United States Patent 7,868,149 (PLANT GENOME SEQUENCE AND USES THEREOF) - sequence listing, part 3

SEQ ID NO: 1000 - DNA, 18000 bp, Oryza sativa
aaggggagtggtgctgccaacgccgtcgtttgagaaagagggggggaggggaaatgatttacgattagggttagggctgccgacgttttatatatgttcggatcaatcgggaccgtcgatcagataggacggctacggcttctcccactcgggctgctaacgccacacaattgggccatatgtacgctccgcatggataagttcagttttggtccctccagttgtcccaaatacttactaaaccaaggccaaaatcagattcaagccatttaaaattgctgggaaattatgatcaattatttaatcagttagtagattatttttagataaatgaaaccaacaaaatgtttatctagaaagtattaattatatgatattgtatttgaccaacgttaatatggttttatgtcaaaataataattatttccttaaatattaaattatttatagaattcaaacatattccactaaagattttatttcgatactataaagtgtgtgtttctttcccattgcagacgctttgtagcactgaaaaaactgaaaacatactatagtagagtgcaacaaagcaacgaaacgtttaacctcttttactaaatcccgttgcaacacacggacatatttactagtaccaaatataatatgtatctaaactcgtaaaaccgatgtaccagagatcccagggcagtataaagctcggctttggttgaacgagttagctacgtatggcccacctaggcacccggctaactcagtgtggccccgcgtgtcagttgccaatatttcttcctcctctctctccgtctcacccatctctcatcaggttgggtcactggaaggcaggagacggccgacaggaacaaggcgagccgccggcgggaggtgagttgcgggaggccgagccaccgatcgaggcagcacagacttcatcggtaggcgatctctgcattgttagcatgcatgtgtatgtcgtggactccaaggtaggaatgtggaatacttccaccgttttaggttataagagcaaagtcaataatagagtaagcagcaagctttaatttttttccaactcatcaaagttatcagtatagcctctgtatacaatagctagctatactgctgggtccatctatttcactttgcattagaataatctacccctctctcgtaatgttctctctttctccgttgattggctagctatccatcatcaatgcttcttatctcgatagatgtgtgcagctcggcgatagatttgtcgtcggctcacgttctctctctcccctctctcctccagctaatcacgacagttgatgtggcattcctatcgtcagtccacggtggattattgtactcgctctaagacgttttgagtttgatcaaagtcaaactacttcaaatttgactaagtttatagacaaatatagtaatatttataataccaaattagtttcattaaatcaataattaaatatattttcataaaaaaatgttttgggttgaaaatgttattattttttctacaaacttagtcaaatttgaaacagtttgactttaaccaaagttaaaacttcttataacctgaaacagaggtagtaggagacagagaccgaagagcatgtgaaggctacaagttgtgttagacttcagggtggcggtggtggatggcctcaagctgtccaagcgcctcgtcctcccaagcagcaagccctattgtgtcccgttgttgcgatggactgggtggccgcattagacgtcaccttgctgctactaccggcgtcgatgacctacaccgtggtgatggacccaggtgccatccacagccccagtgtgcctagctaccagccacacgtttgtgactgcctggacccgccatacatgaagaaggaggcggtgaacatgaggctgacggcgaccatgacaacccacctctccaccaagcaaccaaacaccttaaacccaaatcccccttccctgaattcgccctaaattcatcgctccccgctagagatcgacccatcggacgccgatccagctagtcgacgaggtcaccaagtaatgcgacgtgactcggtgcttccgcgcagagtgcggtgagctcaaggcgcgggcggacaagcttggcatcggcagcagggcagggtcgttgacggcaaccgtcttcaccctgagctcatcgctgccgcctttccgccgatgagtgagcaagctcaagctcgttgcccagctcctctccatcggtgctaatgccaccctactcctctccaccaatgttcttgtcgcctatctcctctccgccgctcttctccctgccggccactggccgcgtcgccttttcccgtcgatcgtgtgctcctggaaagagatagggggaagtggagattggagaagctgtggtttcacactttaactgacatgtgtggcccatatgttttttgctttttttttttgtctttagtgccacatcagagccatgtcaattaaaactgcttacaatattttcttgtcctcttggaactatatttgtactggttttacaagttaagagatgtgttatatttggtattacatattgaggatgtaattcgaactcgacgctaagttgaggtactataagtgaacttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacggccggccggcgatgaggcggcggcgacccagaagggaaggccggcggcggcggcgggagcacggagagcaacaccagcgtcttgtgccgcgtccaccgcggcgtgccagcgccggcggccggcgaggtcgtgttggcggcgccggacattgctgctgctgctgctgcctcccggaactcgatcgagacacatcaagggatccaccagctgggatttatctacggccatcgcagccattaaatcgggaatcaaagcttgcaattttggcatccagcagaaacatgcaagaaattaatctcgtgctacaaatgccatctcatcatactcatctcttcttatctcatccaactaagaggccatagaaaatcagtgtcattctactggcaaatcacaattaggcaaaaaaaatgcaagaagttaatctagtacaactaccgcagctcgcagaagggcaccggcgaggagctcgccggagcgccactgccgccgctttgcctcagggcccttatcaagggcttggtcgccgaccacggcgaggccgcgccggccgtgcacgcacacgcggccaagctcggcctcgaccaccgcctcgtcgtccgcgatgggctcgtcgagctctacctcgcgcgcgtcgagctcgcctccgcgtgggcgctcttcgacggattccacgccggctggccgagacgtcgtttcttgtacggccatggcggatgatagcggcgtgtgcatcgacaccgtcgccgccgtcgcggcgttctcggcgtgcgtgcaaatcggggaccttgcgctgggtcgggagctttaggaggatgcccgtgaagaagaacgtcctcgtcccggccgccgccgccacgtcgcggccggccgtcggacctcctcgccccggcaacgacctccccaccaccggccggcttgcccaatccagagagaagagtgggagagagagaagggaggaaaggagaggaagggagaggctggttgttgacgtggcatcctgccgtacggggctcacatgtgtcctacgactcagccgccacgtcagataaatcggggtcaaaaccgctgagggacctagtttgcaaagttgagggacgcgttgtatccggttttacggttggaacgattttgtaactcgaggacaagttgagggaccttcggtgtactttttccatcggattctgacgaacggcccatattagttttgtcggaacgggatcgtgagttcgtgacggacatatgggctgaaaagtttggcccggaaggggcgtgtaccgtgagcccatattgttgggctggaacgaacgggctacataggttaggccggaacggtatcgcgacgagcgtgaagcccatataagttgttgggccagagcatgattctcgttcgatctccatcttgacctttcacgtcgctaactccggaaaatttgtcgatgggcggacggtcgctctcgcaccatcacacaggcaccggctgtctcccatagtcccatgttccagtgaattcacaaggtacaccatgacacctactaaaaaacaaactttagcacatgaaggacttgtggctgccgttaatgaagccatcggaagttcacaaaaaagaggccgtcgtcaaatcttgtgccaaacatcctgtttcgttacagagagagggggaggacatttcaacgtgcaggcgttgccggtgatagaatttggttcctcgtgagcaggcgtccttgcggatatccagccgtcggtccaaccagccacaagcgtactaccctgtctgccgaaccggtcgagttgaagatcccgtccaatgtagcgcgcagtacacaaacatcttatcccgtcgatcggcacacatcggcagtacagtcggatcctgttcctccatcgccgtgaacagcgagcggtcgatcgatcgatcgcgacctagcttcctcgccgcacgctcgatcgaatggcctcctgcatgcctctaggccgacggaccacgagaacagcccgcgggcagcgactcctgagccgacggatgacggatcgacgagactcgacggaaatgccgctttgccgtgcgggggcgcaagcacatggcacatggcaggcagcagcaacaggacgcgcaaccgcgacccgcgcgccgctggtgcatcgcgtgcggccatccgtctcatcctccgggatcgcgcgcgtgcgtgcggggtgacgtacgcgcggtgcggtgcgggctccatccaaccacccgccgcgcgacgcagggcaggttttcgccggagagagcgacgcgggatggatggatgagtaggcgggggggcgtgcacggcgccatcggttcggttgggccgggcgctatcgagccaataatgaacggaacggtccgaactgggaagaacgcaagcctctcccaccgtcgttacgcgcgcggcccacaccgcgccatgataggatcccacttgacatgcacttgccgtttcgtgtctaggtaagacaggagtagttagctaccgttaagtactactagctccctttctttggaaatgagagcgaaccgcttgcaaattgcttttttctcgtatgattgagcgtgccctagctaacgcaattgatgagatgtttaagcgagcgaagagcacgattctcctcgacaatcatggacaaccaccgaccggggcaaagaaaaccttccttccaaccgtcattaaccagtgctgtaacaaccacgaaatgcatgatggtgtctctgatgatcgaggcggttggatggatgaagaagattttgcagcgccctactgctacgagagattctcttcagacgagtaggcgtggtgttccattcgtgcatgatgaatctctttttgtttgggtgcgacctgcagatgagttccctgggcttcagtcgccatcacggcaagattttgtggtccgttttggtgtactcaccacatgcttgctcctcgctctctctccatcttccaaacagtcatggcctcttcagcgcatggcgtgaatagttcaatgccttcaatgtgagacctggttctattatactccctctatctacaaataattaaattatttgatgtttaaattttgcctataatataacggatcctacattattacttttccaattcatccaaccattacatttgttgctcaattttatttgcatagttggcgttatctttactaatctggtaaacctataggacaatttcaccccagctcaatactatactactgttaaataacctagaacccctaatatttacggacaaaagaaacacttcgcatgttaataccatcatttatagacgaagggagtactgtacatgctaatgtcggtggtaaaaattttgacgagcaaaaattggatttaaaatttatattatatggtatttttaacttatttatgatggaagtggttcacataatccgcctctaccaaaaaccacacaaccaaggtaaattcgcatattgtatgaaatgcttatgatcaactgtaattagatttagtatgtgtttggttgaaagaacggaatagattgagatgaggcgaatccatttttcaagttgtttgatttaagaataagtgacatcggatcatgggatggttcgtaatcccataagatttgggtcagttttacacctcagaaactaacggactaatcaatcctacccacctcctctctcttattgacaaatgagccacaccctccgtaaagaaaatataacgattctatctgtcatgacaaacatatgactaaaccattccattcataaaaaatatagattatctcacctcattctcaaaccaatcacgcacttagattatactccctccattacataatataagggattttaaatggacatgagacattctaatactacgaaactggacaaagagtatgtccaaaattgtaagactataatgtgtcacattctttcaaaatcctttttattacgggacggatagagtacaatcctgccgcagttagcagtagaagttgccataaaagagtctttgttgtactattgtctggagtgaaaataagccccttttcaaattagaagtgccttagaatttaagactcgtgtacgctctacgcggttcctacatactttatcgaacgtgagtgatggcagattgcagagcttgctcaatgctcggctagctcaaatatccgtcggtacagcccaagtaaccaacgtaaacagggaaaggaaattgtggcgtgaaccttatgatgctcggagctgaaagctcgggacgcttgcaaaataaggcgaatcaacgcatggtagctagtaggagattgcccgtgatgtccgggcggcccatgcccatgtgcagctaacatggcgtgggggcacgaaatggatggttaattagtcacttgatagactacttctttttgaaagattggcacgcatgttctctttgaaaggaacggattatgacgggaaagctaaccgcgattttgttttcttgtcctccaatacgtgatctttgaaacatcgatggttccgaattcatcacgctatcatttccgcctgctaggagcgatcagctgctgccctgtgctgctagtataaaacttctcctgttgcatggtagtgataatttactaaaattacgatgacatagaagtaatttgtactgttaaactaacaatgacgcatctccgaaagaaaattttcaaaagggctttatgaagttggttgggggaatccattaaaacttcgtgtttgacctctgttgtgtaccagcaaaggaagcaggaatcacgatacgcgacactgtcgaaagaaaaggtgctacactaaaagcaactgaagaaatgcactgcaagttcgcaacgtgcagatcatgaatatactcccaagcaaaccggtggaagagcgcaccaatagtcccattccttgagccactaaccaacatttcctgcaggccgatccttacaggaggcacgaggttacatcgataaaatcaggatcagagtaggtttggagcgagtcagcgagagacgtgttattgcagccacctgtcactctgccacatgtcacaggaaaaagaacagtactatatgcagaggagatgaacgaagaatgcccattcaggtttgtcagagcaaaaaacgtgaacttggacaaacatgcctgcagtttgtctgaagatttcgatttttatacacctttttttgatcgcctacgtacgtggccatgtttatgccatattgccatgtgaaggtgtgaacccttgcaagcacccatgggcgtcaggctatatcctagtcctaaatcctaatagtatctgagcttatcattgggagttcgcactggtaattttggcatcaagcatgtatgcactagattaattgctgcactaatctatattacctagtcctaccaagtaaagttactcgcggctagtcctactattgattcttgtatactcctagtcctacatgatttacatagccgacagaaaaatctggggatagtcactttgcctgatggtgcaatagtggcttcaatcttcagcctactctgctggcgcattacaatttacaattgtgagaacggttatgccttttagagcaagtttaatagtatagtccactgctaactccaaatcatctatagctaacgtaatagctaattcatataatagttgcttactatactattaatacatggtcccacctgtcatacacacattacatcttggagtccgtgctgcagctggctacagatctgtattatagttagtttatagcctgctattgtacctgctcttacaacatcgaccggctccgatttttcggagattatccaatgaacgagaggttcttaaccgaagaatgcaaccttcgaatcttgcgctacgtcggaaaggtgcgagaggcatccacgaacatggttcacactttagaacgattggttgtcattcggtctctttttcgtttctcgcattaatctaccatgcatgcaacttgatcaacagttcaagaacataaacaaagtggtttactttagagcatttgagcaaactgtatcgcgtagtccgtgcatttgaccatgtctatcctggcacgtaaaaaaaacataaacctgcacgccaagtcatgtcatgcatgtacacttcgtgcatgaatcacacgagagacagcccacgacgcgcagccacgaagcatggccatccacgataacgtaccggcgtgtaatcgaattcgtgaagcatatgtctacatgatcacatggtcggtatggtcccttcacacctgcgaaattcgtggcccatatagcttctgcgagccatgtggcaagtatcaaagttcgccgatttctcgtttaaaaaaatgctcggtgatttttattgtttttttttcttttgctgcgattaactggacttgttcctgcagacacacgggcagttggtgtctccttgtgcgtgacgcgcgggtccgacgaggcgatgcgacgagcacttgcatgtgcggggctgatcgccctgatttgtatgtgttaaccgccgtcgtggctcgtggccggttatggtgggctcaccttcctctcgccgccttttgtctccttttccggttctctcctctgtcgttgggcaaaagctatcaacgattctaactgccaaggaggagtcgcctataagtacctgagcccgggagcaccgctctcttcacaaccaagcaaccatcgattcgatcctagcttaagccgagtgaagtagctagcaggacattgttggtagtgtgatcttctccctgttttgcaacaatggcctcacgcagtagtgccctgctcctcctcttctcggccttctgcttcctcgcccggcgagccgccgccgactacggctcctggcagagcgcccacgccacgttctacggcggcggcgatgcgtccggcacgatgggtacgtgtgcactgctcctcgtaacactttgtttttttttcttttggacgcattgacaaaaccgggagtaatctgactcgtgtcgtgttgtttgtgtacatgaaaaggcggggcgtgtgggtatgggaacctgtacagcaccgggtacggcaccaacacggcggcgctgagcacggtgctgttcaacgacggcgcggcgtgcgggtcgtgctacgagctgcggtgcgacaacgatgggcagtggtgcctgccgggcagcgtcaccgtcaccgccaccaacctgtgcccgccgaactacgcgctccccaacgacgacggcggctggtgcaacccgccgcgcccccacttcgacatggccgagccggccttcctccagatcggcgtgtaccgcgccggcatcgtgcccgtctcctacagaaggtgagctctacttgggtcaatgggtcacgagtgagtggcaaactgtttgcaacttgaagccatgggccccccgtgcggtgtgtcggcttcgatgggccgatccccaatcggctgatcaggccatgtgtaggtgggccacccggcagatttggtttgtccacgatctgtccgtgtcggctgtaggcaaagccatgcacgcacgacttgacaccgacgtggacttgacttcgctgtcccggaattactttacgcatcccatttcacatccatatgattaatcgttgcaacaaatagtaacaaattacagttaattctactgtttcactgaactttgctttttttttttgctggtgtgttgcagggtgccgtgcgtgaagaagggcgggatcaggttcaccatcaacgggcactcctacttcaacctggttcttgtgaccaacgtggccggcccaggcgacgtgcagtccgtgtcgatcaaggggtccagcaccgggtggcagcccatgtcccgcaactggggccagaactggcagagcaactcctacctcgacggccagagcctctccttccaggtcgccgtcagcgacggccgcaccgtcaccagcaacaacgtcgtgccggccggctggcagttcggccagaccttcgagggcggccagttctgatcgagtactcggctaattccgtttttcagttcacttttctgcagaaatgtcagtgtgagattgagattgaggtggaggaggagggaggcctctttgctatagtaaaagagaagaggctttggctattctgaggctgcttattaattagcacccgcttaggcctttgctttctcccataggtccagtagacataaataagttatcatggagttgggcattttttttttctgcattgttgtagccttggtttaaaatttggcaaggcaatttaaggattatattgtagaacagcagggaggtggtgtcttgtaacttttgttgttacattgtaaccccccgaatcaggccacatgggccggaggagtttgtgggggagcaccggagcactcttgtgcttttgggaccatgaactatgctagtttatgggtctatgtatatgatatgtttgtgatttgattatactttcttttgtcgccttatcaagtaccaatcattattaagtactgtacgtagtctctgagtgataattttgaaatctttgtgagcgcatattttaatcgaagttgaaggctatttttgttcgccattttttgttggattgtcaggatgatttgtaggcaaaagttcacaagagaatttatatgttgcttcttcaaagttcaaaacgattcatgagtgagaagaaaatgatttgtgacaaagctttgtgcctttgtctgttttcagttcgacgtacgaaacaaataaaacgggcccatatctattccaccgcagaattccagcttgaactatcaggccattacaaattcggcccactagagcatgtattctcaaaagcaaaagctggccatatctatgctaccgcaaaattccggcctggactttcaacccattaggaatccggaatactaaagtagtagtacgaagtagtattcttcaaaaaaaaaatttctttgatatgaagtttgttttgtattgcaaaatgtggcttgactatccagtataagtgtataactattctgttcacgtatgctgataaaacaccaggtagactgttcaactgattggtctcacacccgacctaacggctaacgcaagaactttatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaatgctaatttttcaagcctaaaattgccggggcggacggtgaaatcaaagacgaacttgaatttttagccgcatcgtttgacagtaagccaagcattcaagttaagttagatggactttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaatccaccaacattttaagcaagacaacgagcaaccacccaccaccgcacggagggaggaggatttctgcctctcgtcgcattcgtcctctctccctctctcggttctcgcggtggtggccacgggcgcaggtgaggggatggtggacggcaggatggccggcacggcggcggcgctgggcctgtcggtggtgtcgtcggtgtcgatcgtcgtctgcaacaaggcgctcatgagcacactcggcttcgtgttcggtgagccctgaacttatccgagttatctcgcgtacagtctgtttctgttggacgccattgttcgagatgccaggaacatcttagcggtttatactgcctttaatcgatgcgtagcagagtccccgttgttcccgtcttgtgcatcgcctgcgataatgatttctgattaagctcagtgacggagaatgctttggcctgcgtagaagacaggaggcggcggtgtacggcttgcaaacgaggagtaatttgtgaaaaaaaaacttttatatacatgttcttagcgaactaaaagcaaatgctgaaaaataaagttcgataaaaatacaccaaaatcagcttcaaatttaaagttgaaaatttaaattttggctgataaatataagcataagcgaaaagatgaaacaaatagtttacgcaagtacctcctacaagtacactgcagtttatgtgtcactcgaatggttataaaaaaataaaaaaatattaagaatatataaataatatgtgatatattatttcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaacatggccgcgtgttcgctgcagagcatcccgcccggatggcgttccggggaccggggatatcattacgctcctcagcctccggtctcctctgcgccgtgctcctcagccgccggtggcgccgactggtcgccttcgccccagccctcggtcctcgttccaccggagatctccccgcctcgcgctcgcctacctcggttctatcgatcaccctcttgaacctacctcgctcgcctactttgcgcttaaaattccgcgcacatatctggtctgtttgctctttgcagagatcttggtaagtagatttcgagtctacgaacatcttattcaattcccgcaaaaaaatcctttaaattcctccattccaagggaggcctaatactattgttctatttaatgctagcatctagcactctgtccgcatacattggactgcggcaatacgagcttagagcaacgcaaatgactagataagtatgcactctaggtgttctttgaattgcctcagtgcagacttgatgaccattttctgaacatctctgctctgctgcatatgtgagtcaaattcatggctccatgggacaattggaaattgcacaacgttactgctatcctattcatgtatttgttgaacaaaaatgacatccttcgaaaattcaggaaacacaagttgcctgatggacacggttcattaataaggcacacaaattctatactactttatgagtacaatatgacgaacaataccacctgagaaaactaactgtttcctaagctatataaccatgcaaaaatcacagcactctcctaatttctttcagctactacgctgacaagctggcatctcctggtgacattttgttcccttcatgtggctcttcagatgaagcttttcgagaacaaagatttagaccccaagacaatcattggatttggaatactaaatggcatatctattgggttgcttaatctgagccttggattcaactctattggcttttatcaggttggtttactcttcagaaatcaggccaatcttgcatttgtttatttttcctattttgagatgaacatattcatcttcagcaaacgacacctgttggaaactttaaaacttaaattcttgctggaaatttagtagttgaccttgattcatgcccaatctgaaaatcaacatgcacacaatatgttgccctgattttattggggatggaatgacacaattcaacagtctctagtttcagccaattcatgttctttgtctacagacctaactgtgcttgtgtaattagtctactgctttgtctaagctatctcactctatcaaatgcatcaggtaaccaagctggcaataattccatgcactgtatctttggagactatattgttcaggaaaacattcaggtctgatccaaattttgccttgtcttatgtaaaaaaaaaaaatttgccttgtcaattcacgctgaaaaaaaccattaactactaaatatatgatgattgttggtatccttgtgaatacaagcatggtacttgaatatttgaattcctcaatacctgtgggtcttgcaatcctaatgtcatactcccataaaacaataacttgtagtactatcataaattgaatagactataacaatattttcacttcatgcagccggagaatccaaatggcactggcagttcttttgtttggtgtaggtgttgcaacagtgacagacctgcaactgaatagactgggatcgctgctgtctctatttgctgtactcaccacgtgcatttcacaaattgtatcctctaaacaaagtatacattcaatattattttctttgcactaaaataatgacacttgattctttgtttttaatagatcaataatcagacatatgcattatagaaaaaatggcttttggtgttagctcatatcaaatatatattaatttaccagataaatagtttcttatatctattttgatatgcattctcttgcacctaaagtggatgataacttttaacatactctgaaactctgatagtttctacgacctccgtcccaaaatatggcaacttttggctatgatgtatccagattcatagctaaaaatgcttacattttgggacggagggagtaggtgtttctcaaatttaagtagctgatctgatacacgttgttttttttctctccatttttttgtatcagctataaatatgtggatccaacgtagtatattgatttaacatcatatccttcttctgctatcactatttccttccccatacagcttaaccaattttgctagatgacaaactttatccagaagaaattcaaagtctcttcaactcaactgctctaccaatcttgtccataccaagcgctgactcttttcatcattggtccatttcttgatggttttcttactaaccagaatgtatttgccttcaagtacacgagtgaaatccttgtgagcattccctggctcgatgttccctttcttatttgtcttctatccattatacagtaatatatctgtttgttatctttttgtcaggtattcatcgttctttcctgtctaatatctgtctcggtaaacttcagtacatttcttgtgatcgggaaaacatctcctgtaacataccaagtagtaggccacttaaaaacctgtatcatcctcggttttggatatgttttatttaacgacccatttagttggaggaacatattagggattcttcttgccttgttaggaatgatcctgtattctttcttttgcttgatggagaataaacagaaggccccggaattgtcagctccatttttccacactaaggtatcagatagcacttcttttctgaagccttaatgctacatttgcgacttgcagctatttttttcatatctcgtccttgcaactttagctgacccgttattttctttcactaacttactttttcgtgaatgtgcaaaaggattacacgtcaatatattagaactttcactaacttactataattccttgcttctcacccatcggtaatcacccttgcttatcaacctggcaggtgaaaggaggtgaagcagggactcttctcctagtacagaacgggtcagctaaagttgcagatggtgttgtgactgagggcccaatgtggaggtcaaacagagacttggacgcatgatcatcccgctcctgcagaagggatcaagggactgacatatggtctgaaaccggtgtaattttcatcggcattttgctccagttcactccagctagctagttctgaaggctccttgctctgcgtcttgtacatacatattcggcacctatttttgctacgactgtacataacatgtccacggctggaattaaacaaacatttgcattcatactattatatgaagatttcatgtctgttatttacccgaagagtaaagtgcacaatgcgtttgttggttggggatgggaactaatcccttcgacatgcaaaacagaacgaaatattaacgcacgattaattaaagtacaagttccttttctttttaaaaatggatttatatgatttttaaaaacaactttcgtatagaaagtttcaccaaaagcacaccgtttagtattttggaaagcgtgtaggtcgaaacaaaaatgatgaattcacttgtagacttttaaatggttagactatgatgaagaaatattgcatgcttatatttaggatgaagggagccactttgataatacaaaatccattcaagtatttaccaaacttttgtacaaaagacaaaagtgttcacagatctgctacgcatttgcaaacggaggtagttgtagtagtacgttacgtcggctgttctgttcccttctctgatataaaagcgtgtagggtgttgcaaagcggaaagtggcaaatacgctttcgcttatgaaccccgtgggccatggcccttatatattcctacctgacaacttagaccgtcgatccaacacacgaacggccaggatgctttgccgcttctcccggttctagtataaaaggccactcgtggcgcaaaccctagtagaggagagattaccttggaggcttctgagctcgaaccccccgcc

SEQ ID NO: 1001 - DNA, 38608 bp, Oryza sativa
atccgctgctccaactgcgccaagtgctgccccaaggtaaggcgaagcgaatccccttttgccctctctcgttgcgcgcgaggcacccactggatctctgtgttgatttgggaatctttgctttgggtgcgggacaggacaaggcgatcaagaggtttcaggtgaggaacatcgtggagcaggccgccatcagggacgtccaggaggcgtgcgtgcacgatggtgcgtttcctctcccccgcttttggtttcttttgctgaatttgtatgtgatgcgaaatcgtagtagaggttggatttgtgatcgccgataacacactggcgatttgcatactgctggaaatttttattctatcttgatattgttgaattgatggcatacaatacaactatctcgttgcaggatacgttctccccaagctttacgccaaggtgcatcactgtgtgtcctgtgcaatccatgctcacatcgtccgtgtccgctcccgtgagaaccggagggaccgcaggcctccggaacgcttccgccgcagggtacctgatccccgcctcttaactattatatctagtgcttaattgatagtgtaattagtatatcatgatcggaacgatttcctttatctgttactgcagatttaagaaacaaagtctgatatactaatagacgtaatgattttgcacagtatttgtagatatctcttatctgcacatatggtctaatatctttcaagcacgctgaaaaattaaaattctttagtgtgctgattctatgaagtttaccatttagcttttagtcaaatgtaccggcatacttaaggaagtatactcattcagccagcttctataatctgaaatccactgttcttttttggaactgcatgtcttccctgatggcaaatactacatgttgcctgtgggataaacaggtccttgagattcacagcatcattttcacaattggctgatggtttatgtgtaacatttatgttgggatatgtatgatatcctacaaaaaagccagctaccaaaattttgttagggcctcaatccaaaatggccctaacatcaagtaatcaattttcatcgaattcagtagattgtaagctagctagtctgttgttctttaagacaaccttaatttgtgttaacctgttctaattatggaatgctgattgttttgtgccaatgcttacagtatctagcttcttgctagtgggtttgtgtccctctttgttgcatccagaattcagatgcgtttgtgatagtatagtagtatcaaagtggctggcctatgtatcaaaaccacattaagatatctgcaaatatgtccactcatcctagaaagtgattaagaggagcgcatggtgtagttgcgattgatgtgtttaggctgctgttattgatgggctctattgtttgttattttgatccatatttttttgttctcaagtctatttattttggagcgatcttaatcgtgagattatatgtttctaaactagttgccgctattttgcaggaggataggccccaaggccctcgtccaggtggtggcgctcccgctcctggtggagctgctgctcctgcccccaacgttgctcgcacctgattgtctccggagtgataaaccttttttcagtcgtttccctaaatctagcatgataccagggtgttgaactttatctaggaccaacctgttctttttcaaatatcggatctgctgttactggtttcatctttactaaatgtggtttaccatttattcgattcgttctgttcctactcacgccgtgtcagacgttatgtgccgtgtgagtttttctgttcctgctcatgcttgtgagagcaacatcgtatgttctcctaaatcccgagtatgttactttttctttatattcagccaagtgaaacacaatggatgctcaatgtacgttcctgaccaaaatccagaactctaaaggccatctttgtgcacgaaactctgctgatcgggccaaaccgcttggcttttggttcaagctttttaaaaaactgtaactgaattttacattttttgtccagatttgtctggcttatgtcagtttatctcgcggaatccgacgatagcgatggattgtgaatctgatccggccgtccaacttgaatcagacaccatataagatgcctttttgtgggtgggaaatcatttccatttccaatttagccaaacattgcctcaggctgtgagcctgtgaccccaccggtcagtcggccaccgccacctttgcgccatactgcctcccatctctcttgtcaagtcgtcagccagccagcctgccccgtcgtgcctccactttcccaccaatttaacacgattccaaaccacggactccatctggaccgtccaccagcgcatcccacggtcacctcccgtccccacgtttttctttacacccacgcaaccaccacccaacctcaagagagcacgtcgcgtcgcgggctcgcagccgagttgatctgccgatcggccggcggcatgacggcgacgtccagggcgccggggtgggcccgggtgcgcgcccccgcgcgcgcgccgccgccgaccccgatccggacggcgcgcggcgcgcgctccgcggcggccgacgagctcgtcctcgccgagttcctcgaggcctccctccgcgtcccggacctcgccctgccgcccaagatgagcagcaggcgctcgttccgctaccccgcgccgcccccgaccccggacgtcctcgcgggggccctcctgtcgggccccgacccggacgccgcgcggacggctgtcggcgccgccgcggagtccggcgcgttccgcgtgggcggcgcggtcgatgccggcgaggtgcgcgcgcccgtggaggcggctgatgcggtgttccgggcgcccgaggaggtgaagcgggagctcgggaggtggttccggaggagggatcgggtggccggtgaggagttctactggttccggccggcgacggcgagctcggatgacgaccgggtgctcgacgcggcgctgcccggctcgacgtaccaggtgttgaggtatacacgtacgccacattccgcctgcgctttttatgccgctatatgtagtaagttttgtccttttctcgcctcgtccacatcaaacgtaggtgcatacttgaagagagtttcagaatttgagcggttttagaagccgattttgatcggataaaatacgtgcgcacttaaaattatgcaaaaggatcagtttggtcatacttgcgtttttgttagctctattgaactactctccactggactggactgaagaatatctcacttgctaccgttctctcgtcgatgtcaattggaatgagctgtagtctgtagagggtacggaactgtgtacatctgttttgagtaccccagagcctccggtaaccgttgcaacttgcaaggaatggaaggcccatttagatgtagagagcgagctagagaaaaaggctggcacctgaaatgttgcaggggtacaggcacagcccatgcaagtatgcgacaagaaatgttgtgtggttttcttttgaaggcgtggatgctgtcttgtggagtcattgtcaaactctatacaacatgccgttccatcacttattttgttccaattttgatgtttcggaagaaaatatcagtggaacaataataaccataatattctgtttctttagcctgagtgggatttccgctgattcttagcgcagttgtcaaaaactcaaaatacaccaaataaatatagccatgaatgtcgaaaattcaatggatatgcgaacgggcctgttctacaataaccccattgggactttcataatggaatttttgtgtacttacatcagatccttcacttcctagggaaaagatggagattgttgcatccaaaatggaggatcttgcacaatgcgttatgagagttctatctgataacgccaggaatcctgaagactctgctctgtctacaggggccgcgtcaatactatgtctgacactatataactgtaacaagttgaaaactcattggagtgagtttggcagcaccaatcctccaaactcgtacgctttgagcatccacctctctggacgagaccaggaaatttgtctgcggaatcagagcgggtcaactttcttcagtttgccggcaggctctatgcttgttacaatcggcaagcagattcaggtatcaacagaaccattgcttattaccatattacttattgtaattctaacggaaacttactaagagtcctttttttttctactcagaacttgctaaatgaactcttaaccaatgaattgaaattttcttatacgcactgaacatttgcatcatcctttatatactatcaccgtctcatactttcattgacatggtggtccttgaatccttaccccaggtctgccttgtcagtacattttcgtaagtattcggtgccatatatgggatcaatccaatccatgtagcctttgtaggctaaattctaattttctatccatctttcaagactgtaatatgagcaatgggcagtggtgcttgctgtatgcacagtttgatccttccatgtgtggaatgtgacacagttttgctatgtgcgaactcaggaatggtccaatggggagttcaagaatgctgttggtgagatactatttgagctgactgatgaaccaaacccgttcatttccctggaactcttgtactcaccgggtcacctgcgtcttcctgatgttggtcgacacgcaagatgcattgaccatcccaagactgtttctttcagggaccagattttggttgctctggttctgctcgttttcttctacctcttctggagataattgtacccaggtttgctcattaatcatgccctcctttgtcaaggcaacgaagccgtgaggtcaagtgtcctagaaggcttatttttacagcttttcttggacttagcttcctgtacttcttcattaatcgtgggggagagcaccgcacgggtggcggtgatgacaggtagtttgagtttttgcctctgtggtttcaaattcagattttgttgctgttaaacaatacgtgatagagtggatatccaacttgaagaaaatgatactgggtggattttgatttgttgattgaggcttgattttgctgttgaggtattgtttggaggtgagatttttattctattacgatggaggagttgtttgtaaaggtgcaaatgtttttatgcttcacaaaaatatattacaatatatgatattattgccatgaccatgtgaaaattgttcattgtatgcccgcaagttgcaactattaccttcatcccaaaatattgctatgtaaaataggatgtgatattatttagtaccactataaatctggatatgacatattcgtattactagatatatcatggatcctgtttagatttgtagtatcacatcttgtcttaggtgactgtaatttgggacggaggaagtatcacaattttcgaatgactattattggccgtacactcgtacttatttatcacctgaaatgatcgttctacgtcctatgctcaactcggttgcttttctctacacagtttcttcgttgtgtcggtccagcatgtggtgaccacccctcccccccaccccaccccaacccacatactcgacctgtggagtttcatggtgatagatctccaaaagtacgtacctgccctgtcatgtcccgcgctattacagtgtactagtgtactactgctctgctcctacttgaccatgctcaatcgatcaaaacctgagctttctttcagtaaaaaaacgaaaacggcgttgcagactcggactagtccgcagcagtaaaacgcggcaccgaaaaaaaggatcacgaagagatccacgagaggggagtaggaacggaacggggcctcgtgacaagaaaacgggggtccaactcgaattgaacggccacccgcagcgcgacgcaactgcaggcacacagtcgtcgccagtcgccgctcgtactctctccgcgaccatacgtgacgccgtgacggccccgtccttttctcgccaaaaggcaaagctctgcacgtaggtatagctcttgcgtttggcagcgacgacgaccaaagaacgcaaagttgcaaacgctgtgctctgcctcttcttctcgtcttcttcttcacgggttggttaccttgggtttctggcaggttgtaggcacctgaaagatggacgtgcgaccaaccaaaacgccgtgctccgtgaccgcctcctcctcctcctgcttcgtcgtcgtcgtgttgcccgcgtggtggcggtgtgcgtgagagagtctgggggccttcgctgataataaatgtgggcatctctcggacgattctgctgttgtgctgctaggaccaaggtggtggcaacaaggagaaggagaaagggctgtgggggggactggtgggctacaggccgtgatgccaatctctcaacctccaccgtcctgtgcgcgatcgatgttctagtgtacggtacaggcagtgtcatcctaatcattgcaatcattggcgccatctttgctagagactcccaatccttcgtctcgttgtcggttctattggcttttcccttttgtcacgtccttctgatcatccctgaatttttagtagtaatttttacttacaccatgtcaaaggctcaaagccagcatcttggccttgggcatgacgcatacacgtacaccattttattcggttcagatcgatccttcctgccgtcgatcatggtaaactagaccgtaggtcgtgtcctgcgatgagtgaaacactgctgtctttgtcattctggtacattgggccattgggctgcttcgtgatgccgtgcgcttttgcagtactactagtaagcagcaccggctgcctgcttttgcctggtaaaacgagtgctgtgcacagcataacggcacctcaattctgatgtgtggcggtcactcatgaaggctgctggtagtagtagtaacatttcgaggctgtgccaaaagttacaccattgaattggatctgcaaagggccgtagttacactgcactggaggttgagagacatgaaccattcactctgcactggacgagcactggccatcagccgtctcttcttcagtctctttctctgctgcaggggtgtcacagtcacttgtttgctggagttaattaagctccccatttccattgttactactgcattctccctgctctcgatagtcggatgtgatgtctcaatgttaaagcccttcactgactaatcactgaggcctccgagagagaacgtagtgaatgcccgatgtgtgtggctgcggcttgcagctgcagcgccttttgtcaggcttacatgtacagtagtatatgatgtgtgtgtagagtaggagtaattgtgtacagcatactcctactgtagtagaggaaggaggttctgatctgcagcttgtggggtgcagtaggagtaatactccgtgtactccagtatttgacactggatgcagtgaaactggttcttctgcttcttggcagtcgttcataaacgatctttgcgagaacggtaaacaaaccacgcatacgcagtactcatacatccatgaatttctctctgaatgagtcgaagctgcaaaccgggacacagattgccgtgtgcatgcccaccacaaccgattggcttccaatcctgtcatttctcagacccgatcctggccgaagcttccaacaacagtacgctatgcagtaatcctaatactatctcgcccatgcacagcacagcctgaagcagtgaagcttgtgaaggatcaacgacgacgcagtagttcacgaaagcatctcctgtttcaccaccgccatggcacgcactgtccctgtgcatgcacatacatgttgactcgagaaacacactgaagaatgggacgcgcgagctgcaccatgtcgtgcgtacgcatcgacgatggcgtgcaggttcaccctgctggtactggtacagtaggaccgacggccggacggccggcaagatgggtggacagtggtggacgcgctgttcccgggtattcacaaggtagaaattctacagaaaatcttctatcgcccaacctatctttgaccccaacagccacgcaaattcttgtcgaaattgatgatgtaccactactagttaggtttcagacattcggcaaacacactggcatagtggcatgcagctgaatcatcatccttccctcacatcagatgccaatatgctaagaattcagtggctgttatcatagttgcaagatgtgaacgccacggtggttgtttccaatcattcccgtatggccgtatcgtgctatgctgcaacatttgccaaggaaacgagctattagctagaggccatgcaaatggggacatcgtcatctgtggaaccctatgctgctcggggacaaacggagcggagctacagctcctggaaccatttcaggggtatcccatgtgtcttgtggaatgaagagagcagaaggaattaaattcagaatgatctgatccttaggacatcaaggggagccacatgacgtgccaagtgagctccaagctcaatccaatttatctaagatccgccgatatctggagcttgtgtttattagacatggctatcatgcattcatgcatgacggttttgttcatgtggtccactatataatgcagcccactattgcgacttcttgaccagaagactcaagatgagcaatcattttagtaagactgtcattgttgccttggtattgtcgagtaggtacgatccatatgtcatgatttcatcgaattgttcgtatgctaatactactatttttaacacaacaaagacatttgccttctactcctactgtggaaagcatcatgttttggagaaagaacatactactagcaagttcagacttcagagtatgtagcactgatactttacagaagttggatgaattctttcctcaagctctgcagacacaggctcctcattgatgaggaatggaatctacagactactactcctactacgtatatactacagccactcttgtatatgatgagatgagtagaaacaataggagcagtaggattgcagtgattcaattgctaggttttttgtctgcaactgttgctacttctgtcctctctatctagctgcactacccacaagctgcgagctcaagaagatcgcaattcgcaaggtgcaacaagctgctagtactactagcattcacaactcacaagcagaataactaaaaagtactaacctgctctgaggaaaaagctcttatacaaggacggactgttcatcacttaaagaggatgaggaccaggaactcgcaactgcatcggtactgaatactgatcgataccaggtctccaagaaacagaaaataaaggaagagagacaactgtgaacatttacttgatggtactaatatgttgacctgtactgtgcttgagaagcaaagcttgtccaacattagtacgcgagtcaaggttagtatcctgattcgtatattagtatattacgatactacgattttatcaaaccgaaacgataccgcgatatcctaattttgatagtatctcgatcctactattcattaccacacgatcctacgtaatcttatatagtatcctaattctacaatccaacaaaatattatttaaaatatgatagtttgaaaataatgaaatatgctcaagtttatatataaaaatcaattaaatatatcaaaactaatgtggtttttcttaataaatatctctatttgcatgacatatattattactatattttttatatagaatggctatatgtaattaatataaatattaattaaacttttaaaaaaagaaaatctcttagtatcccgatcctacgatacgatactactttgagcaaaactatattaactaagatcctaatactgacaaccttgtcgcgagtaactcaatttcttgtaaacacacacagagactatcaattaataccaggaatattttttacctgtatttctttagcagtaaaagaagtataagaaaggcacacttgttgcaagtacaattttcacaatatttagatttaaggtaatttttttaaaaaatactagacacaagagcagtttgttctagatcacgcaaatattctagctagatcaaaatcaacttgctatgctaaattattcgtgaaagttgaatagttttgtaagaaatgataagtttgttatttaaattcttagtgaacagtggcaattgcagacgcagcagaccttacgcatttatatagggtgtgttctttttctctattcacctttatgcatgatgcttatctttcattatctaaaaaaaatatgtgcttgatgatctttgtttcagaatgaaatttgtttaataatctattttagaaatgaacttaaagaagaaaatatccacattatactagctacatgactaaaccagttgataaaggcagacagcaatgggagggtctcttcttctctgcctccactagatggcgttggcgggtgaacgctctaggggccaggatctatcaaatgtgatcgttgacaaacgcagggtgatggaggatccgtttggaatgcttctcaagagcgtcttagtgtgaggattccccaagaggttgctaatgttatcaacatcgacagagaagacctcaacctcctatgagaggaggcctctttcggatatggacctcatgtttcctttgtagttcaacttgattcttctgccttctttgtcggtggtttggatcccgccgtttatgtaattattgctgttgtgttgaatttgtgtaaaagatctagctaaaatctttggtggtgtatctgaagcttctcatcgtgtgttagcacctgaacctccacatatgagaggcccctttagggtttgtgagcatgcttttcttttggcaactcgccttgtttcaagctccgtagcagctgagctccaagcctatgccatcggcgtcgtaggcagccaaaggagaataacccaattgccttttcatattgtattatgttattttctgcaaaatgttgattgaaattgtaatttaatcattctaaaagggcttgtttgcaaaactggatgtatcctatactgagtttttttttcttttaaaaaaagaagaatcagggagtggccatttttttctgcgttcctctctgtaggttattttgtgaaaaaaatagaagtggttaaatttgcaaatataacccaagtagcacgtctatgtagcatgtacatgcaccttgcttagttttcttggcaccctactaaggaaaaataacttgtgtgggagcacttgtgagttgtgactcaaatgcacccaccagacaagatgagtgattcgctattcaattacaaaaatagtgaccaacttaaataagaaactcaccgtgcaagttgcaataccaatagtataatttgcactttaaacaaacttaaataagaaattcaaatgcgatatactactgtaatactccatccacgacatactagcttcttagcgatcttcaacattatagtttgatcaatgatttattttaatttataacatattttccataaaaataaaactaacattatacaaaaatattttaatacgaatccaaaaataaggacgcgttatattttagattgatgaaagtaattcaaaaaagttgctactactaagcattagacaaatacaaacaataataactataacttgaaattaaaggctattttaatctaattattgttatacagtttatgttatggttatggaaaccacataccacctccgtcccaaaatataacaacttttgactatgaatctggacacatagttgtccagattcatagctaaaaatgcttatattttggtacggatggagtacctaatagtagttgactaagctcggcaggaccatcatatattaagtcttatacggaattatatctcgtatatagaaggagttctggataaggaatgacgaatacagttctatatgaaaacgagaaggactactcgaattgtatccatattggtctccctagttctacttggacaaaggggtatctatgggtataaatacaagaccccttaataggaggggagacacaacaacagatagacacacaatatacaagccaacatatgccgtcagacatcaacattagggttaagcctagaaagaccaacaagagggatttagcgtcaaatctgatctcaagagctcatactcgaggaggaagactaccatgtcgtcaactatgtgttggttatccatgccgccaagttgacgacagctcgataggttatcccaattattgtacttgtgtgatccagatgaataaagagtaacaccggcttcggccgacaggagtagggctattacctgtcaaataaggggtccgaacctgtataaaaatccttgtttccatctcttttacctcaatctcgcataccctggtaccaactatccctatttcatgcaaatactgtagtcgagacctcaaacgtcgacagtttagttagggtgaaatttactctggaaatccgctcgattttttttagaaaatcatgagctacaattaggagtccgactttcgtctcaagttaacatacaagtttttttaaaagatatttcttatacggctccttttgtattttcaaaagcgaacaaacataaaaactaacttaaacacgaatctatatttctaaaaatgaacgaaattaaaaaccgactcaaacaaggataacgtaccttgtattggcaaaaacattttcaacttttataatagtcgagattaataaacagataggcgtgaacttagaaagggtctcatcttttcgcttatatttatacttatcagccaaaatttgaatttttgacgttaaatttggagttgattttaggggtttttcatcaaagtttatttttcagactttgtttttagatcgctaagaatgcatatataaaatttttattcataaattattcttcaaatgcaaatatgccgtaaaacgatgggtccacaaggtttggattgatgaatactactccctccatcttcttttgatagtcatatttctaaatctaaaaaaattatttttgataggcatatttcaatccaacaacctatcctcttaatgactttctcggatttaatgcgtgactctacattcttccacacaagattggctacatgggcatcgagaaatgtaaatattaatgaatcgcttgtttacaaggaataactggtagcatatttaaatggatgataagtagaattactttggtctgtgtgccaagatgaaatatgactatagtttaagtatgcaatgcggtagtacgtacattgcatcggtaccacactaagcgcgcattcaataagcatcaatcaaactgtcaaaaaaaaagcatcaatcaaagactccaaattaggtgcttgtcaaattacggtttgattaatgattaatccatgcaccacaatgtctcggatgctcaactaacttgacacgtcgtcatatacttgtactgaagtcttcaactctacatcacgtacaacagtagtggtgtagtaccattggacactactacatcctacagataagaggcagagccaatagcgaagaaatactactgtttgactccattagatttgtcattaatattatcatttatcaacaccactatttagtctttaccatagttgatttctacagtactagtagtaccctgttttgcctggattagcctctcacatttcatactagctactgtagtatagtaccataaatgtaaagagacagaagaacagcatagtatcccaggtctggataacactatttatcatacccaattttaggatcattaacaggctagagcaaaccaagattctcaagacgacagctcttggcacgatgggactcattggattcaccatgcaagacaagagttgcattgcattgcactagcacgagtgagcttgagactgagctcttccgctacatcttgatgtccgcgaggttggcccagatatgctcgaacacgtcgacgatgaggtcgtggtactcggcggcgttgagcgacaggtagcacgccaggaggtcctccaggtcggcggcggtgcggatgccgttctcggcgatcatctcctccatggactcccggaagtccctcctcgggtcccgcgacgacttcaccaccgcgaagctctccgccaggggcggcttcgtcgtcggcgccggcgagcgcgccgccgcgggtggtggtggtggtggtggctttgacttcttggccacgatacgcggggtgttggcgcgcgtcttgaggcggcgcgcggatgacaccgaccgcctcggcttgctctgttcgaggagggtagtgggttttttagccgacgcgcgtctcacgacgtcgatgtgtttctcctccagatcgcagccgtcgagctctctcctcgccggcttggtcacgataggcgggagcaccttgtcgggcctcttctcggtccgcaggtcgatgatgatgtccgtggcggaggtgatcaccttgccgtcgagctggtcacacgcggcgagggcgaccgtcggcttcttgaattccacctcttcctcttcctcgtcatcgtcgtcgtcattgtagccgacgaacttgtcgcggcggcacggtggggtgtcgggcgcctcgaccacgacgagctccggcttgcgcccgcaccggcagccggtggacaccggcgaggacaggacgctgctgccgctgacggacggcgccagcttgacggaccgccgcctgtgcctgcgcctggacttcctcggcggcgacagctgaagaggagggaattgcgtgtcggagcacttgggatggagcggcgaccccacgagcaggtcgccggcccgcggcgtgtagtagtaggacgccctgtgcgggagcgacaacgcgccgtgcctgggcgtgttcggcagcggccggcacgccctccccgcccgcgacacggccaccgaagactgcgtgaccaccccaccgtggctggccccgccgccgccagcgcccgcacctccccgggcggcgcgcatgtcgcggagcttgaagaaccacgcgttcgggatcatgtcggacagcctgaacttgtgcctccccatggcgccgcgctgcgctctgagctccacagaatgcgcggctgctcgagtataagaagagcaagaagaacaaagctttgtgtgggctgcgtttggttgcttgctgctgctgctgcgcagcttgctctgtacgaggaggagcagaggcgagcagaggaggagatggcgcggagcagaaaagggcgggtaatagagtgggggatcggcgaggcggagaggaggggacgtgaggcgccttttgtcctcgctcctctctatgcggcgtgggcccccacctcgcatggcttcactctctcagctctcatcagtgagacaacgccacggtgaggcctcctcttccattacagattatttcaacagtactgtacttactgctgctgcctgtatttttatctgaaaatccctgtaaatctctcgaagttttggttgacatgagaggctaaaaaatgtttcaagggaggtcggggataggatgataggatggaaagcgcaggtattgttggtcggagaagaatgggcctacgctgcactgcacgtaggatatactactacagtagacaggatatgatatgaaatctgaagaaatttcgcttcgctcgcttgtggattgtggttacgtcctttgcctggctgccttcaattcttttctttctttctcatctcatcaggcctttaattacgcgtcgaaaagcatccttgtccgggacctcttgtttaatccttttatttccatcacccctgggcgagacaagcaacagtactactactggtggtggtcgctggctcggagcttgagcggtcagtctgcgagatttgccttcgccgcttgcgttcacaacaaaaactccgagactccgagagggtgtgtttagttcacacaaaaaattagaattttgattgaaattagaacgatgtgatgaaaaagttaaaagtttatgtgtgtaaaaaaaattttatttgataaaaaagtctaaaagtttgaaaaaaaagttgagaattaaaccacgccagaggctctaaatttaagatgccacgcgcagcttttcgggccaaggccaatggtcaaatcttgcgctgcaatgcaaagcaccgaaacgcaatgcagcgagcctgatcggccgcacgcatggcggcttatcgcgaaagccacacacacgcaaaaccaaaccgtaatcctgtcatgacgcagtactaaacttgtacttgcatgttagattagtgtggttgtgtggcacttgtaaagagtcaactggcaagtggcaacccaaaagagggacgtgggtgaaggtaccggagcttttgatcgtaaaaaccgagtcctcgatcggcatgcttaacacgggagatggatccagcaccggcaccaaacggtgtcgataggattgatggctgcgtgcttagtgctcggcgatctcagaaaggtgctcgttattgtagactagagtgtggtcctaactccggccctgaggcgggtactcgcttcgcgcgcgcgtgcatcatgctgcagagggcagagcccctctgccccgtggacgagacaaacacaaggatgcaaaaacgttgatcaaaaccatattattattttttttagtttttcacacgcctgcttaattaacccatatgcattgcgagtgcgacacacagcgacagtcttagccaacaagtgcaatataaatacttgaactaactcattctagcgccggcaatataatactgcaaccggtagatgagatgagatgaggatggcccgcgttttgcccagcacggaatcgcgcttgcgcgcacggccggagggcgagagggcaccagcgatgacgcctcatttagcgcgcacggagcgcataatataggtacttaagccgcacggttcgtcgtcgccgtggccccgcgcgcgcgcttaattttttcgcggcctgtcgggcgttgcgcccgccgggcgagcggcatcgccgactccgtctccacctactcggctacacgtccttcccgatcgatttgttaaccgcgcggaaacaaaagcgcgccagcatcttggttcccctgggccatgcgtggtgacactatttgcttgccttcttttccgggctcctagttacctaaactgcttattatcaaatgttaagagtgtctctctcactagccatgcaggcaaatggagtgcgtatcagctggctggcttcctttgacttggaggcatttccgtgctagttgcagttagccaacaatggatgggctcagctcaaagaaaaaaaaaactacgaaagggctaacccttcacaagttgtgtctgtatcgtggatggaatgatgatacgttgatcttgtttgaaactgaagcagataaagattttttagagaaaaggccgaaaggcccagcttactatcaagcataagagtgcagatacaagggtaaacgctggggaagccagcttgaaatgatgtgctgaaaactcaacttcacttctattaaggtgctgctggcacagcgctaacaagccaggaaggaactcacaaagaaccacacagcaaaaattaacgcactagtttggtcctgacgcccgaatactggcaagcaatgagtccttcagaccatccacttcgaccttcagcttctccggcagcagccctctccactggatcaaaaacgaaacagctttgtgagggagatgacatatattagaaagcagcttgttattgaaaacccagtcatttctcacaagccaaatcgcccaaatccctgcagaaattacgtgtaaaaagattattgccctatcatcccccatagtcatcaagatattcataaactccctcctggaagaagggacgtgatcccaatgaaacacatctctaaaacaacaccataaaaacctagctggtgcacatttaaacattaggtgatccacatcctcttcagcaccacagaacttgcagaggggatctccattccacttcatctttttaagccgatgagcagcttgaattctccccttaagcatcagccaaacaaagatcttaattttcagaggcacgggtgtcttccaaagttcttgcatctttatgtctctaatccccccaaaggtcatttctctatagagagatttcgtagtaaactgtcctgattttgttaatttccatctcatcctgtccctatccgtagataagtgaacatttgcaagatctgcaagtagttgttcccattcaactagctcctcggcaccaagcgatcttctaagatcaatcctccagccatcagaggaccataattgactcactgttttcccaggatcagccactatactgtaaatgtagggaaatttgattttcagaggtgtatctcctagccagacgtcatcccagaatctagtaccactgccatcccctaaatcatacagctgcccaatttcaaccaatgttttacctcatgcaaacctctccagaattgagagcatccctcagtactagactggaaaaagcctcccccgaagcagataaagattaagttgatatacgtaaaacgagaaaactattagcatagaattaattaatttttaattattacaaacttaataaatgtatatttttctcacgtagtaatggtgttagatattgcaacaattttataatccattgcaacaaatagaaatccttgtagtgaaaacaatttctatatagaaagttttcacaggaaacataacatttattagtttaaaaaacgtgctaacagaatcttaattgatgtaatgtgtatgtgaccaggccgattgatccctgtcgcggatgttactcatcctgcatgcgctgccgatcgatcgacgagcgtaggtacgttctctacgtcgttgcctcgtcgctgtttgttctccatcgatcgggttcagattcccaccggtacttttcgcggatcatcatgaggctaatcttgtgttttgtcacgagattagagcatcctagtcatcaaattcctcagggagccctgtcaaagtacgtacgatacgccggctgcgagagcagctggcgacacacagtacctgcgttgggagtatacgcacatggacatgtgctatacgcaaagcaatggtagcgaagggtcgtactcgtacacgactcgggggcatgtattattagcgtatttcggccgtctccccttaaatcgatcggtcccgtgcccatctgctgataatgatcgaatacctgatggcgatgatcaatacgcaacaaagatacgggtatcctttggtgtgacggaacgggggacggctggtggtgtggtgtcttcaattcagctcaactcgattttttcatacagtcctatactgcatggtcactggtcatgcaagaaacgaataaatatgttcagtgttgcctaattggttggtagcgtacacgcacaaattaagccgaatctttcacatatctcgccccgacaacgtaactccatatcgacctctcttgaatagggcaggatatgaacctatggctccttttatgctgctctcaactctgaatcttgacttgatgaaccagacgtgctacctgtgtatagtatccaagatgtacgtatgtactccgtacatagctagtaagtgtgctgctatagagggtgtttgggagagaggtaacccctctcacaaaaccataagtactcgtttctgccaatcgctagggtgaggataacaactgttggagagtttgacctgacgtgacaacacacgtgtgaagcacatcaaagcaagcgcagggtagggtatcgcctctcgcctcgccgaggccgtagaactagctattcaatgacaaggacgccgcagcgaaagcctctggctctaacctctaagcccctgttaattttttttcatcttatacccgtcttaattggaatccagctcatgatcctaactggcccattgtacatagactagggtcttcttcaaccggtcgatcagtttggtctcaggctgccagccattgcattaatccaacaagatttgcagttgccgtagtaggttcattaagcgaggtccttggaaagaatctcgacctactggccggctcggctctcactggtgcgtactccatttttgcacaaatgcacctatgccctgacgacgatagaaaaggattggacattgttgcatcttgggactttggtttgaaaaaacaggagtcccccctacaaaaggtacgtgtcatggcaccatgatgatgattatctccgcgtcgataccgcaatctgatggggaaataaagctgcatccatggtgatggggaggcaacgttgctaccaggccatcatggagattgcggcacctgaggtccacatggttgttgcattgttgtggatcgatccatccattttgctcggctttttttttttatgtttgtttttcgaaggctttgtatttataatggcaatgtgagagcacgttcagcggtcggcccaatttatttccacacttccaaagcttcaaataatcaatgttctaaaatacggagtactccaacttcgatggctcaatctgaacatcaaagtcaaccgacaatactccagcattgttcatgctactacctctacttgcatagtcgccatacgttcagctacaacgtggaatagtgtcagcgacctaacacagtaggttttcataatctaatgaaacagaccaccttaatgagcatatcattacttagttccgacttggtcgctaataacacccagattctaagcattgtgctattgatgataggctttgatccctagagcttaattcactccagtcagagtaaaatcctggtctgctcggggctctatgtgttgtacttagcggaaatcatgttgttgaacgatagagtactagtaataaagaaccacgtctaattactgtattttgcacacggcttggacgatgggccgagtgtgagccgtgggcaaagctcaacctgtaattcagtttcttgtaccggacaattgagttcctatcagaatcaagtagtacttgggcagctagatagcccaatagcccatataaaaatccctataaaaattcggaggattatgcaaatctgagaggctgggcccaaccaaaaatttctgactagtatttccaactctcacgaggagaacattcatccacaaatatcacctcctgtacacatcatctgaaccagccagcaggcaaccagccacgttgcccaaatcgctcctgaccagacacaagcgtgcaagcgcgcgacgcaacgctcaacgccgtcctctcgcgcctgaaacacaccccggcgtcgcagtcctctcgtttcagcaggctcgccttgcaccacgtagccttgcagccgccacaagactcccatgcatgcgcacaccaaacgcctcctacatatatataataatggtttgatcagtcaccagttcagtttctacctgaggagaatcaatcaccgatctgcagactgcagccatggccatgagggcaatcacgctgtcccactcgcagagcgcctcgtttgggcaccaccaccaccaaaccatgccgtcctccttcaggccaagcactgcctccaccagatcagtgaaggtctacgcaaaggaagatgaggagaagggcagcaagcagtcattgttcgggagcatcaccgaggcgctggacttctcgcaggtccggtcggagaaggacgcggagcttctgtatgaagccagagaggccacaaaggatggaggaaggatgacaaaggagcaggtatccattgaactactgatccgcacaaaaaattgtcgatcaatggtgttatttagtttagtagtaacttagtactgactatacacggcatggattttctatggtctgacaagttaatttgatttgcaatgaagtatggagcacttcggaggaagatcggtggcacctacaaggatttcttcaagtcatatgtggatggtactacctcatatatgctttacttgcagaatcctaaaattacttctgatccaaaaagattatactagtaggagtatcgcacagtcctaactgtttctgaattctgcttgcagttgacggggaatacgtagaggaaggttgggtggataagacctgcaaagtttgcaagaaggacactagaggggaacccaggcaggtcgacaagctaggaagatatgcacatgtcgcatgcttggagaacccaaaaccgaccaacatcttcgccaaattgttcgccagatgaacttcaattgtacaatcaaagacatatttttactcatgcttagatacatagatggtgttgtagccccaagaatttgaacaatattatgtgttcagttttgccatataaaatggtatacagggagcatgtcacacattttccttcttcaattgatccatttactcacgaacaaagcaatgacttaacagacctgaacgactgaaaatgttaaatattacatcaagtattacagagcaagttaatacactaatctatctattagcttatgcccctggtctaatataagaggagctcaacagaaactcaagtcaaaagaaatgctatatagagctaactggttatctgatgctgcttacctaattctgtagctatatgacgtgttcagaagtttctttcgttgaccatggacagatacaccctgcatctgatgacagtgcatccaatcttaaaccccggcattactgtaaacccaacactgaccttgtctccttctttggttatcttggatggaacacattccatgtgtttactcctaaattcagtaccacccttgacatagaacatctctgctcttggattcagagaacgtgctacggttagggacgcccatacatatcttgacattgtcacaaatgcctgataaaatggtgttcttggatggccgccattctcaacaaatgatctatgatccaaatttccgaagaatgaatcctccatactaggaggcaaaatggccagatacttttctcgacagaatctcccaaaacaagagtctggggccttcataagagcatcaaaaggatcactgaaactcattacataatcgaagacatccagcgaaaggtactcctctttgtgccccatcaacatcatacaagcaaagtaggcctcaacggcgtaattcttgtgagaccttttatcatagacaacagaattgtctattggggatgttaagttgccaagattccaccgagaaagtttcatccaacggacgacgagttttgcaaaatcatggatagactttgtcgaaagctcgaataattccataaacatatccgttgatactcccatcccaattgcaaaacttccttctttctgtaacgcactttgaccgatcttctcctccagttccatgttcttcctttccagttcatccaactccgctcgcaaacacacaatctcagagtctctcttgcacatgccagcttgcaactccacggccaacttttgttgctcctgaattctagagcccacatagcactggtacattggatttctccatttgttcatgttgacatacagatccttcaacccggcagtctcttgaagctccgatgtgaatcgctcatcagcgatcgtaatctcttcaggatcatatggcacaagagcttgctgaaggttcacgtaactcaatttgaggccagaaatcgcgtcgagaagcctctcaacaaacgcttcctcgcagcgagcagaggagcattcagagacgctctcatggtcggacacatgatgcgggtggactttcaggtgcgcgccgccgtcttcgctgctctctccggtggcgctgccgtcggccttgggcttttcgcggacggtcggcgcgacgccgacggagcgcaccttgcagatgtcggagatgcgcagcagcaggcaggaggagggcgtcctcctcaccttctccgtcgccgactccatcgcaagactgcgtactactggtctactgcaaaggcgaggcagagcagcatcaggctccaagaacgattcaagatggttgagacaggaagtaaaacatgcgcggattccaaggcgagagtttgcgggtcttcgaagagattgattccaaccggatcaaagccaagaacacgataaagtctctgcctttcttctgaaggttttgggttttagccgattgccaagaagaagaaaaacatcaaaaattgcaaacaaacaaacaacttcaccgtatattctcgcacagtcatgagtactcagtaatcactaaccagtgtaccttcagtgaccaccccaagaagctccaataaccgccattgaattctcgcgcctgcacggatccaagaagccaaaagcctgaaagaaaaaagctgcagcgaaggtgaggtccctgctctgaatcttcgagaatccaagtggttttgggagaatgggaggcaaagacctcgtgggctccaatggattcgaacaacaaaaaagggtggatcgaggaaggcgagtgggagccactcactcggggcagttttcttttgtaatccccagatgctaaggacttggccgaccataggaagcggggctaggtaaaccctaatctctcatttatctctgactcaatgcaaagactgtaactgcccatgcggctatgccatttaattttagttaattttaggctctgtaaagactgtaactgcagatctgacttctggccttctattccagatctttaccatggggatagaaagcgggaatattcagagggtatcgccacgtttttcgttttttctgacggtgttgcatgccgtgtcacgatgcagtaaagaagaattttttgggttggtggaagttgaatttgggagaggtagtacagtgctgaatggcgctcagtgttgttcagattttatgtttctactgctatctagtggtcctcagggtcaatcttgaatgataactgagatttctcggagggaataatttgctctgcccatccacatacacttacaatattttgcaccatcaaatagcctacttgtgtgtttgcacaataaacaaccccctaggagcaaagctttaaccaaagtttctttctgatgaacaccacacgattggagataagtaatgccatgtccccaatgcctcagtgtaaaactaactgatgctcgtggttaagcactcttccaattgattatgtctgcgcctttgagttagcccatacttgtcagttgccactccttaaatgcccagttgcctagtcctttaataatttccatgagcaaaaagcaagcagaaatactactagcatccatgcgagccataatttgttcatatttttgtgggagtaacaaagacgtggagatcagccacaacgattttctcctctgatacgaactgtttaattatctccgcagtaatatctgggaaaaaaacaaaccttttcgaaatacaaatcagtataggaaacaagtaggagtaacaaacgtacctggagccggagcacgtactggtatacgttaatacgtacgcgtgcgtgcagggttccaccactcgccaagacgatcgagccagcaacacgtacctagctacgaaaacgaactctcgccgatggttgatctgtcaggcctcgagatattcctcgccgtcgtcgcgctcatcgccgcgatctgtgccatctcctggaccgtgcgatgcttaatcggccggcggttcgaggtcgccaccggcgatcccaacggggagcgccaagggttgctgaacaaggaggaggtcgtcatcatcgacgtcgccgccgccacggaggcgaggggcgacgacgtggcgctctgcgcgatctgcaaggggaggctcgcggtcgcggtcgcggacggcgggggacagccgtgccggcggctgcggccgtgtgggcacgtctaccacgcggagtgcatcggcctgtggctgcagagggggacgacgtgcccggtgtgccgcgccgacgtcgttgcctcgcggaacgaaatcgtcggcgcgatggcgtgagagccgcgcgcacggggcgcggatgcgtgcgaccggggggcctgggtcgagcgccgcgttgcagggttgcacagggtaacatcaaaatttatgtttccatgttgtgtttctcttccggagatcttttttttgtacgtgcacaaaattggaacggagattaagctctactcctacctactttgactcttcttaagcccgtctgcaacaagaggccgatggacaataacattagcgctctggtccttttttcgtttagagtatccggaccaaaatacatgtctaaatcagtaaaaccatgggccgacaggacgcgatcttgtgttgctcacaataagcccaccagatcacgacgtttctagtcagcgacaaaaagtagcccatcacggtatcgcttcacaaagcttcgctctcagcccatcttgccaacgacaaaacttagcccatcacattcgcctcgcccacgcaaacctctatccgtcgcttctgcagtcgctgccttcgctgcggaccaacgagcgcgacactgccacgccccaacacaaacaaacaggacgctgtagctccaggaaaccattacataaaccattcggtcagcgatgcgcaatcatgattggtgcaacagtagagaatcaatcactacataatactattgtcaccagctagtattcgtataaatgtttttttagtacacaatccagtggctgattacaacatgtagacttcattaagtcctaactaacccatcgtccccacagcccactgaaaaactaatccgtagctgtttactttcgtattcatatttcctcgatttgctgtcaatcggatggcggcgtctgaatgacggacatgctagtttgaacaacacacagccatgaatatagtacaatatatttcttacactcatatatatataggtcaaaatcttcatgcgatgtgtaacctggaagcctgagatctcctaaaaaacagaagggtcagacaggaggtcactgattcatcaagctgagcaaacacgctggcatgtgtttcaagtcaaacctatttcattagtagcaagtcaggagcaatgttcagattacaaacccgtcgatcgtctgcaactgtacagaagtgcagaaactgagaaacataagctagcccgcatattctcgtagtgttgatcccttgcgagataagatggtgacattcgtgtctcagatttcattgaaagagtcatcatttgagaaattcggctttatccagggttaacaatccatatgattaatttatggattgaggataacttctctcggataatgacaaaaccaggtaatagatcgataagaatcatctaaaacaaactcgtaatagctcgtcacggtaaagtcgcattcaagcctggacccgcttgatcgatcttatcataaacccctatgtactctcggcacgatcaagtgccagattaaattattactcccttggtttttttagtttgatgtttttgacatccatacacatattctatcattaagttttacaatatatttataaaaaaaatattaaaacatataatcatgcgaaagcttttttcatgagtgagtatagctattactaggggtgggtagaaaaaaaatcgaactgaaaagaccgaggccgagaaattcggtcctcggcagtgaaagaccgaattttttcggtcaattcggttagtctccttggttaatcgaatagatcgcaaaaaccgaattaataaaaaaaaaattaaatgcaacctataatccactaagttcaataatattaaactctaattttcacattcctacttcttctaggcatgcaacctaataagagtctttactcatacgtgcttataatttttttttgattttgtgttgaaaatttcgattatttctttgcatatatgaaaatgttgttaaatttcggtcaggaccaagaccgagaccgaatttgttggtcctgaaatttttgcgttgaaattcggtctacactttccaatgacccaaaaactgaaaaccgaaaccgaaattttctatcggaccgaatgcccacccctagctattagcattgctaggcatattgaattctaatgctttttctatttataaatgatataagatttcaagatttgatcgcacatattttaggacatcatttattgagaacgaatgtaacaataaactttaaaaattctccaacaattcctactaaagcagtgggatttctaagggtatgctcgatagtgcagttttgtaactcattctccccgcattgaaaacaaaatagctcattaacgtattattaattaagtattagctaaaaagttgaaaaataattaaaatgattttaaagtatttttttctatattttttataaaaatataccgtttaatagtttggtaagcgtgcgtgtgaaaagctgttaatgttgaggttgggaaaggtagcgccaaacacacccggaattaaattatgaatgtagtaattttcatatgtggtataggcccttatttggaatgtttgtgctttgcgacaaataggctgatgctacaccaaaattcataatccagagttcagttttttatagaagaagtttttgatcattttcatccatttcttattcaaaatcgtggtaaacaaaactgaagcagtgaacctcatattttaggctccaagctcaaactatttggatttttttcaatatatacctttttttcaatattttgtgccgctttggtgtgtaatctctccgcctccatcacaaaataagccatcactacatcttgcaattgactgtatttttaaaacatttttaaggaacataccatagataaaagcttttgagatgcacttgatgttgcggtggcaagaggtatatggtgtcaaccccaatgtctcgtgtttaatctccaattccaaatcttgtttaaatagataaaaactctttttatatataaaatgatagatccaagcatgaacctgcagcatttggcgatagatccaagcatgaacctgcagcatttggcgccatgtacatatatagcatggcacacgcatgaataacccgttgactgtatgatattttgtactcctgatggctcaattgacctttgtatgttacaatcatacacaaagtcaaatactgtgatggtatgcagtatgctataaacatacatacagtccctgttcttttcagtctctcttttccagttcttttctggctatttgccagacacttataataatacaatttctaaaaaatatatattctactgtattgaccctttatactaatctatttataaagtttatttcttaatttattaattcatcatgttaatcaaataaacaatatgtttcaataatgcatgcaaaaatccgtgttcggaatgttccctttttatgaaatgacttgctaggggtgtatttataaaatttctcacggaaaatggctaaaattgtgaaaatctcaccactgatgataggttgataaccatccaggaagatgaaagtgattgaatcgatggcgacaactagttggatgaaatttctcacttttcccacggaatgctatcaaccggcgtttaaatcgagcttcgccatttctgtggacgcacccagctttgggtggcctctgccacgccgcaaagcgtccgccgtccaggcaggcgtacccgcccatccattctgccaatcgctttgcggctgcaatatcgacaggtttctgcaccggatttccgcagcgcggcactgttcgagaccagtcgtcgcaaccgcgggtcgacgaatggttgtcatcactacaacgattgatggtgatactggccaaatggtcccagtaaatgcttacaagtttcacgtaattccttctcccgctttcttctcttcgtttgactcgacgggatagatagatatcagtagatattagagcagttacaatagcagctataaaccagctataaccacatatcgagaaaaaaaagtgaagagagagaataaagcgggctacatatttatagccagttacaacacagactccgaaacgttatgtgtgtatgagaggtgggaccgggtataaatagtgtagtacattttatagtaaactattatatgaatagtctattagattagctatagatgatttggagccagtagttgactatattattaaacttgctattaggaacagtggttctaaatttccaactctccttcggtcattttcagttttgtgttcgtctgatgcaacttgtttttgtccaagtgcgtgcttgatcttcgcttcgtcgactattcgacctctctatacactatacagccacgaccttaatgccgacagcagcgaattaattagggagccaattgcctcgctgactgttcatgcacaagtcaccgagaaacagtggcatgaattggattgtctgacaagttcaaatgacgggatttgttctggaacccaagaatcatttcaattttaaatcggctgacttccttcattgccagggaagcaatttggtttcgactggaagaccagatcaccagatgcaatgcacgcggcattgtcagttgtcacaatggcgccgcaccaattaagaatagtgagcccttccttgcttcgaatgcagcattttgacactgtcagggaacaggaacgccatcctctgtttctcttttctatcgatagcctccgaagagcacgataggagcacgaacacccatcttttttttttctctttttgtatcttacccaaaaccgccagcttgatcaagatttggagatcaaaattcggcacgctctgatgggggcaaataaaaaaacaaaatactttttttcccaacaaagcaacgcgcaccatgacaaaagctcgcaccggcgcatgcagaaaagaacacccgcgtgatcccagaagccgccgcgccgagcagccaaacgccaaaaaaccgggagctcgtcggcaagcgcgcggcggcacgaggacgccttcctgccgcccaaccaaaaggcggcgccgcacgtctgtgccctcgcgggcagaacgttgaaccggccgtggcatctactactcctcctacgcctctttctcgcaccaatcaagcggcctgcaactcgcggcgtccccttcccgtgccgtgcaagtgcgtgcaacccaccgtgtcgcgaatcatgtccgcttcgccagcggggggcgagtctggccgctggtcccaatcgtcgcaatcactccggggggcgcccatgggccagtgctggcggctgctcctgccccgggacccatcaaccaccccctatgatagcaaaagtgccaaactgcgcgtcccagttgcttgcttctgttacattggatcatggagtagtagacgaccatggacgggggtccattcggtaagttaaatcggaacaaaggcgttgctttccttcccataccaaatacgagtagtggttcagacgtcataaaggtgaaggaaaaatccgggtatccttacgaatggcagtacagaaatgtgcatgtgaaaaatactttctatcttcgtttatctttcgagaaaagaaagggcgcaatttgagttggaattggaggggattacattggactgaagctcgtatgcacagttgatcaaacactcaccattatctctcggagcaaagaatcttgacagcctaaaaaagactctgtacagcaagaaggggggaaaaattatgtttctgaacttatcctacgaggcaagttgtgattggttttcacgaagccatcatggcagggggcaccacggtggcaacggggcaaccgccgcctcgctccccgtcggcggcggaggcggctgcccaccgccggcatatccggccgagcgaggcggccttccgccgggcgcgctccgtgccgatgctcatcagctcccagatcgcccattccacgccgggcacggccatgacctgggtcaccgccggcgcgcccaggcgccggcagagcagcacgagcgccgccgtggcgttctccctggcccagtccgtgccgcgcctcatttccgccacgagacgcgccacggcgccgtcgatgttgacgatcgcctccgcaccgccgcgcttggccagcgcggcgagcaccgccgcggcggtctcctccttgctaatcgctgacagcgccacctcggcgacgcctgcgtcaacgagcttgccgacgttctccctctcgccggccagcgtcagcagcgcggccaatgcgtccttctttgtgctcgtcgggccggtgcgcacgagatgcactaatttctccacgacggattggttcctgccgagcctgcggcggtaggaatgcacggacgccaagctgagcacggcggcggcggcgttctccttggcgcgccacgtcgcgccggagctcatgatatgggcgaccgcctcgacggcgccgtcggcgtgcatgatgcgcttcttgttggcctcgaggatggagagattaagcagcgccgtgacggcgttgagctggagccctgcatcctcggagtagagcaggggcacgagcagaggcacggctccggcctctccgacgaacgctcggttctccgagccggacttggatagcagccggatctcgtgcacgacgcggttggcggcatctggggagaaggagacggacagcttcttcacaaggaacgacgccgtcatgcgcgccgcctcgagcgcggccttgttggcggccaccgcctgggcctgctcgctcttgctcgcctcgcaggcttccatggcgacgccgttctcccggcaccacttggagatgaggttcttgagggccttgttcgacacgagctccagattggccaagacctgccctgtcttggggcacgttgacttgccggagctgaaccaccggtcgatcgactcgcgatcgtacgtctggccgctcgcgacgacgacggggtcgcgcattagatcgagagagattgggcaccggaagtccgacggcggcaccgggggctcgccgtcttcagcctcgacgtcagccttggaattggaatctgaaggccgaggcgtggcgctgaacaggacgcacttggcataccggaggaggccgacgagagcgatcatggaggccgtccatttctccgaggcacggtcgccgatctcctgctccaggctctcgatctcctcgctgcagctcgccgggtcgttgatgccgacctccaccaggatctcctccagcctctcccgctccggcacgatctcccgctcgatctcttgtatcagcgacagcacgctcgccttcagcgcctcctccgactccggtgccggcgagcaccgccggcactggcgcgacgcgagggcgaggacgtcgagcacgtcgtcggcaagccccagctcgacgaccggcaacaggtcgagcagcgtggccaggtcgtggttgagctcccgcagctccgcctccatctcgtcggactccagcagcagccgcatccggctgcgcgccgagcaatcggcgacgatcgccttgaaccgctgcagcaccaggagcacctcccgcaggcacagcgacgccgaccgcggcagctcccccgcggcgccgcacagcagcaggtcgtcgaacgcggccgccagtagcttggaccgcctcgagatggacgcgaacgcggcgcgcaggaacggcgcgggcgtgtcgacggcggacaggtcgcgcgccaggcggtgcagcggccggagcagctccccgtcggacggcgacgggggcggcaggaacaccgacgaagagccagacgacgacggcgccgccgccgccggattaccagccattggcgcagtaaccacaaccaaaagaaaaaatccttagcttattagtggagtaaaaccaaacggaaatggtggacacgcagcggagagctcgaaaagagagagaggtttataaacttcggaggcggtaggcgtggcgtgacgagttggttgagagctggaaggaatcccctagactgattttgcctttttccgtttatttctattgtgattgttatgcatcatgtgcttagtttatttgtgatggtattaggattatcttatatgcatactatagtattaatgtattatgatgcattggctggaaaggggggcagggtcgtcgcatggtggccgttggatgtggcgcgatggacggccgggatgggaattggatgagtgatgatgagtcagcccgtttcgtttttgatcggatcgcatctcgctctcgggtgcggcggctgggtaagactttgggacagatgagggacgagctaagcacccgagtggagttaaaagtacggtgagagtggcttttgtgagaggacaggcgaagatgtggaggactagatatcgtcagaacctaaggatagctgtaaagattactttgttcaaatccaggcaattttcacgtggaagtgggagacctgtcacactaagaactggagtaactgctagatctatacaagagccggctgctggattaaggtcctgtttggtttatagagacttattccaagtccctgtcacatcggatgtttggacacttttttaagtattaaacatatactaattacaaaacccattccataaccttggactaattcgcgagacgaatcttttgagtctaattacgccatgatttttacaatgtgatgctacagtaaacttttgataattatggattaattaggcttaaaaaattcgtctcgcggattagctctcatttattaaattagtttttttactagtctaggtttaatactccaaattagcgtccaaacatccgatgtgacatgggctaaaaagttttagccccatctaaacaccccctaatatgcatgtcctctacagtgagtagtagctaacatgtcctattccgtaaaaagaaaataacggttcgttgttagaattgaattttttttacggaggggtacaatatagaaattttatgcttactataatataaatattctactcatcctagaattttatgtggatgcgacacatcctaatactaatactaggatgtatcacatccgtctaaaatatcttatactacatccgtcccaaaatatagcaactttttgctatgaatctggacacacagttatctaaaatatcttatactacatccgatttgttgagatgtgaaaaggaataggtcccactacgataaggctattgaatgacaccatgggttaatggtcaccaagccaaggacatcgtcatgttggcaagaatgaagtcaaacttgtgatgggaataaagtcttgacaaaggatggtaaagacctcggcataaacatggttcaaccggatggtcacaagtgttgattttggcttaagcattgaccccaagttggatggcgcaaggcaaaggtataatggagctacgaatgttttcttagtcttttcccggtcttggtgtttggtgtagaccggatttgctagatagacgtcgtactattaagaggggtctatgaagcgagcatgtggatgatcttgcgccatattagttcatatgcatgtaggtgtatttggtgggcttgtctagccaagtgtggtgagtattatcaagtcctaaacaaagagatatgtgggcaaatcctataggtttgggtagcctcatgtggttatgtccggtggagtatcctttggagtgtgagccctttctccctgagaaaagttgtgtttcttggatggattgttcatggattggatatccctttgaataagctttccatagagtccaagagcgccaaattccgagacccgagtcaagagatatcgcattttactaacggttggttgtgctgaaaattaacctgcggtctgaccgtgggccttaggacggtctgaccgggcctgttagccggtctgaccggcgtgataaggccggtctgaccggcttcaatggtctgttgcactggtctggtttatggtggtgatacagagctgccagagccgcaaccggtcagaccgagccgaaggaggtctgaccgagccgtggacggtctgaccggccactacactgcggtcagaccggccaggttgagtgggctcaatgactgccaactagccgttacaaagtagtccggtctgaccggccactctatggcggtcggaccggcagagcacagagttggggatttcgaccccaacggctggttttggtggttgggggtatatataccctttccccagcaacaagggtaaggttttggcactccattgcattatcttgaacccttgcaagagctctcacactcttggcacttagtttatctagtgaggtgttagagagtgagttaagccaatccaagtgcattgcttcattgttatagctagtgtggcacttgatcatcctcggcaagcatcctagacttgttactcttggaggttgccacctcctagacggcttgtggaggtgttgcccggtgacctctctgaggagattgtggaggaggcccggcgccgtttgtgagtggtttggagttcaccaccttcgaagtgaaggaagaactaccctagtgatcgaggcttgggtagtcctctccgtgggccggctcccaccttgcccaccccttgatgaagggggcgtgcggtggcttcgtggttgagcggtggagttgggctcgcctcaacggggactaggaaaccggcaagtttctgaacctcggtgaaaaattccttgtctcttgtctcatttatttgttgcatttacatttgtgcaatttacattcatagagacatatttgagcccatatcacttaggtttgcaaaacttaacttagttgcttagttaaccttgcacctcaccttgcctagcaacttaggttagttttgttgaagtgccattaagttttaaaaccgcatattcacccccctctagtcggcctccttgatcctacagcggatgaggcagttgctcacgacggtgacggttagagtggactagggtggcgactgcgacagacggcgagaggcgatgactgcatggaggatgagggcggtgacggatacagtggactagggtggcgactacggtgacgactgccatggaggacgagagcggtgacggatgcagtggactagggtggtgactgcggcgaacaactagaaaggcgacagatatagtggactagggtggcgacaacggcgaacggcgaggcacgaaccatgttcctccccttgggttgtgtgtaacaacccgccttccagaaccgcgtagcccagcccatctgataggcaggcccactcacacacaccacccacttacactttcgtcatcgcatcgtgtaaaagggttaattcaaaagtggcacggttggaggaaagaggcctataagttggtccaacccttaggctgtgtttggaacctagggttcccaacctctctccatcgtattccacgtgcacgtttttcaaactgctaaacggtgtgtttttacaaaaaaaaagtttctataagaaagttgcttaaaaaatcatactaatctatttttttaaaaaatagctaatacttaattaatcacgtgctaatggatcgctctgttttctatgctcactgtgcaagtttggaacggctgattctgaacacagccttagtaaactaacaagattaaactaaacatgcgtacacaattctcataaaccacacaggtcaagtcatagtttggtcaggatgttatatacaacccctccaaatacctgacgtgcctatcgtctaacttacctttaacaatttctttactgattggtttgttttatgcgcacattgttaccaatcacgacgacaccaccgtgaaaggcatgaacacggtcaaaactctaccggacacaccgtcgaaaatttacattcacttcagagacgtggtctacaggttgcgcggatcaacagggtaaagaaacgtccaagaacaacccataatatctcgatccaagctacggcttatcggaggacgatgtatgccatatggaagaagcaagaagtaacttccatataccattggaaaaagtacaaattaccctctaaaactatcgcagtcgtccgaattaccccctgaaccataaaaccggacattcttcacccccaactatgcaaaccggacgaattacccccctcgacctaatccgcggtggttttggtctacgtgacgtacacgtggcatcccaattagcgttttttaataaaaaaaaatagtgggacccgcttgtcatactctcccacctctctcttctccacttttctctcaatctctctctctcttccccctcttcctctcaatctctctctgtctgccctctgcaggcgtgcacgagggcgagcggcaaacggcggcgtcgcggctacggctgagcggaggctactacggcggcagctgcgggcgcggcgcacggggcgggcggcggacaccggcgtctcggcgatggccgagcggaggcgtcgcggtgactcttgggcacaatggcacacggcggcatggggacggacggtggac

SEQ ID NO: 1002 - DNA, 7144 bp, Oryza sativa
ggttttcttctatcatttgagttttggtggagtccacagaccggacgctcgacgaacaacggcgacgaggtagtcgagcagggcagcagcagccacaccggcacgcgcagcccgctgaaccgctcctggcagagcagcaagcagaggacggcacagccggagcacagcgtccggtccgcgcccgcagccgccgccgcagtcgatgccgtggtgaactcgagcgccgccgtattccgctacgcgacccacgtctcgccgtcggagttgaagatgccgtcgccgagcaggtcacggaagacggtgtgccagaaggggggtggccgccgccgctcgccgtcaaccgaagcaacccagccgcgcccgccgtcaacctaagcaaccctggggaagtgaggaagaggggtggccgcagccgctcgcctgcgccgccctgccccgccgcttgcctccccgcgttccctgcctccgccgtcgcctcgccttgcctcgccgcctccgctctcctccccgcgctcgctgcctccgccgccgcactcgctacctccgccgttgccgggaggagagagtgtgtgtgagagatagaagagatagaagagagagagagtatgacatctggtcccacattttttaataaacagaacgctgactggactgccacgtgtatgccacgtaatttaaaaccaccgcggattggatcgaggggggtaattcgtccggtttgcatagttggggatgaagaatatccggttttatagtttagggagtaattcggacgaccacgatagttcgggaggctaattcgtactttttccttatactattcgatttgacaccatcaaattccaggtgcgcgatgccatatggaacatgccaatcccgcccaacaccctgctgcgcggttgccggccggaggacgacgcccttctctgtgatccggcagttcggctacctccaactagcgaaagcgcggtgacgcgtcgaggaacacgacacgggcgggggctagctgctgctacctgcgcgcgaagctccgaagacgcagccatgctgatcactccacttaaaaaaatgccgtagccgacgacccgacgtgctgatcaggaaaggtttcgcgcaagttcagagaaccaaggtggtggcgatatgcagatcgggtcaattcatacaattcgcttcacgtgcgcgttcctttcatcaatccgcgattaccttttgcctcatctttccatcacccggtggcagccgactagcagaaaccttttgggtgggtttggtctggggtgtgttgggtacttgagttactgcagctcgcacggcttagtacgagcactttgcgtgcgcctaaaccatgttttattgtatttgacctgacattcctggtcaatttaaacaggccagcagcacacgtacgagtttaaggaggggccagcacaaaagtgatagctgcctttggtcatcaacgttataaaggtcataactaattcataagtcataacagtgaactattgatcttttaattaggtgttaggattagtgatgttctcctcaaaaaagattaatgctgttgaaagattagtgggtaggtggtctgctctcctgcgttaagatttctctatattaccaatagtagtgaatagcccacgaataccacatgcaaatttgaattatgaagatacatgtctattcattacatattcagtgtacctatagttatttaaaaaataattgtatttgtcttattaataatctaactaatgcatgcatatataccatcacaaattggaagcggcaaaaaatagcatttccacaattatatgggcattcacctatgtggggttggattataacagcttggattgaaaaagaatccacagattttatgacatgttcatattaatttcaaatcttagagttacattaattaataagtactccctccatttaatattataagtcactttgatttttgtaaagttaaacttcttaaaagttgaccaagtttatagtaaaaatatagtaacacttgtggcaccgaattatttacattgaatttaacattgaatatatattttgatagttgttttctttgtgttgaatatattactatattgttttataactttggttggacattaatggtttgattaaaaaaaatcaaaacaacttctatgatatgaaacagaggtagtactactaaattgagagtgcaagatgagctcatcaaatcatcaattaaacatcacctacgacttgctaaatactaattctgaatttaaagtgtgattaattgataaaaatactaaaataaaaatgaaattcaaagagtgaaaattgatatttatattaatttaaagtttgagattactaagttgcagtagaaaataataattaagacacatattggatataacattttattgcaaattttaggatcattaggtgcttggcgcggctggccaaagccaaagccaaaaataatatgtactgaaaataatatgttatttccatgcaaactgtgcaattagttttttgtttttatctatatttaatgctccatgcatgtgtttaaagattcgatgtgacatttctgggaaaaaaattgggaactaaggcctggtttagtttccaaatttttttttcccaaaacatcacatcaaatatgaaatattacatatagatttttaaaaaactaattgcacagttgcagggagaaatcgcgagatgaatcttttgagcctaattagtccatgattagccataagtgatatagtaacacacatgtgctaatgacggattaattaggcaagattcgtctcgtggtttccagacgagttatgaaattagtttttgcattcgtgagaaaaacccctttcaacatccggtcaaacatcgacaccctaaaattttctttttttaactaaacatgccctaaaccaggccttagcagtgtaaccggactccgctacggtgcctgtgttgacatggactattgacgtgtccaaccatttggctgcctccgagccctctcacagtctcactgttagaagtgggcgtatctagttataaacgtttagggtgctaataatggggtagttatgtgataattttatttgttattgatgtagcttagggaaatgtgtcagctagagccaactatgaacatataactcatattagagttaatatatcgtaaggttatctctatttttcttctaatagaaatggagaggtcatacccttttaataaaaaaaagctctatttttcttctcctttctttatctctcacggtctcacctatgtatttaatgtatttatttttctatgtactactccctccgtcccaaaatataagagattttagtgggatgtgatattcatagtactaggatgtgtcatattccaccaaaatcctttatattatgtgacggagggagtagcttttatatgaaagctaaccctcttcattttttaaattctctcctttacataaatttctagttagcttttgtgtttagttcacgccaaaattggaagtttagttgaaattggaacgatgtgacggaaagtttggaagtttatgtgtggaggaaaattttgatgtgatgaaaaagttgaaagtttgaagaaaaaatttggaactaaacaagggcatattttaacttgctctaatgctgcagcaaaatgatagttttgtctttaaaattaaagttctttaaaaaactacttatttatttagcctggattatattatacaaagtttatattatacaaagaatgcaataggaaaatagccgtgccgatgcaacggaatatcaaggttgatatggttcctcttgcaagtagcggaaaatataatatgttagtcatagtacaatgatttagaattttgttattaggaacgatggaacttgttcttgcgtagaatatatactgaaagatgccattataaaatttattaggacgaataaagtataagaatagagatagacgtacatcggaaaaatcagggcccatacaacgctgcacctaatctatcattaagattcactagttaagcacatcaactggccacctaatcatgacaaatgtgcgcactgcatttcttcttttttttaatatgctttcagtacaaaccctagatatgaatgtggacatgatgtatgtccagattcatacccaaggtttaccttttttttttgggacggagggagtatatcataagtagaactcgtaccaaatgacaccaaaagttccagcaaaatgtcgactagttatcatgtatcttcaacagtagccatccaaataaaacataatgcatcaaaactttggctgaaaacaatatgttattactccttaattaatcgccattttatgctaaaatactagtgacgatactgtgttaacaaagggataagaccggcacggcgtcggtgtgaagtagcaaagccggtggcaggttcttgataataaaagcacgacgcttttgtagtcgtccccgtatcaatcgccagggtgtcactggatgctgcactgacaatactgttaggtacagcaattagaggaggagatcacgcatgtaccctactgaaaaaaagaaaaacaaaagaacctgaacgcttttcttttatagcgaaagtttactagctccagtctagaagcatggaaccggcggttgctctgcggaagctagcgacgaaggcacaatgcggtacaggagaggcgccgggagtaaatgggcaagcaggcagcgagagagagccgttagcagtatcaaatgcgtccctgcgctgccgtgacagggaggggacacatgcatctggggctagcaagcagactgccgatcgagcgtggcgtggggggacccaacccgatcgatggatcaacccctcggttttttttctgtcatctgcgtgtcggcgtggggcatccaccattccaccaatcaaagtcgcgagctcatctctctctctctctctcgtctcatcggctcatcgcgcggtcctgccgccgtgccgctcacttggacgaactcgatcgcccaccgtttcgagcgaaaccgagcgccgcacccgcacgaacgcacgcgcgcgggtgctgatccggtcccgtcccatccgcctctccacggcttggtttcacgtgggctccccggacccggagaggttgctagctaggatttggtttgagacggaaccaaattcatgtactccctccacagtctgcagaaacagcttcggattagttgagtctgagtgcctcacagatgatgcattagcaggtccatgtttgagggggagggcaacggctcaacctaaatccgaatagtctcgtcactaagagtgggtttagcagggaccaaaccaactgatctatcatccacctttgtatttttgccggtgtagttagcacgtaactggggtggcgatggagcatgacacgaaccaaaaaggatgggtgctcacatcacattcgacacaaaatacttttagaacgaggtatccatcagtgtgcttctagaaggccggagttaattaagtttagcaagaacccttgtgcatgtcactgggagtgacagggtaaattaagctcacgaagtgacagggtgataagtgacatggacgtcgcacaagtgcagaacagaccggccagtaggggattaggtcccgtgtccctttgtgtaggcctataaatggtgcgcgaattgcgtatgggtttggggggcaatcggtccagcccggtctaagtttcgcccgagattgcgaaagatcaacagtccaaccggcgaccggtcgattgcttgcgcagcgcgctcggagcaactttgggttgggtccagattagagaaacactttcgatcattccatcgatcggcgacgtgcaaccaacctcgcatgcacgtcgcaggtccatctctccctaaagcgaccgcacagggaagggacatttgttcttttgctatgcggcatttaatgtccgactaagacttccaggactccaggtgataagtgtaaatcagttaattagtgtcccattggattggctatcatcgactatagattcgtttaattagagcaagtttaatataatagcccactactagctccaatttatttatagccaattaatacaatagttgcttactgtactattaatatatggtcccacctatcatacatacattacgtcttggagtccgtgctgcagctggctacagatatgtagtccgctgctcttctctctcatcttttatctcattaaaatatgtttatagctggctaatagcctgctattgtacctgctattaggtgtaatgaaacttcttgtttgatttttcaaaaggaaaatactagtaaatcacttgtcaggcagtagtggtaaatactactataacggaagaaagtggaggccgtatctgaaaccaaacgcatgcatgtgtcacggcgttgccaccaaagttggacggaaatagatactagcactgacgtactccaacacttttgcttttatcactttttggtttatacctatgtgcacaaatttgtcataaatcgagtaagtgcaacctacgagggccatgtgccgaagccggagggagacggcgatgccgtaaggccatttactgatgtgtcattctccctcgccattccacatcggcaaagcaggagggcacacgccacgtctacttctaggcccaccagaataaggttcgagtgtccaaagatggccattggttcttggcgaaaaagaggacgaatgaagctgggagacgacgctgctttcgcgtcgtggagcgagtggcatcgccctccttcccatgccagccgtcgccctccagccagccgcctagcccgccgtcgctgtccgcagccgtcgagctcgttctcgtccctgccatcggagctcgccggccacaccacccccgatccgctcaacccgaagctcgccggccactccgtcgctcgattcacgccggtcggaggagagccagaggagaggggtcgccgccgtgggagccgaggtcgccggccgcgccgcccttgcagggccggaagaggaggaggaggggaggcgctcgagcctccggttgcgagtggcattggagtgagcggcgccagcggtcgtgggggacaggaagggcgtgtc

SEQ ID NO: 1003 - DNA, 5597 bp, Oryza sativa
atcctcgcgccgcgcccggacgagccgtcgccactggatctggcgagctgccacgccgtcgtcgagactcgtcgctgccacgccgtcttcgagactcgtccccgccatgcgagaggaggggaggccaagaagttcgccaccgtcgagcgccaagcccgccgccccgccaagaccgccgccgccgtcgcctccttgctgccgagtgagtggcctccatgccaagaccgccgccgtcgtctcctccttgccgccaccgccgtcgtccccagatccaccgacgctccgcccggccaccccagcgccgtctccgctcgccactgctccgcccggccccgtcgccgtcgaggccgccgctccgctcgaacgcctcagtgccggctccgctcgagcgtgagagaggggaaggagcaacgttgggctcgaggaaagggagagagagagagcggaaaggtggagaaaaaaaaaggaaaactatatttttgtgaaccccacttgaggtactgcattgtgaagcttgtgcctcttagtgttcctcagcatatgtggcagctcaggtccggcattttaggtgacgcattgctattgccctaaaagacgacgtgccattgctgctgtgtcgctggcctggcggaggaagccaacaagtcctgatgagtctggcaccaaattcaatgtacagtactagtagtacgtgccaggtgcaacttgctaataataaatcgcttaatcgagcatgcgcaacggcacggcgagacgagacggacgcgcagctgcagaggtcgtgcgccacatgcatgcacgttgcaaccgcgattattttgtggcgtgctattcgatgtagttttccgtgctactcctatatttgttggagaaatagggacgttacccgtgctacgagtcgttctggaagaactgttctcggtggatggagccatggaggccagctagctgcagacgcagctggctcttccgttcacctggagagcatgcaccaagaggcacccttcctatacttgctagtctacccaggtgagctgtgacgttacacgtaacagctccgaagtttgcaattttgagcgttgctgtgtttgagttccttccaatcgagcaaccacgttatatcgcctctagtcttacgatccataggaattaatgggaggcgtgaaagtggcctgtccttgtatactctgttgacttgctatatgtgcacttctccaatttgtgcgtcctcttgtttcagccagctagctccgctgctccgacgtcgttgggcaaccgaaaagaaagttgcagtcgaagaagagatctcgcagaagaacggcaggatctcatgccggactggaacgtaccgaggacgagggacagaacagatattggggactcctgtagcggaaactctaaatgcgcgatcgatcgcggctgcgatcggatagcgatcaccacccctcccccctccatccctacacgtttccttttttttttcaccgcattaattttttattttagtaaatttatgcacataaagtttatacacctaaagtttatagacccaaagtttataaattaaaagtttatatatccgattcaaatttaaatttgaattcaaatattttttatatatagtatttctatacatctaaagtttatacacctaaagtttatagacccaaagtttataaatcaaaagtttatatacccgattcaaatttgaatttgaattcaaatattttttatatatagtatttagatacatctaaagtttatacacctaaagtttatagacccaaagtttataagtcaaaagtttacatacccaattcaaatttgaatttgaattatatccaattcaaatttgaatttgaattcaaatatttttatatatagtatttctatacatctaaagtttatacacccaaagtttataagtcaaaagtttacatacccaattcaaatttgaatttgaattatatccaattcaaatttgaatttgaattcaaatattagtttatagacccaaagtttataagtcaaaaatttacataaccgtttcaattctaaatttaaatttaaatatttatgatgtagtaggaaaagaaaaagggaaggaggaagggggagaggagggagcgacgatataggggaggggcggagagcgatcacccgcccattaggcgtacccgtcctatagtcctgtagagaaagatggaaaagaccaaggccgaaacggcccggcataaaacacacaccggtataatctgatccaataaggaataagtccactcgccatctcttaactttgcgttgagtttgtttgacatctttgtctccaataacaaaaattttcacctctaaactatataaaatcgtgtaatttagggtctcgtagtagtataaatgtctgatttcactgacgtggcatcctagtcagcaaataaaaagtaaaaaaaatgtgggaaccacacataagtgaggagaaaaattgtgggacctgtgtgtcagcgccatcttctttctactattttcttcccaaccacacacagtgcttgggtgttggccgtgaggaaggcaaccgatcagtctgggatggagggaggcagtcggcgagcctaggaaggagagggagggggaggcggccggtgagcccgtccgagcttaagcttacttggcctttgtcagaggggaggctcaactcgttgttgccccctgtccccttggttccccgtcgacatgtaggaggaaaccatagatggagaacgtccctgaccaggacacggacaccgatggccacatcggagccactcgtccataggaggagacaacaatgtgggatgtcagcaacgaggggcttcgatgatcttctcccacggatcctcctctacaacagcttttaccattgatttggtcgccgtgtgtgggaacacccaatttaggcttggtgccccaaaaatccactcgtgatcgttcaggatttcgatcacgcatagattgatatacagaacagctttcgattatttacacaggtttgttcatacaagctaattatacaactgttaaagggtgaaaagatccaaactaaaatatccttatttgaaatacaagaaaaatccaaagtactaaactcctaaacttcttcaactactagaactacaattaataaattccaaagaacttcaaagaactccacaggcaaaaactcgagtgtagactagcctagaaaaactcgttcttgtcgtagatctcgcttccttctgatctccttattagcacgtttcctctatatgtcaaattatgcaagggtgagtacatatgtactcagcaagacatattataaataattaaagatgaatagatatgaataaataaacaataataaagtaaaggagtaatgaaaaccataaatcatctttatcctcaacaatttaatttttaaaactacttatacttcaggagtaggaatcaccctaatggcacaactccagaaccgggagtacggcacattcgaatgatttaattcacctctgcagagactgtccagttttacccgcacgatgtcaacagtttgcaaggctgaggacaacatagccgttcgagagtcccacttactactagttactgcacagtggggtcttggttcatcatagtggtcgaactcttgtaggcctaggcaaggtatctatatcgtcacactttcatgaatcccactgttgtgaaacactgccgcaaaaactcattaggtaagttcaccccaaaaccgctcatagagccacccaatagtctttcatataatgggacaatatactaggctaagtcaaattacttggttgtgtggatggacgcaactatatcatttcccatggtataagggggtaattataatccggttaaaccacccaaaaactttccaaactccccacaccagcatcacaaacttcatcaacattcataatcacaacattcataatctcaactcataaatgcccattttaaccggattcctaagtttgtaaagttatttggaatagtaaattacataaaatgataaccaatgcttctttctatgttctcatgcaatcatgcttaaaagcatttaacatctacccatgagatgttaaaagagtaaggtattatgcatcaaattaaatatgaagatcatataaagttttctatatgatcaaaattttaattatgtcttgccttgtgccttaatatttcccgtggcttcagcgtagccatctgggtccacgtcagctccttggatgccgatagaacttcttgtatggtctaacgtacgaatacgaaaagatagcaaataaagcctataagcaaattgctacaaagaaacgataaagtcaaggaataaataaaattggagcgaggcgaaaggaaaaagggaatgggttcaaaataaattttagattgaaaataaaagagaggtgatggtttctataggttggaaatcgaataaaattgaggaaaggataaaatggagaggtgaggtttatttggtggattggtttctagtcggtgctagggtagggtagcacgacggctagatatttggagttggttagccgatgctaaggcataacagctaattattggctcgtctagtcgatgctacagttaagcagcacaatggctagagagttgagaagtttgtgcaggtttgcagggtggaatagtgttaccctacagccgtgagtggcagcagagcggcttgaatcgcacagagcctgaaagctagtgtgcgacgtgctatggaggttgagggagtagtgaggctctgaccactatacacgtcgaggcgtggggtgcgaagagcaacacttcgaccttaagattaggtgatgccgggttttacgaccaacggttcgatgtcggggtttgagatcatgcgaacgtctccatggaaggcgtaaagttcccacggcggctatttggtagctaaggatggtacatagatggtttaaaaaataaattaatggaatttgaattcaaaaatagattaaaatttaaaatggtattttaaaataaagaaaagggcatttaatgaaattaaaggataatttaaagtttttaaataaaaaaagaaaattaaaatttaagggatgtaaaggtatttgaataaaataatttttaaaggttaattaaaatagtttaaaattagaaattaaataaataaataaataagaaaaggtatttaaataaagaaaattaaataaaaatttaaaaatagaaaatttggtatcaaaagagagggtttaaaattagatgaatttaggtcaaataatttttggaattgggtcaatggttggagagatatgggctcctaaagattaaaaatcaaataaaagaaaaaggaagttactgtgcagtgggccccgctgtcagtgtcttctcctttctcgttttcttcttccttcctgcttcctaggaggggtggtggctggtagagatgaagggtaagatggccggaacggcgaagataatgcgtggtccggtcaggagaaagagagcttcggtgtggctggattcaagaggaaaaggcaggggaaaacgggtaaaatggtttccccgaagtaagaataagctagtgg

SEQ ID NO: 1004 - DNA, 3060 bp, Oryza sativa
  unsure (1)..(3060): unsure at all n locations
ggggcgacggtgcggcgcccatcgagagagagaggaagaggcggctcggcgggcttcggctcagttgggctggcagcccaagaaggagggaggaaaagaaaaggggaatgggccaaaagaaagggaaattggcccaaaataaaaaggaagtttgataattttgtatagaggatttggaatggaggaatttaaaggagatgaaaattaaaggatagatggatgtggactttttgaatcttggtcaaggaatttgaataggattcaaaggaattgaaaactaggaaaattttgaatggaaggctttaaatagattttaaaggagataaaatttaaaagagggatgtttgagggtcttttgaacttttataaaaggaatttgaatataaggtttttgaagcaaaagggggattgaaatatttttaaaataaaatcaaagatatttattttgagatataaaatttgataaggggtaaaaataaagatgctccaattttataaaattcaataagaaccaaatataaaacttgtcaaaaaataatcaaatgggaaggaaaagcaataacttaatttctaactttggatgaatttgggatgggggcaaaaatagatggaggtaaataactaggattttagcctccaaaatatgtggtatggattctcagtgaattatttgtggctaaaggaaatttatattgtctgaatgaaaaggattggaaataggtttcttcgcacaagagcaatcactctaaatattgtgataatattattcttgtgccgaggaggaaatcaagccataagaattaaattggtggcttgattaaaataggagagtttgggaatattaaaggggtttatgaaaggtattgtataaagaagaaaaatggggatttcaaaggggaaatatttgtgggagtgtagaactggattcagaagtatatgtggatgtgaatttctacaggaacgaaatttgtggtagattgatattcttctaaaggataggtatattgactcagggagattgaaaaggatattttatggactaagggaatatttaggtggagatccaaaggaaaagtattggttctgggaaaaaaataaaaattggtatttcatgtgtttggttagagatcaaaaggggagtatttggtgggagataaaactagatttgatggtagtgtggtaagctctaaatgaaaaggtattaactctaaagagattgatatttcatgtgctctagagatggttgagcgaaaattaaaagggttttgttcggtaaaggagtcaaggaaatataatctagagccaaagttagagattaaataaaataaatagaaaggttttgtaaaattaaaaagggattttaaagaaagcttttaacttagcaaataaagtttagactcaagtcaaagaaaagatcaaaagtgaaattactgaaaggaagaatcgagaagagcatgacttaaaatatttcgcaaaaaattttccctaaaaatttaagtccattacatcgtggtacggcgagccggccgcccggtgggggggggggggaagaaggaagaagggnatggnatggtggtggggttgggnatgtcaaggggcggtgtgttgcttatgacatgctcgtggtaggacgaagaagggacccaactcggtgacaatgaagaagacctctgggttctctactggggtcgttgggggtgtactggcaacgataactgctcaatgtcatacccgtctcagttggtttgtccgctgcaggggtcttttctttgtgggcgtcgtctcaccacaacggcgtggcggtggtacgatgagccgacgtagaggagcatcggcagcgcgtcgccttccttctccttatcttccaactcttccgccaagtgagatcccccacattttttcttctcatttacatgtggactctatattttttttctttttgctgactaggatgaaacatcagcgaaaccagatattcgtattgctatggtattcaaattgcacggctttgtatagtttagggtaaagattgctggtatcagagataacgaatgtcaaacaaacttgagcaaagttgagggattgcaagtgaacttattccatccaataaagacttgtttgtggactttccaaactggcccaatttaaggcccaaaactatgaggttctcatatttcctgggcttcccagttctcaaatgctcaagaagtaacgatgccctgacaagtgacaaatgcccattgagcaggtaccgcgttgcgaattttttttatttctaattttttttattaaaagttttacaaaaataattttccattttgaaaattgacggaagtagtcgcctaccgccctctgggagggcgatttttaaaaatcgccatcccagatggcggcgaaaatgacgtggcagacggccgttcgctctcgggcgacggctgtcaacgaaatttgcaggcggcccccttgccgccctccgctagggcgattttgtactgtgcggggggccgcctgcaaatggtcggcgagggggcatggaattttgcaggcgccccccttgccgccctgggggaggccgatttttgcctcccccctataaagcccagtcccccctctctgaaatttcattatattcccaaccctttaaaaatccaaaaaaaacgaaagagagagaggagagggcagcagaaggggagcggcgaagccctgctggttcgctcacttcatcacaggtttgctcccatatatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacattt

SEQ ID NO: 1005 - DNA, 5863 bp, Oryza sativa
  unsure (1)..(5863): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtatttgcgggcacctaagcgcatcaccacgcgtcccaactgatagggattccgttttcctgaacttattgacgaaagtggtgcgggagtggttggaagcattggagcttgatggcaggatggaagcatgaccatggacaagaacgaagcggtggaggagaacaaatgatacatcaatcttgttttttttccccatgcagatcaattcaatccactaaatttgcggaaaatttactttatttctatcaaacaatacaatccactaaatctttgaagatttagtttgcttcctaatgaacgatactaatcacatggagctaactattctcgactcacagaaaataccatatttgactagttatttccccactgctatcgtttacgataattttattttatatcttgcatctctcttaatcaacggtatacattatcctatctcttagtatttcgaagtaccttataaacaccgtaaaagctcggagccattaatcggccgctgcaataatccaatgaaatggaaaagagtccggctgcacgttgcgatatgtacggactccagaaaaaaaaaaaggacaatacaacagaccatctgcccatctgcaaattaaaatatccgctgtttcgaccaatcgatctcttcgtagtaaatctttcgtaaatgcatttgttgagatctatcgccagactaaaagtactaattttgtgcagtgggttgcagtcgcatacagtagtcgtgggcacggtgcacgtgcactgaggttaatgtggaatgtcacgaagcgaggatggagactggtagccggccggtgtagttctcaattggacttttttttttttttttacaactcatggttggagttcagagcagcatattttccatacgaaagagacttgaaagaccgggaaatgaaaaggttaggggactaccaattgagggcgccaaacgtggtcgcgttcactgctgctgcgaaacataccaatcaccagcttgggttagctagtatacctcagctccaaacacgtcaaaattgatcgacggaatgtttgatcaactgtcgttacgggtgctacatttgcgaaggaactggaggtctggagtacaaatctttcgtgccaacgccgcaacgcgggaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaattttttttatattgaaaattatacaagattaaaatctccaagactggtaaaatacaattttattattttttagggtctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatcttaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatccctgcacccacactttggacgctcggaccatttatgtaaccctaatggattgttcctccagtctaagcttgcaatttccacccgacgttcgtactccatccaagtatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtgatgtgcaccgtgcaagtcgtcgtcgtagaactggctagtaggaccagtcctaccggcgtgagacgaagaggccccagtaccgaagatcccggctgcaaatcctactggacaaggaccatcagtttcatacatgtatttaatagtattaataaaaagtaaagtaccttgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcaccttctctgtagctaacacccagtcgtcaacgtactgctgtacacgtggagcccaaagtgcgcctgctagctgtccccgtcgagtcaaccgaggtaaattatatggctcgatgaagtaagtatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctaccggtgctctcgtagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtggctcgaagcgcgcagtgatatcctccttccacccaacaacaccgtccacgggaccaactggtgctcccgccagcggtagcccgagcaggtacgacacgtcctgcagtgtcggagccatctccccacagggaaggtggaacgtgtgcgtctcaggtctccagcggtctacctgagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgtcgagctgtgcaccctcgactgctgacaggaacgagcggtggttcctgtcaatcccacggttcaacagcgccggtgtgtcgtacgccatacctgcatcaaatagattggtcagaaacatataaataattagtcaacataagtaataaatgttcataagcgaattactaacacatattaaacaagagtacaaacaaacaaaagtgtcaccatacggaatatttctgattacaacaatagctgcagttactagtccgaacactcatcacgataacattatgatacaacaccgaatagttcgcaatactactagtacaacaatagtcggaggtactcattacaacaacattcaattgaaattacacgatataagtatttagtccgaacacacatcacatcacaacagcgttttatttccctaaatcgatagcattgttacaccatggaatcgcctgctgcg

SEQ ID NO: 1006 - DNA, 1501 bp, Oryza sativa
ttcaccatgtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagattctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtcgccgtacctttttgattttatcttccatgtactttgtactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtaaaatttctgatggccgaccctgacctccttctcattgttggtgggtcattatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagccttttaaagagctccataagatgcttgttcttgaattgcttgtagaaatttgcacccatgtgacgcatgcaccaccgactccgaacatcgggccacttagctggaagtcccttctcatcccaaccgttctgcaagtagtcaatagcccgcaacatacccgcatgacgaacatgtataaggcaaacgttgggcctcatacgcaccactgcaatgtgcactctctctaggaaccagtaccagctttcagtgttctcactctctacaaatgcaaaagccataggtagaacctggttgtcccatcacacccaattgctgtcaatatctgaccttggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatg

SEQ ID NO: 1007 - DNA, 785 bp, Oryza sativa
  unsure (1)..(785): unsure at all n locations
ttggcaccaatgcacgatcgatcgatttatacaaatccaccaccaccaccttcgcggcggttatccacttcatcaccggccactctgcctagagcattatcatcgatcgtcgtctacctagctagcttcacttgtgctccactgcaaccagtacgccacattaacttaattcacacctagcttagctcactatatagcttagcttcgcttaagcttaagctgatctcggagaagacgtacatgatggtggtggtgataaggcggcggatgtcggcgacgccgatgctggtgctggtcgctatggcgggcggcgccaccgtgtgcgcggcgcagctccggcggaactactacgccggcgtgtgccccaacgtggagtccatcgtccgcggcgctgtggcgaggaaggtccaggagacgttcgccaccgtcggcgccaccgtgcggctcttcttccacgactgcttcgtcgacggctgcgacgcgtcggtggtggtcgcgtcggcggggaacaacacggcggagaaggaccaccccaacaacctctccctcgccggcgacggcttcgacaccgtcatcaaggccaaggccgccgtcgacgccgtgccgggatgccgcgaccgcgtctcctgcgccgacatcctcgccatggccaccagagacgccatcgcgctggtacgtgtactcccggtttgactttgttcaaagttaaacaactctgagtttgactaatnnnnnnnnnnnnnnnnnnnnnnnnnnnnnnnnnnnnnnnnnnnnnnnnnnnnnnn

SEQ ID NO: 1008 - DNA, 2145 bp, Oryza sativa
  unsure (1)..(2145): unsure at all n locations
aacgacaggaagatcatgttctgtaaagcggccaaacaaggtcctgggactacgaggccctcaccatccgatgggggtgagtgtgtcctacgtcgcaattgcttcgcgcccacccacccacccatgtgggcagcaggccctcccgcatttgttgctgcctgtgtatctgcatgcggtgaattcatccattcagttagattcagggttggatgctgcatctggagtgtgtgctgttggaattctagacgtcggtgatccagggaaggtattgttgggtgcgagcttgattgagtcgtgcgattttttttattcgcatatattatattgggaaaatggatatactccctgaaatcattgggacaattgattacttactaataatttctgttcactagtggctacttaaattacccattttttgacttgcgattacggtgtcatctacaagtttgcatcgtaaatacatttctctaaaccacgtacatggaggcaacaataacacataaactgctgtcgttctcattgaattcccattgtttcagattgcatgttagattagcgatgttgcgcagagggcatgttttttagttagtttcaatctgtcgaatgatttagtttagatagaattgggctcatcatttggtgttacaatttaatttactttgtaataggaatccaaggcatgcatcaattgctctataagtttagagtccacgggtcatactgatcctgtggtcttaaaacagctattttgggcagcaaccatgtgcagcattaaggcttgtgctgaaggattgttcttcaacagttcaacctaaggattagagtaaccatgttattttttttagtaaatattcttaatcaagtccattgaaatgactatatatgttataataaacttattttacttaattaaccatgacaatggacctttgtcaatatgtattttatcactgaatgaaggcaatcatgtgattagcttgaagtgtttttattgctactgtattcttgtatggattaaagatggtatgaattaagtgtaataacctgatagtactttggttctttggcctttgtatagcttgaaaaatagatatcaggattgattgtagtgcattatgcctagaggttatagctcaacagcacattaccctcaagtgcctggtctggcactggtgttttctgcttgttcttcattttctaaagacagaacaggaagatcatgtactctaaaagcaacccaaaataactttggttgtatatgattactttagcatgacgcatgtcttctccccacaaatataccagtgttcatcacttactgttttgaatagtgtacttatatctccagtcaattaggaattcatgctgtgagtgagctcacaaaaaatgtccaactgggcacttatattttcccagcctatcctgttaacagtatctgaatttatgatctctttgagcagtgagcaggatgattatgaagttgtcaggaaagttgggagaggaaaatacagcgaggtctttgagggtattaatgtcaacaacaatgaaaaatgcattatcaaaattctcaagcctgtgaagaaaaagaaggtagttcatgattcatgaatcctgttgtccatcctttttttccttttcccctgaacatgctcttttactggtaacatggtactgtttccatcttacacctagctttgtgtcaatggcattagtgtttattattttaaccatagttttcttttgtatgcagatcaaaagagagataaaaatacttcagaatctttgtggaggtccaaatatcgtgaaactgcttgatattgttagagatcagcactcaaaaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1009 - DNA, 665 bp, Oryza sativa
  unsure (1)..(665): unsure at all n locations
tttttaccaaaatccaaactttgcgctgaactaaacatcaagccttacactactactacatccaccaatggtaggtactgtaaaataccctaatagctaggcacacctttacagctgtggtgttgacatctcctgcttagatttttggaagccctcgaaaagggacctctcgtattggtagttggcatatcttcctccaagtttgcagctgaagaaggtgataacggctaaaccgaataatctacccctgaaacaaataaacaaacaaataaataaataaagagcaaagtagttagataggggactttaagggtaaggacttatgtgttacccctaaaagtgtcacattaaattagatgatgaggtggagatcgaagggaagtgaaaagagaacataacccaactctcatgcaagaggcaaaaagaaagtggaatagtgtgagagtggaccaattcaagaaaatgttaggatttgtgtactaaaagtaacataatatgcatgttacatcttaataaatttatagatgacatagctaaaattagatgtggtaatcacatccgctgtaaaacttgtcgtcttgccctaatgtagcagtaacagggaattactggtggttgnnnnnnnnnnnnnnnnnnnnnnnnnnnnnnnnnnnnnnnnnnnnnnn

SEQ ID NO: 1010 - DNA, 582 bp, Oryza sativa
atagtcattagctcatgcatatatgcatcattgcaatacataattaatccatcacattcttcaaatctacatgtcaatacatgtatgcatatatgcagtaagctgacagctatgggggtgcccaaggggaagttcagagaggaggtagtaggggaaatcaacattgccgccatgttctgtgtcggcttcttgcttgcctcctcctctactgaacgaatcatggacaagtacatcactcctcaacgccaatcacctgctcaggagaccaagaattaagacgagtccagatcgatcgatcgaaaagcttctgaatttctctctttaattaatctgtgctatagattcactaagtcgtcgtttaattggtctctctccttcagtactgattgattataatatattgtcatgtaattctttattactaacaatgctgatcaagataataataactgtaacttgacaaattaaatggttatgtgcagaacttgttatattttaggattgaggtttttttttcataagacagtaaacgacaacatttaaaaagacgttggatataaaagaaagggctttcatatcgat

SEQ ID NO: 1011 - DNA, 1161 bp, Oryza sativa
agaagttctaatccacctaggaaaccttcgcgtacaagaaacaaaatttacaaactccaatcataccaaatttagactccttccaaattcgacaccgcatcacatacgcacacaatatctccatcgtatgccatatggaatcttcaccaaccacattaaccaacatatcagcatattgcccttatttaaaagctaaatttgcaatagtaaaaacaatggccttttctaacctacaactaagtcccccaatgaaattgtccattaatatctaagcatacacaaacttccatttcaaaggatccattcctaatttgaactctcacattatgattaaaataaaataaatacggttcttctataatttggagaaaaaaattagggttcttccctaaatgcctaaaccctcaccatagtcctacatttaacggttctatgcgcatctaatcattgcattgccaacaactactacaaccacaatgtagagaacaaactaattagagaaaataaaccccaaatcgtgtttctagggttcatccctcaatgagcaaatccaagcaaaaaatggacaaataacgagaagattcggaggagaataccttggcactatgtcccccaatgattttccctccaaaatacgaagattttgtggatatttgctcgattttggagaggaggagagagagaggagggcgccacgccttctcaaccaagaggtgcgaggaggaagaaggaatggcctggggccggctcggccccgagggatatgtggggacctcagcgccaggcctgttggcggcttggcgctgaggtcgcgaaggtcagcgccgatgcggttggcgctgacctttgccacatgggccgtttcgccccaccgcttttagatggccgttaggacctcaacgccgatgcggttggcgctgaggcgttctacctcagcgccatcgggtctggcgctgagctcggggtctaaatctggtgatagttttcggtagggaccaaatttgaaataagttttaaaaaagggccaaattgtgaaattttcggatggttacatacgcgatgaatgctgcctaattccggtagttgaacacgttattttgagagtaattaagctccaatggattgtaatatataattaatggcaatgtggatgttgttaat

SEQ ID NO: 1012 - DNA, 788 bp, Oryza sativa
ggcgaattcgagctcggtaccctgcagtacattcaacaggtgctgacagacatgttgggcattagcactgcaagctccattcagttgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcggtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctggccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagt

SEQ ID NO: 1013 - DNA, 2392 bp, Oryza sativa
aattgtttgataggataaatatttgtattcatcttatttggtttgctactaagataaaaaaagcagaaaacggcataccttaagggcccctttgattcgcaggataggaaaaacacaggaataggaaaaacacaggaattgaagtagtatgattcttcaatcccgcaggaatcaaaaacataggaaaaaatgaaaggtgccctttgatagtgctataggaaaaatacaggatttctcttccggtttgaatttgaacagatagccgttggcgttcaaagcaagtactagccgttgcatgtccttatatatattgctgtagctgcaactggacatcaacaaaactagctcacctcaccttcgattgtatcggccaagcatgacaagagctcaaacgtggcaattcatttggtaagtcataaatgattttttttctttttggtatgtatgtaaggattaacaacttatttgcttgcttctgctctcctatatatattggtagaccaaaccatcagatttattatttgttgttgatttcccctgtgattgtcatggatccaagttatcgacgacggtcacagaatgaagatgagttcatgctttttgttctccctaccatcgaaggagattcgtcacaaccatcatctagtaggaaaccgatgcacacatcaaaactttcaggggcttgtcgtgttaatgaaatcttaacaggtcatcagagcctaagcaaaaggaattttcgcatggaagttaatgtttttcgagctttagtcgataagttgcgtgagaaacaactacttgctgatgcaagagatgtctcagtagaagaacaagttgctatattcttgtatgcactagcaaaaaatgcaagtaatgagaccttgcaagatcagtttcaacacagcgggcaaacaataagcaagtattttggggttgtgcttgatgcagttaagcaacttacatgtgtatatatacggccacctttcctacacccccatcatatcttgagaagaccaaaatttcaccccttttttgaggtatgaacagattcatgttttgatttttttttactttgagttaaaccaatcattgtacataaaaagacttaatcaaggttatatttgtatttgtatagaattgtgttggctctattgacgggacacatgtaccaatgatacttccactagaccagcaagaaccataccggaatagaaagcaaacaatttctcagaatgttatggtagcttgcgacttcgatctgaaatttgtacatgtacatgccggctgggagggatcagcttcagacgcaagagttcttcaagatgcactaaaccatggttttgaagtacctcctggtaaattttttcttgtagatgctggttatgcaaatacaacacagtttctagcaccgtatcgtgggacaagatatcatttaaaggaacagggcagagctaatcaaaagccacaaaattataaggagttattcaatcttcggcatgcacaactcagaaaccatatagagagagcaattggtgtattaaaaatgagatttcctatactaaagaccggctcacaccacccagctcataaacaagttgatatttcggttgcctgttgtgctctacacaacttcatacgcctgcataatggagatttggtgtggccaagtaattgtcgtttagagattgatccagatcatattgttgatgtgccaaatggagacgagaactataatggtgatgtacaagaatttaacaactctagagaagctgggaatagaaaacgagatgacatggcacaacggatgtggaaccattacgtagcacgaaggaaataatatattgcatttgaccaccatggcattcaaggtcaattactagtcttgtactccaagtttgtcacattctacttaatgaagtaactacttgcatgcactccctctaagcaaaagtatatcctactactatctgcttcacaaaagtaccccctttgtttcacaaaagtactatccttctatttgcatgccatctatttcacaaaagtactatcctactacttgcatgccatatgtttcacaaaagtactcactctaatgctgcgatttcctttctaatccaagccaggcgtaatgcatcacttgaaaaggacaagaaaacttccctattatccttacctttgaagatatcagctgccaccaatatatctcctatttgtagaccatgtaaaccttcaagcactgtgatacacttgttgatgctgtaaggatcctccaatttcttctcctcaattgcagcaaatcgatctatttcttcttttttaagttttaggtatctctcatgaaatccatcatcaggactaacagatttgatcttttgtttcttcccaggtcgagatt

SEQ ID NO: 1014 - DNA, 1705 bp, Oryza sativa
  unsure (1)..(1705): unsure at all n locations
nnnnnnnnnnnnnnnnnnnnnnnnnnnnnnnnnnnnnnnnnnnnnnnnnnnnnnnnagattcaggaacctctgaaggtgtttgtgccgagctaggtgggacttttgtgagatggacaggggtaggtgaatgctgtgaaaagtccaaattggctgtctcaacctcttcaccaaaaggaaattgcaaacctgattcacctggagcatttgaattaggggatggtgactgatatgtatcaaccgcatttgcttcttgtgttgaatgagctggtgcattctttgtcttccttgcataatggtccataccatggcgagttctcccttcagcataacgacctgcacaattatattctcctcacgatcagcataacttgcctaaaacatttcaacaaaacaaacaaaccactgataaaaaaaatataaagctcaccatcataaagtggagctaaatcatcaaaatatgggaacgacttatctcgccaatgaattgcatctttgttcttgcgatcagcaaaagtgtcccaaacactttgtggtgcactcaccatcattctgtcactatcccacccaaaaccactttgatccaacaaatctttaacactgcgataatctttcttcaaatcctgctccttttgcttgacttggttggtcgtaaatgatgtaccgaattttgtattcaggcggcaaacaatatttgtccatgcttccttactccaagcattttgtgttcgaaaacctggcacgtcatgatctgttaggagctcaataaagaacatctttatctggtgactccatctggctctcttttgcgtccctaaaattgacaaacatttaacaatttcagtttcagccaccatatgaaacaaaaaaggtttgatgcaaacaacaagtgaaactgaattgcaaatattacctatttttgacgctctgcagtcccatgctcactgtcaacattaacataaacctgtgatagaggtgctgggctcgtcgatcggacaaattgcgttgatttgtatggtcatctgagaagagcctttcgatggcattgctttcctaaccccaaaaaaaaagaaagaaaaaagaaatacataatccttatcagagagggatttacacctacagtgccaatgaaacaaactagttccaagtagtcagcttaaaaattcactaatccatagatccaaagtacagaagcactaataagtcaataataagtcaagtatgaaagctcaaaagtgcagacaaataccaaatcgatggccctggctgctgccctcgatggcggacctgccgcacgcctccgcctagcggagcccaacctgcgcgccagatggatgctatgcttggttgctgcgtgttgctagatgttgggccggcgtccccagcggaagccgcatacgcgactgagccggcgagcctcgccttcgccttgcacccccagcggccggctcaagctgctgactatctctatcacagttggctttcttggctgctaatatgtggtcctcggtggtcctcgttcccatctttctctctctctctttttttctggaagaagcgcgaagggccccggtttaccgccaaacacacaaaagtggcgccaacgacgacgtgcgcacgcgtgggcgcgcccttctttcgcgccaggaaagtttccaaagaggaaagacctctttcttattttcctgtgaaaatgaactaaaggaa

SEQ ID NO: 1015 - DNA, 7979 bp, Oryza sativa
gacatacataggaaaaaatccataggattgtaaatcctacaaaagtcctatgccaatcctttgaatcaaaggagccctaaggtcccaattgaaaataacattccaaaccgatgacgctccgctccctcgtcgtcgttccgacgtcctctggtgacgcggggcggccggagagcccggcctcgcgggtcgacctctccccgactccgtccctgttcaaggaagtctctctctccctctcttcttcctcttccctcccttcttcctcccttcctacctcgatgtcgcgcggcggcctcctctgacgcggccggcctccccggctgtggtcgtggtgacggcgggacggcccgcctcccctgctgcaccgtcgggacggcctgccccgccctcggccgggcggtgcggcgccccagctgcgcgcccgccctcggcgtcgccctcggcctcgcaggcctcgctgtgcggcgcctcggctgcgcgccctccctcgtctccgacccgccagcgttctagggcgccgcgccgacgcgccaaggcgcctcctccagcctccatcttcaagggcgtcttgggggctgccccaacaccgccgcctgcggcgcctgcagcgcctgctgccgcggcggccgtgccaccgccagtggctgctcggcagcctgcgcaggatggggactggaagccgggccgtcgtcggcgccgccgctggcctcggcagcgccgtcctggggcctccgtcaagccttcctccacggagacgcgcaccggtattccgccggagctgtaggaccggtgcctcaactgcttgtcgtcggcgcaccagattgcgacctgccgtctcccggtgcgttgccgtcgttgcttgggtctcaaccacctcgctcgcgactgcaagcgtcctcgcagcccgagctcgccatcggagcggcagggcggccgccgcgtccttccgcgccgtgcggcgtcgccctctgacgccacgccctcggcctcgcaggcctccacgcctgtgggttcgccggtggcggctcttgccccttctccgcctcctctctgcttcagtgcgtcgccgattcgctcagaggacgagtcgctttgtgtggtcgagcgctcgccgcagctcatagaggaggagggccggctccggcgtgctctcttcgcccgggtgagcggcctggacatggcgctgtcggccggcgatgccgccgcggcgctgtcggctgctcttcacctccccgcaggccgcttctccgtccactgcgcgcagcccgatcacttcctcatcgtcttcgctaactccggtgacatggacctcgcgctctcgcgttccccgatcccggctcccccctaccagctgattctacgaccatggacccggcttgtgatggctacctccttctccatgccgttcagggtgtcgctggacctcgagggtgtaccggcacacgcctggaacgcgtccacggcggcggccctcgtcgctcccggtcgtctcatctctgtggacaccccggcgcgccccgacgagtaccggtttcttcgagtcaccatctcgtcgcacaacccggccgccattcccaaggctcgtcttcttctcattcccgagccgacgttgggctcccagtgccttctccggtatcgggtccttctccacgtgctctcggtggtctgcctctcggccccctcggcgtctggcgatgtcgacccggccggtggcggtggtgctagcggtgagggtggtggcgctgcgaacgatggtggtggcgctgcgaacgatggtggtggcgacctcggcgctcgttcttcgcgaggtttggacgggggtagtcggcgcgatggcagccggcgcgacggtgctccgcagcggcgctcgtcaggcgttctcagtgatgtgcgccttgcggaggtcgctggcgcgaaggcgcgctccccggcgttggcggcgtgcccggcggggtctgccgacgcggcggtgcggttcccagtgctgccagcgtgtccagctgtggggcccaccattcaaacggcttcacctgacttggtgcccccctggcgtctgcggctgtggccatctctccttttgaggccgtttctccttttgaccactctctttttgcttcttcttttgtctcctctcgcgatgcttgggcgttggatcccatgttgattcccccatcgctttccacgtcgctcgctggctctttggacgcggtgatggcaggcgcagagagcgcggcgggtgcggagagcgcggctccccctccgcacgtggcagcggtggctctctctccgcgcgcggcctcgccagctgggctgctcagtcctggcccagtctcttcttcgccagctgggccgctgggtgggccgtcccctccccttaggctggtggactcagctgggccgacgtgtgacttggaggagtcgccacctcttgtgccgcttgggtcgccgcctgcgctggcccatgcagcccatgcggccacctcattttctccgttggccgacgacggacggggcttgctgctggcgttgccggacgccacgaattcgccagctgctgcagacgccatcacggcctctccggtcgacgtcgtcccgccggtcgacgcgggctcgccagctgccgatgtggccaccacgtgctctccggtagccgctggcatgccggccgccgccgtggccgctgctggctcgacggctcctgctgtggtcgccccggactcgccagttgctgccgtggctgtcttcagctcgccaactgtagtggctgcctccagctcgccagctgcttcgccggttgacatcgtggccgcctcttcttcgccggctgccgccgtggccgccttcggctcgccgactgtcgtggttgcctccaactcactggttgcgggttcactagccgccgtcgtctctccggtctgcgccacttcaccggttggtgcctgccacccgccgaccgcatcttccttgctgtctggcccttcgggtggcggcccggcgttccctgcctcgccgctgtgctcgcgacgttcgccgttgttggccgatgggatcgcggcctcctacgccgagccgactggtctcttcttcgacgagctcgacgccctggccgcggagtttggtccggctgtgcctttgccgcccagggtatcgcctgtgccgccgtccgcctccggtgcaggcacttctctgccgaggactgcctgcacaccgcctactggtggggagtggctgaggcctgagtcgccgctttctcagcaggctccaactttggtggttgatgtgcccgacggcgtcctctacgatgtgccgatggttgtccttgacctcgatggccgcccactggcgcactcgcttccatcttctgtggcagacaacgccgctcttcacgccttcctcaccagctgctccaggcctctccctcctgcgctcctcccgccgcctttgccgctgccgcctctcgccgccaaggcggtggaggttgtgccgaagcgcagtgagtgtatcgctgctaagatggcacttgaggcgcttgaggggccgatccacgcagtgtcgcgcgcccagcgcaacctgatgcggaagctcggcctagttccggagaggggcccggtcacggccgaggcggtcgcggcttacaacgccctcttctccaagccactttcccaggagcacatcatcgcgctctcctcgctcttctccagctccttgcccccggccaaggctgcggaggagttggtcgtgtgcggctgatcggtttcttctcttctgctctcggtgtggtcctcctcaatgggatcatgcaacgagaacattttggtgtggaacgtgcgaggtctgaactcgcgcgcccgccgggatgctgtgcgtgatgtagtccgtgatgagcatgtctctcttctctgtcttcaggagactattatggatgtaatcccctctcgtactattctggaaatgctaggcctcgactttgattattctttcttgcctgcggtcggtcggagtgggggggtgttgcttgcctcgcggacgaccgtctggtctgtctcagatgttcaccttgcggatttctctcttgcctcgttggttcgacactcttctgatgtcgccccctggtggctctccgtcgtctatgggccacaggaggagccggacaagcttcgtttcttagatgagcttcgttcgctgcgctcctctcgcacggggccgtgggccatcgtaggcgatttcaacctcattctcgaagatcaggataaaaacaaccttaatctcaatcgtcgtatgatgggtcgttttcgtcggctcgtcgacgagttggaactccgggagctgccgcttcacggacgtcgcttcacttggagcaatgagcgtgagtcgcccacgcttgttaagctcgaccgcgtcctcttctctgcggattgggaggagcttttcccctcttgcctcctccaagcggcctcttctatcgcctctgatcactgtgctcttctccttcatacctgcgtcacctccccgaaagcgcatcgttttcgttttgaggccttttggcccaagttcgacggctttcttcaagtcgtgcaggacgcctggcatccccctgccaacctaccccctcttgccgctcttgcctggtgcttctctaccacggccaagcgcttacagagctggagtgaccgtcacattggcagtgttcgtctgcagcttcagatggcgaaggaacttgtcttccggcttgatgttgcgcaggagagtcggtctctttcccccttggagacctggctgcggcgagatttaaagttgaagtgtattggtcttgcctcgcttgagcgtactatcgcgcgtcagcgttcgcgtttggtctggcttaaggagggtgacaccaataccaagttcttccacctgcacgccagagctcgtaggcggaagaacttcatcacgtgcctttgtgatggtgaccagcttgccgtctcccatgatgcgctgcaagagcttgcctcctctcacttttgcgccatcttggggacgagcgtcgagcgtgaactagccctagacctccactctcttggcctccgccctgcgcagcttgaggggctggactgtctcttcacagaggatgaggtctgggcggtgatcaagtccttgccctctgataaggcgcccggtcctgacggttttacgggccgtttctacaagtcttgctggcctgtgatcaaggtcgaaattctggcggctcttaactccttgttcctgaccaacggccaaggtttcgcttccctcaacgacgccctaatctccctcttgccgaagaaggacgaggctgttgacgttaaggatttcagaccgattagccttattcacagctttgggaagttgttctccaagatcttggcctctcgtctctcccctcgcctggacgagcttgtggcgcctaatcagagcgctttcatcaagggccgctctctccatgacaacttccgctatgtccagcttgcggcaagggcgctgcacgccaaacgcattccccgacttcttctcaaggtggatatcgcgaaggcctttgacacggtcagctggcctttcttgcttgaggtgctagcctagcttggcttcagtgaacgttggcgtgattggatctccctcattctcagtgcctcctcttcccgggtgctggttaatggggtgccaggtccacggttcccccatcagagaggtcttcgccaaggagatcctctttcccccatgcttttcattctagtcatggatgtgctcaatgcgatgctccgcaaagcctctgacttgggtgattttcttcccctcaatgatcgtgctattcgacatcgtgcatccctctacgccgatgatctagttctcttcctttcccccgttcggcaagaccttgagttcatccaaggcatcctctctgtcttcggtgccgcttccgggcttcggaccaacttcaccaagtgctcgattactccgatccgctgctcggttcttgacctggagctggttcagtcctcttttccttgctcgatctcggagtttccctgcacctacctcggcattccactgtcagttcgcaagctgccaaaagcggccctgcaaccgcttgtggataaagtctcccatcggctccccccctggaagggccgtctaaccactctggcgggtcgctcggttctagtccagtcggttctctcttccattccggtccatgtttctatagcgatcggcttgccaagctgggttatcaaagccattgacaagaagcgtcgcgccttcttgtggacgggtacggactcggccaatgggggacagtgccgggtgtcctggatgagggtttgtcgtcctagggatctcggtggactgggcattccggatctcagggtggctggctttgccttgagagttcgctggctctggcttcagcgctcgggacacccctactggtctgatctgaaggcccctgttgagcggagcgtctccgacatgttcgcagcatccaccttctctatcctgggagatggtcagtccacgctcttctggactgatcggtggatcgatggtcgctcaatagcttctatagctcctgacctcctccacgtcgtgcctccacgcttccggggatcgcgcacagttgctgctgggttagcgaacaactcctgggttggtgacatacgtggcgccctcactgtcccggtcatctctcagttcctgttagtctgggacgcggtggttcctacccagctctcgccgggtattgaggatcacctcgtctggcgttggacgggtgaccagtgctactcagcgcgatcggagtatcaggcgttcttccttggccagcactcttttgcctatgccgacttactctggcacgcgaagggccctgctaaatgcaagttcttcctttggtttgcatttcagcagcgctgctggactgccgatcttctccaaaagcgtggtatcgatagccactctgcttgccccttttgcgctcaggagcttgagacagcgaaccacatcctcatcgattgcgtgttcgctcggcaggtctggctccgtgtgttgtcccctcctcgctgggctgccctctctccccctcgtggcagctggctccaggattggtggtcatcctccagggtatgtttacctgagcaccttcgcagcggcttcgactccttggtactcctagtctcctggcagctgtggaaggaacgaaactccagggtttttactctgcgctcgcttcggtcgtagtggttctagagtccatccgctcggagggccagctgtggtctttagccggtgttacttgttttggggatttcttgggagtgtagcgtggctctgccccctcccgctgtttggagttgcgtttttaaccgtcgtagtagttcctagcttcaagtcccccccccccttttaggcataagccagtctagttgattgctttgtgtaacaaaaactctttttctgctaatatattgacgtgcaatccttttgcaagttcgaaaaaaaaaggtttgctactaaaatataatcaaattgagatactacagtgaagttgtagattgctaccaaatttaatatgggtatcataaaaattaagttggcttcattaatccaaataaatagtgggtactatttagtatttaggctatcaatataaattttggtagcaatccaaaactaccctagttcccacgaagagctaagacaaacgtacgttgatttggatgcaaaatgcgtacatagaaattcagcattttgcgtctccgtgcaaaatgcatacatagaagcaccaaaggccgaggatcacacacgcaaacacatattagagcaaaggataatagaggagcctgctatcggcacaaggataaagatgagcatgttagggcttccacaatattgttgtatgcaaagtaatgttaagaaataaagtactccctccgtttcacaatgtaagtcattctagcatttcc

SEQ ID NO: 1016 - DNA, 1380 bp, Oryza sativa
  unsure (1)..(1380): unsure at all n locations
nnnnnnnnnnnnnnnnnnnnnnnnnnnnnnnnnnnnnnnnnnnnnnnnnnnnnnnnnnnnaggaagtagtatttttgttctacctttatgcactgtgagaagagaaagcaagaaatattgcttaaggctaaaccataagaaataaaaaattagtttatatcttttacaacatgcatgatactctttcatttatattgaatagagtttttccatgaatggttcccagcttaacatcaaaaagatgcagcatgtgttatatacacaaatgaacataagggtgtgtgtctcatcttggaccatatctaggcgctcgtgccaaagcgatgacggtttccttctcacatctgctttctctcttccacgttagatcgagacaacatatacgggctaatcgtttgcttattagacttgctcttaaaagttgtattctaagtccccaacttatatatatctgcctcgtttttcacacgcatgtttcctaaactgttaaacgatacgttttattaaaaagtttttatagaaaagttgctttaaaagattatatcaaaatattgcatgatccaaataaatcattagcaggcgccccacatgtattgcatatactcgaatttgccatgtttagtcaagctcggacttcagcaagcctcgtgcaaagaccctgatttttttggtacctttaacttccgcagtctttcattctctcttcattaagtccactttagagctgcctggtctatcatttagccaatactctctactcctttttatgtgcaccgacattctataaagcagagagcactgaaaaaactccatttctttcatgaaactaagcccgagtatcttgttgtttgacaaaactcagagaaatctacaaactagcctctttatcccaactacaaaataatgaatctaacatctcagtattccaagtcatcgacattttattaactagtcaatactccacactttgttacgagatatgtggatgaatgcatgttatacattatagaaatgatatatgtgtatatttaaataatatgaaaacgatatgaagataatgattggacattgtttacatatctattacaagtccattaaacttcctataaacgctctcaagctgtcacgtggtttcttacaaacgctcataaagctccatatggcgttctaataaattagtaaaaatcacaaataaatcaaataaatatctaatcattgatttttctttaaatcggtggattcattagttttaaccattagatctccatctaaaaggaaaatgaaaaaaagtggtacccacctccactgccgaacgtatgtacatccgtgctccttcccaccctccgatccttctttcatctctctcctatttttagctaa

SEQ ID NO: 1017 - DNA, 6347 bp, Oryza sativa
  unsure (1)..(6347): unsure at all n locations
nnnnnnnnnnnnnnnnnnnnnnnnnnnnnnnnnnnnnnnnnnnnnnnnnnnnnnntagttttaaccattagatctccatctaaaaggaaaatgaaaaaaagtggtacccacctccactgccgtacgtatgtacatccgtgctccctcccaccctccgatcctcctttcatctcctctcctatttttagctaacttatcatattttctaactaacactcaatatattaaaaaataattcggaaatgtaaataatcataactctcaagttacatttattttgttatttaaaaattagatcatgcgaccgttctaactacaaatgtctaggtctgatggtacctataagcgctcttaagtcatcacaatgaactctaataaattaaaaaattctataaatatgagtgataaaataaaacatttaaccatcgattttcacttaaatcgatggaccttatatggttagatctatctttaagaaaaatcgcaaaccaaccttcttccctcccccgtaccacccatccttccgttcctctctccctgcccttccttctttgtttttttcactccacaacaacctctctccatgacctttcttctttgtttttttcactctacaacaactaaaataaaaattatctttacgggcaaataaactcacaaatggacctatacctaacacatctagcgggctctccctctattacgtgattttcctctctttctcctctacctatagcacggctctccctctatcacgtgattttcttctctttctcctctagctgcactgtagaaacaacacaaattagactttaaaataatcataattctttaaatcatatatacaatttatgacatgtataaactactgtaaattttaattaaatcaataatttaacatgcgtattaacttacattgtggaacatatccaccttcaggcctccactaaataaataaaatactaaaatttctcactaaaaattaaaatatcccaccttttttaaataaactggtcaacctattatttataccctactagacatctaatgactttctaccaactctttccatttcagattataagtcattttaaatttggtcaatgtcaaactcttaacttagtttataaaaatacatagtacattttcaacgcaaaacaaacatattataaaaatatattcaattctgaatttaatgaaaactaatttggtgtcgtaaaaaatgatatattttttccgaaacagaggaagcaattaatttctcttaacatgcatataggggctatttacttatacttgatcttagatgtgcttttgtgaataaattatcttttaggagataaataaatgttcctaagatgatcatagcatataaattatacataagatatatggtgtcactaatagattagagaaaaagcttttgattatatattttttagtcgtaacgtgtaccctgtgtagggtctatttgtcatatatatagataacagattgaaaataaccaacatcgtgcgttgaacatcatacaagatcgtagcaaacacatgggttgtgccaattatagcagtgaaacagccatatatatcaaatcaattatatatagaaattaaagaccatgtatatttgcatatttatttatttggtaaaacttgctacactgcattgtaaatctagaaacactccagtttagtggtagtttagttaaaaaacattatgactgttattttaatatttcatacttaattggagagagaaatgttgaaaggatgccattaccccatgccaagttgtatgaccttaacccacttatattttcattccaaattgcagagatcaaaacatttaaagaatgcttgacggaatgaaaatctagaaaagaaatttaaaaaaacatgaaataaaattgaaaactgaacatttattttttctaaatctaacttttttttgggaatttgaaacacattctaaatagcaaagttcaaacattttagaagtactaatataatgaaaataacaaaaaaaatcctaatgaaatctaacagaaaaattgacttttgggggcattaatttggaaataaaatctaacatactttcaattcgaattatgcaaccctaaactataacttgggagcgataaaagtatccttttctaatatattctctgtttgagaaaaaacatttacttctaaactttagttttctactgcaatactatattactacaatcaataaatcaacagttcaacatatccacgtcatttaattagatgatgtggtcgtattagccatatttttaatagaaaatattttcaattaatatatcctaaaatccagaaagacatatatagtatacaagacaaatgttactcacagtttagaactaaatattaaaaaagaaatgcattgtgtacaactccatcgtgacacaatattttcttataaatttaaaactaaaacagttttaagtaatttagtttagaattcatacgccacattggtaattaaaaaaaatactagcactcaaagaaacccaaaaaattattggaaaaacatgtttacaatagagtaatcataaacattcgtaataaaatttcaaacacattaaataagatgcacgcataagtgtgcgggctaccttcctagttgagttctaaaaatacaacaaaaatacaaaagatatgtcatatttgcatgatatataaaataatatagataataattatattgctagtgggtgatgatgcgataaacttgcatgtgatttaaaatactttagataataattgctagtgggtgatgatgtaatacacttaggggctgttcactttgacgccattttcaaccataccgtttttttttggcaaagttgccaaaagaaatcctaccaaaatttgataatattgtcaacatttatttacaaaatttgataaggtttattttgacatcaaaagtgaacagccccttactttaagtgaattaagtgggtgatgatgtgacacatctactttaagtggagttgtgtattataataatgtagtatacttctctatgtatgtatggtgactcagagaagattaattaattgatggcatgcatgctgactgcagcttcaatattcttatgaaacggttgagattcgttatgaaggcagcagtgacttcttcacctcggcctggtcaaatgcgatgggcttgttgaagagcccgaggggaacggtgatccgtattgaggttcttgtggtgttggctgcttgtatgcttatattcctcgccgtgtttgggtttctccgacggcgatgcacaaatcccttgttccagacggctgtcatgggctcctatgtcctgtcctcctccctggtaacatacacgcttggttcaatgcagtcttctgctgccaagagtggcatgtaccccatttgggccttgtcactctttatcctttctgggtgcgccgattcagtcacggcatatagcctcgaagacaacaatcagatacagagacagacatacaatgcttgcctctaccatgcttacgtcctcctgatatctgcgaccatcatcacgcaaggtgccggcgcaggactacttattcatccacaggattattgcatctcagctggcaagcgtgtcgtggaacctgaacaagatggttgccgattacatgcatgaggagcacgccaatcatccaatacgggagtacgacgcaggcagcatgaagggttaccgttacctagtctactggcgattggacaagacgtccaagattgaagctgcgacatcatatgcagcacgcgtaacaacaacagatgatgatgcccagatcatttgcatcgacgacatatggctccgcagcgacaagtcactgagcacggacctgaaggatgcctgtctctccttctctctattccatttgttgcggaggcgcttctttgggttcacatgtgctgaatctgcacaccccaagactagtgatttcgtcttcaagggcctgctgcagttgaagaatggcagcacaggcactgtagactacatcagagctttcaaggtcatcgaggttgagttggcttttatgtatgacttcttcttcacaaagtatgctctcatctactacagttcaacctctgctgcagtttggtcattggtttcagctgccttcacagttttaactgcatattccacaaccaaactccattggcttcagggtggatccactgttgtggttcagggtggacccactgttgtgggcgacaacaaagctgacatttttatcaccatgctcctgcttgtatctattgctttgctagagctgcttcagccactgctttactggaccaccatttggggcagagtatcttttgtttgtcagtatatcagacaacaacagccattgcggcatggcttcagctgctgcatgatgagagttaaggagcttctcaccaagatcggtctgcgtgtgtcgtcaaatgggagctactggcaggacatgcttgggcaatactcgttgcttgcatcagtcagccgcaataaaccgattaagcagctggggagaaaacgtagtagatttattaagtgtatgaatcttttggactacagggcacttaatttttatccagcgattgcctccttcaagaagaagaaccctgtagacaaacctatcaagttgtccccacaagtgaaggaggcagttgccaagtccctgctgcaacatgctgctgctggtcatggtaatctgacgaacggagtgtcatcattgaagtccaatggagctcatcacctcttatgggcttgtgacccagacccagctgcacgcatcttgcagaatcagacgccctctattttgatatggcacatcgcgacatgctgctgcgagaagaaaccgcccaactaccagcatgaagaagagctgaaaaatttccaggtcgccactgcgctgtccagatactgtgcgtaccacagcttcttcctgggcaccactatgacacagcgtgtgtgctgcatgcggtcggagaggaatccgtgcagtttcttcgtgaacgtggaaaaaaggagttcgacgccatggccctgcaaggctatgagccaccaccggagggcgagccaactaagggcatattcgagagtggcttgaagctggggaagcagctggaggagatgccagagaagatgcgttggaaggtcctggccgacttctggcctgagatgttgctctacatctcgccgtcagacaatgtcaaagagcacatccagcggctcgccaagggaggcgagttcatcacccatctctgggctttgctctcgcacgccggcatccttgagcgtccgaagcaggagcatcaccccggaagcagcgtatgaccgagtaatataattaccactccctgctctgcatatgtatcgctccctccgtttcgtattataaatcgttctgacttttctcttaatcaaacttaattttttaagttaatttgaccaattttaacaatattttcagcacaaaacaaacatattatcaaaaattttggtgttttggattgctatttttttttactaatttgatgaaacttaaaggtgttttggatgttgctaatttttttttacatattcgatgaaacttaaagaaatttgattaagaaaaaagtcaaaatgatttataatatgagaggttatcaaacggagggagtaaattgcatctcttgtcaccttcttgcttggaccattgcatatatgtatatatgctgatgttccatcgccatgcattctggaatattttctgcatacctgtgttggcttgttccggtggtatatttgtttgtgcttcaatgtttatttacctcttatgacgttcaatgtttcatatataatatattgtgtgaataatcaaagaaaagggtcaatatcaggatactggtatcattggtatctatagatcatatatcatgaatatatgtctttgattcagtatttatttacgccacgtccatgtttatatatatctctgtatgtaaatgtgaactccatgaatgtttcctggattaatttcgtataccattggtttgcctgtaatataatgtgctggatattgtgtcatgccttcattggattgtttttgcatgcaaggtgtgtttagttcacaccaaaattggaagtttggttgaaattggaatgatgtgacggaaaagttggaaagttttgatgtgatggaaaagttggaagtttgaagaaaaagtttggaactaaactaggccgcagtttcataacaagaagggcttttctttgtaatataagttctaatttgtttgtggaccttgctttgccaagctggcatcccagagaggagtgatgtga

SEQ ID NO: 1018 - DNA, 2280 bp, Oryza sativa
  unsure (1)..(2280): unsure at all n locations
nnnnnnnnnnnnnnnnnnnnnnnnnnnnnnnnnnnnnnnnnnnnnnnnnnnnnnntttttttggtgtgttttgaagaaagcttttcagcttcagtctatacctagagatctttgagagtgtatcaatcttgtcaagggaaagggagtttccataatttgggtttttctttctgcttgtctctgttgggctttatggatgactagaaatgattgggttttcaatgatgtcctggtgaaattacctttgcaagttgtttacagagctttgtctttttcgcagaagtggagcgtgttgctaaaagaggaagaacgcacaattctaacagagtggcgtgatgctgtgctggacaagctaaagcaagtgaaggctcaaaatctacctaactcaatctagctttgctgtcatctggttttgataggcgtctcttagttcttagactggttttgctggctgattgctttacagcagcttttggtcctgatcttgtaagctggtcggccccagcatttgcttatgtgtgcctgttgtttttgcgtttcagtataatactcagtatgtttaactttggctttctccccaaagccgggtcaatgcaattgatatgttctaaaaaaaatatctgtcagaagtttaatgccaaaatgtctcctttttttttctttggactcatgtatattcttatcagttattttggtcgttggccgtacatcagtcatcttccttgtaaacccaataactctaaagtctgaaagcaccttgcaaactgtcatccaacctcagctacatttagttaaagatcagtatggatactctgaactagaaacgcttttagccctctttaggtcgctcagctgaatcatttgcccttgtaggctactgtacttcacctgtttcaacaagattattggaagaaatgagttttcctacagagcatatacatatcagaactgaatcaaatcaagctatattatgtcctacttacgtgcatcagtgctagtgtggacagcaactctctgcactgcgccattagaacctgttcttgtctggtaattatggacagctgagacaccaacacatttgtcctggctagctacagaaagaagcagatgacttcaggataactcacataattaaggtgtagagtagtttataatgttcacttttacatatcatcacttcagtagatctcaatgccattatgtagatttgatttgtgctttcaagggtaaaaggaaacacatgaatgattcggagagaacggcaccttaggcagtagataactcattgagtttctcattgtctgcatgacatcaactgcagagccaacagcatttttgacagactgaaaatctgcctgcaaagtatgagattgcaatgccaaacatcagatataatcaaacttgtatgaaacatggaggaaataggatcagtgttttgtcaggtttcaaaccactgctccatcagagacaggaaggcgaagaacggtagcattcagagcttccactgttcctgacagcgaattagcatacttgttctccagtaaggaccactcttccagatatgccatctgtatagtcagtgtaatgcttaattatcagaatttcatttgagttccattcataatggctgatctatctaatgatctgggacaaatcatgacctttcacttagtctgcctagtacacgtgtacagcttcattagtccatatattaggtgtaactactgttgaaatcaagtgataaagagatgattattttcagctttacaactaggcttaaccacaaaccatgtgcttaccatttggacaggcaagtaaatctgcatgtaaatggcacggagcaactactcacagtcctgtaactacctgaaagaaaagtgttctggtgcagactgctgagactaccagactactaccgatattgttcaaatctcaaaaaatgcattttcttagagaaaaacatgacgaatcacaatagatgaattccactgaaacataaaacagagggtgaaaattttgccaaatagatgaattccactgaaacataaaacagagggtgaaaaatttgccaaaatagcagaattcttacttggcccttcagagtattcatgactttacaattttgtctcagtaactgtagctccaacttcttgagcgcaatcgatttgctcatcccgaggatactaacccatgcaccacacaattgtttctgcaatgaagaaaggnnnnnnnnnnnnnnnnnnnnnnnnnnnnnnnnnnnnnnnnnnnnnnnnnnnnnnn

SEQ ID NO: 1019 - DNA, 725 bp, Oryza sativa
  unsure (1)..(725): unsure at all n locations
attgttgaactagatattcagaaggactagataagaatattggtaagggtttattgcaaagattattatacttaacttacaaagctcgcattcctcgcaacagtaaaatcataatcacaagccgatcagacaagattgcgaggttaggaaccacaccacctctcagattacagctccttccaaaagaagcttactggtacttcttcaaggtgtgcacatttgggagcatggatgcttcagagcatcctgaaattgcatccgtagccatggagctagcaatggagtctgaaaggagcttcatggttgccaatgtctttggtagattactgaggtcgaataccaacacgctttactggagattggttcttgcatccctaagagagttcaagaagaagattcgagttgttctgttaggaggtgctgatcagcctcaaggaagatttgatgcacttggatggaaatcccagatagcacctaactatagctacacgtatagctgtgagatacagaggccaatgtgtattgttagtagataaaccttgtgtgtttgcattttaatttctgttatgcatgcgcgcgagctccggtttgtggaagccgtgcgaatagctgtcatgccgcgagaatagctcggcgtggcgctagcaacggggagtgcgcgcgtactgcgnnnnnnnnnnnnnnnnnnnnnnnnnnnnnnnnnnnnnnnnnnnnnnnnnnnnnnn

SEQ ID NO: 1020 - DNA, 432 bp, Oryza sativa
cctttgaagatatcagctgccaccaatatatctcctatttgtagaccatgtaaaccttcaagcactgtgatacacttgttgatgctgtaaggatcctccaatttcttctcctcaattgcagcaaatcgatctatttcttcttttttaagttttaggtatctctcatgaaatccatcatcaggactaacagatttgatcttttgtttcttcccaggtcgagattcaggaacctctgaaggtgtttgtgccgagctaggtgggacttttgtgagatggacaggggtaggtgaatgctgtgaaaagtccaaattggctgtctcaacctcttcaccaaaaggaaattgcaaacctgattcacctggagcatttgaattaggggatggtgactgatatgtatcaaccgcatttgcttcttgtgttgaatgagctggg

SEQ ID NO: 1021 - DNA, 592 bp, Oryza sativa
  unsure (1)..(592): unsure at all n locations
nnnnnnnnnnnnnnnnnnnnnnnnnnnnnnnnnnnnnnnnnnnnnnnnnnnnnnnctccgtccactgcgcgcagcccgatcactttctcatcgtcttcgctaactccggtgacatggacctcgcgctctcgcgttccccgatcccggctcccccctaccagctgattctacgaccatggacccggcttgtgatggctacctccttctccatgccgttcagggtgtcgctggacctcgagggtgtaccggcacacgcctggaacgcgtncacggcggcggccctcgtcgctcccggtcgtctcatctctgtggacaccccggcgcgccccgacgagtaccggtttcttcgagtcaccatctcgtcgcacaacccgggcgccattcccaaggctcgtcttcttctcattcccgagccgacgttgggcttccagtgccttcttcggtatcgggtccttctccacgtgctctcggtggtctgcctctcggcccccttggcgtctggcgatgtcgacccggccggtggcggtggtgctagcggtgaaggtggtggcgctgcgaacgattgtggtggcgctgcaaacgatggtggtgg

SEQ ID NO: 1022 - DNA, 12307 bp, Oryza sativa
ggtagcgcgaggcgacgactgccctgggcttcgccgtggcggcggcgcggcggcgcgacgtgctcggccgagacgccacggcggcgccgccatcgaccaccattgatcttgaattcttgattccaagaacacaaaaaaaaagatagtggtttatggatcgaacagaagaacagtagcagctactgcatcatcaaccgatcgatcgatcaatcgctagtgctgctgctagttattatggatcgatgattaatagtagtacgtgcagggttgtgatctgtgggtgtacgttcatattctccaacatgtggtgtgtgccgtacgtacttgcgagcgttagattttggtactgaatttttgtatctttttttttggttgattcgattttgccgtgattacgtacgatcaacgtatacagtatatggtactcgatcaatcgattgttatttacatgatctcgtactgtgatattttagattgcattcttgatctgagattatttgtacattcctggtataggagtatcttggattctatgcttttctgatttattgctagaaggaaatcatgtactactagtctactacaagtcctcttgcttaatgggcctgacgtgttcgaccattgtattgggccttgttaaaattttacactttaggaggccttgttgaaagaaactgaaatactagagggcgatatataccattgaaacaattttgctatatatctgtcgaaaaattttctcctaaaaatttgacagatgtaattactgtacgatcgtagtgtaactatactataacttgcatgcaactacaatgtaactttcacataattttgaactgttagatatgttttaagatttgtgtaagtaaagaaggaaaaacgtcaccgagtgcacatatatgagaggatttgttcccacgactgccgtttcaccgaaatagcatgttacggagagatttttgaaagttaaatacaagttacatgtaagttacagtataattacataacaattgtactataattatatctgttaaatttttaggagaaaatttgtcgacaaatgtataggtgatcccgtcctctattgtccaacggtatactattccttaatcttcatgcaaaattgcaaaccaccctaattttaagatttcatcctatgtcccgatttgttggaaaatcccatctaccaaacacatgtgagtactagattcggctcatttctttcaacgtggattcacagagggtcattatcatggtttatccaacgtggctatgaggtgagtctgactcgagcttgttcccaggttagtttgaagtggcaaggtaactgtgaacgatgagaggggtaagcatggaggcgatcatctgtggtgatcggtagtgaatccacatttaaagaaatggaccgaatcaactatttatgtgtacggaggtaacaatttcagcctagcagccttagatggatgtgcttttgtaacaaaataggttataaggtaaaatatcgaaactagattaacaattggagtggtctatgcaattttgccagaaagaaaagatatttcagggttcttaagcacggattacttgtgttgtttcttgacagattgatcatggtggaatcaaaaggagttcctaatcctaatggctaatggcatcatctatatgaaatgatccatcagtcacatgtatgcctgcctcgctgcctacggcacacggcgcctctccgtgacacacgcatcaaacttgtagctgaaaccatcagttcagaattgcttctccatgcttctcctaatctcttaatgttaacctcaattaatccaggaaatatcatccattcagtctggttttcatgccgtctttttcatgctagtatgtgcttatattcgttcccgttgacattaatgcattgtagtatttaacacagatgatcacatcaaagatagcatcacactctttttgtttctctgttttgctgtctgtctgttactctgttatatgcaggctgatattcctttaatttttctgtttgcttaatatgttcgtttgtgtcggcaagcaatttggtcgtatttgatctttggcagatgtgctgttctctagtgcaaaataatcatagtatataaactgcaaaattaacaccttaaacaatctgggtgtactagtatttctgtgtgtgtttgtcagagctgcaggttatcagtgatcacacgtcaaattgatcaactctgataatcagaatcagatcactgtacaggactaaaaatcatgagaatattacaaacacaaaccaagtatacacagattatcgtgtgtctctatcttgccttcttccctgttgaattctgtatggtcggcattcaactaccagtatatttgaatgtgtgatgtgacgttgatgaattttctacaaattaagaaaaaccaaaatgaatgtgctctagagtattccatgaatatcaaataacggtggttgttagcaagcctgccagtttgcacatctctcttatcctgcgttatcagagatataaataataaaattcgtccaaatcagacgtcgaattaatatattattttcccaattttctattcttcaaaaaagaagtaatttgcttgtaatcatcccatgtaatttggagaaacacaaagagaacaatacacgacaaaattaggataggaacaaaattggttttgtacattgagcataatcctagtagtaatgtacatgaatcagaagcagagcagcttatgtgtacatacaactcatgaatacatacacgcaaacgcaaatagcacatctttgctctactacctacttccccgttttgaacacgagaattttatcctttttccaagtgaattgaactgattttccatgaaaatcatccaaattcctccgttttgaaggctgcctctcgaatgttataatccaagaaggcaaaaggaatcaaagggctcctttcgactctgaatcggatgaacatttctcagaaggcgcagcagcagcaggagacaaggcggctccacgcggcggtggcggcggggcgacgcctcttcctgccggcggcggcggcggcggcgtggcgcggcggcgcggcggcgtccatggagctgagcatctcccacatgacgtgcacgtcgctgtactcgcacgtccgcacctcattccgcagcttccccaggcctgcaatcacgcacacgataccgatcagtctcgtcgtcgtcggcggcggcggcggcggcgaccaaatcaatccaagaagcacggcggcggcggtggactttgactagctacttaccggtggttcgccggaggccgaggcgggcggagaggccgagccagacacgcttcaccggcaccgccgcccggccaagcaggcacgacatgatcgtcggccgtacgtagcttcgattgcactccactctctgctctcctctcctttcgccggcgatgtctctcgtctctcgttctctttctctcttggagctcgtgaagcttagcttgatttataggcgaagtgggggtgggagaggatgtggacgcggcggaggaagaggagcgcgcacgtggatggaaggaggtctcgatccgtcgacgtcgcgttgtcttctacctcgcgccttcacttccttcccgccgcgcacggtcacctccgacggccagggttattcgtgcactcataccggcgaaaatatttagtgccaacttgaaaactacaccgtcggatcgaagagatttgttcacgttatcctgactaaattttttattcccagatttaatcagagtaaaagttttactggagtaaaaattttattcagtgtgacgtggacaaatctcggacgtctatttttttttaatatgatggtgtttggttttttttactacatattttccgcctgataccataacaattttctcacccttgatttgaaattctttttgaaacatggtcatacacacggcacacacacccacccttacgaacacacgtctggacgtattttgagattcattaagtcattactggtaggcacgtcgtctatcactaaaaaaattaataattagctataaatgggagctctttactgagtttgggaataaaacccatggtgggcagttgatctttatttgatttccatatggggtgctctttatttagtttgttttttcgttgttgttcattggatgagaaaatatactcacaacttctattctctcgtcttcccgcgtaagcttttctggacttctcaacggcatattgttttttcaaatattttctattggcaagttgtttttttaaaaaaaatcatattaattcaattttaagttctttttaacaaatacttaattaattatgcaataatctccggctctgttttacgtgtcgaggaagaagggttcccaaccttcccaaaataacactaccaagaaggaaatatatttttgtcagaaaaaaattgtttgaaatcataaattcaaaaccaattttgttttgtattctataatcttaataggcagtggcttaaaatagaacactactctaaaattatacgtttagcaatgttcgaaatgcgaaatagacatggacgatggaaaaatgggtgatggagccagataatttgaaatgtcgttttttgtgacaaacaaaaaaaatgtgttcgtacaagtatctgtctaaactctcaaatcccagttgttatgccaaattaaataaacactcccgatgtggacctcttaatataaagaataaaaacaaagcacaacgcgacgtcgactttcttataccgaataaaaaatgtttcttgaaaaaaaagagacggctggagtaaaatcttttagcagtagctctcgcatatattactgtcacaaattaattcatcctagagatgaaaaccaaaattaataaataaatatcctattggcctggcccaaatgataagatatttaccagttaccatcaggtcatcatctaaaaaagttaccatcaggtttcccttgcatatatagaattgccaacttgttcatgatcagttggtgtcaaatccgtgttagaattaacagtccatctcttcttctgtctcctgctgtcatacacatctgacgaagtagtagtaacagtgagtagtattgagccattttaattaatcagctaaaatattcagctaacagccgccttagcagcaggattagtgcctgattaagcttatctattcctgagctcctaacacgaggcagcacatttcacatttccatttcttcccttgtaaagattcctatattaaattagattggttgatgatcttccttgtcatcttgcaagagcattattgtgggccaaaatcttgatgattgatcacaatctgcatgaccatacacggagaacttgggcaacatgtgctcaaatgaaatactactacatggtattttcctcttcctctcgtgtaacacatgctcatttttctccatccataatcatgttcatataactgcaaaaatatggtcatctgatattttcagaaatcagcataccagcctttatatgtaactgtaaattcagagttcagacatttacttggtagtaactgcaatttacagagttgtggatagcactgtcattcattcgttcaggaattgatgcggaaactaacaggacatgaaggttcagacgtaacagtcagaatcctgagacgcccaattgcagttgcagctttgtcagacaagaacaattctctattccaatttcttggaatggaatgaattttcaggcgtgagtgcgtgtgcaccgttaattagtggaattcgatttggccatcacatctctttctctttcagggtcgcagtcaccagtgtgtacaagccaagttattttttattatttattttgcaaaaaagaatgtaccaatatgccaactttagttttgtctgttgctaatctgatacatacgtgcatgcactgcgacatggtttgattggcattgacatcaccaggttacacagttggatccatctcagaggaaaggaaggaaagcataatcaagttaaatttttttatttaatttgaaggataacacgagattaagttgtgtttctatttgtgttggcttgagaaacagtcgtgcttcattagctagacctgatctcattcattgcctgaaaaatatttcagtcactcgcacccacactgaaagtctgaaactgaaattttcagagttagctgtgtcaattttcaatcttctttttgcatttaagtttactacagaaagtttactcaatgtgtgtgatgctccaatactaagtcactggatcatcacatccaactctctaaattaggctctttgatgggccaatggatgattacactgacacactcacaccccactctgaattctgaagcctgaactttttcaccatatatatataaataagaaagttccaagagctcttatgatccactaatcttggcactttaagtgccaaggaaaagcacattaggccagttttggggggcctgcttagagattgacacttggagcaaacgagtggctcctctttcagattcggtgtagattattgatgatgatcttcatcttttgcccaaccaaagcttgcaattgttggggtggccactagaacaaaaaaaaaaaagagaaacaacaaaaggagattttttttttcagattatcatccaaagaatagcaaagcagtgcatgcgcaaatgcaactatcagagaatggagattggcattccttttgttgttttgggttcctttctaaattctgatgatggtgtatggatgtcatgttaggatataaaactttacttttgtggcatgaaagaaacataagcctaaatgtgcactcaactatatttgcttctcttggactaaggacccccatcgtttcgtttatcctctgcttattcataccgcttattagaaaaaagaaggtataagtaaaacttttatatacttatccttagtgatacaaaagtaaatgttgtaaaataaaccccaattaaaaaaaatacaaaatcaacttcaaaattaggttttgaaattaaaattttggtttattagcataatgggaccattagtacttgatttattcattccatttgtgcagcataccacaatgatcttttcctgcaataatacgggtcgtttcttatgttttacatcctccatttcataatgtaagtcattctagcatttctcattatctagattcattaacaccaatataaacgtgagaaatgctataatgacttacattgtgaaacggagggagtagtattcagttttggtcttctgaccatgcagatcgcagaggctgtttgctctgcacgactagccacttgagcttgacagctgacaacaaaagcgcgttgattttattttattttactttggtcgtcgttagattgcgttcttgttgcataataaaacgacaaaaacagtcttctctcagttcactgaatttgcagtttttacactgaaattatcgcctcagtttagtcagttatcaatcgatcgcagacaccaacacgaacactgaattttccccctattttccaatcttgcaatgccttctctcttgggcccaaagcccagttactgcttacacagcacaggcccacccaagtaatttgggctcaactcccttcccctcttgagcccaaggaccatccggcccaagccccaaaacccaacccaaccagggcgacgactgctaactcctcacctccgctgcccgaccatggccgtacctccggtcctccgccggcggcgacgggctccaattacgccggtgcagaacgccggcaccgccgccgccaacagcttgcgtgcgtgtcccgcgatcgataaagcctcctcttttctcattcgggtgccgccctgcactgtaagtacatggagagagagagagagtgggacaacgcgcggccgcacgccaactgctcggcgaaatgcccaggccaccgcgccgcgggcagcgcacggtatggacacaggtatgttacgtatgctcataaaatgtctgggatccaaaaactggtcacttggcattggcacccacctgtttgcacaaactgcactatatgcacattcacaagctatgtgttgccgaattcttcctttattcatagtattgttgaagtgatttcagcgagtgccctctgttaggctaactactttgtttatcgtcatttattaatttattattattattagctaaaagagcataccttggaaattttgcatgatcgtctaccagtatcttataacctagcacaaaatgctcaacagtaagcaggaaaacatgatggaattatgtatgccatgaaagaacctcatgattgcatataaagggaatatgtataagcagaattagacaacatcttcctccttatttagatgaacaaacaacactcacggctaaacacgtactagtatcttgttgagatcttcctctcacctaggttaatacacaactatgcccgttgtgttcttttgccaaggcattggacgttgccgccttcaaagtaccatttacttattcttcagctgcttctcttgccaagcttgaccaacttacaaccaagaatacgtaaactctatcatacagcttgtcaaagagccggaaataagcaatcctccatatcttgttgaacagcaggacacaaaataccacccagatccccaccacaagtcctataccgaaaccaaaataaaatgtcatcggtttgaattcttgcttgctgctgtggatgaatgtataatttcttgaacagttcttttgaagaggaggtccacaaagtccttcatttccaatatacattagtgatggatcatttgcactgagggtgtcaagttggcggcctgagggtatcattccagataaattgttgtaggacaaattcaagtagcttaggaatgccaaacttgataagctcgatgggattccaccagaaagtttgttcttagagaggtcaagagattccaatgactgcagggtaccaatcttgttgggaatttctccactcaactggtttgaagataaatttaaatttattaatgcatcaagagaagtgatatttggtggaatttcacctgtcaatgagtttgttgataaatcaatgcccacaaaatattgaagtcccccgccatatggaagttgtttcccttttgtagatattaataatatttctccgaattgaccacttacttcgactgtgaccaaaccagaactcatactagcaccagaaaaaggctggaagcctttcattgtcatgcctgtaaggttagatagatgccacggtatagcaccagatatgttgttatctgataggtccaagtactggagagacaaaagatttgtaattccagctggaatgctcccagaaaatgtattatgacttagtcgtagaatttgtaaatctctaaagtctcctatccacgcaggtaagctcccaaagaacttattccatgcaagatccaaaaactgcaggcctgtgcagttctgcaaaaaagccgggaattttcctgataacgtattgttgcttagcaggagaaaattgtagctgatctcagaacattgtgggatttcacccaccagaaggttgcctgacaaatctatatctcccaacagttgcaattcgcaaatagattgcggaatgttgccaccaattcggtttgaatacatgagtaatgtttgaagctctggagcttcaagatgtggcggcagtgttcctgagaatgaattgttggagatgtcttaacacattgatttttcttggaaaaggaggtattggtccagtgaattggtttgaactgaggtaaagttgttcaaaagccatgtcacctagatgcgctggtaagctaccacttatttgattttgcgacatgtccagatatgtggcctgggaaaatgttgaccaaaaccaatcaggaatcttgcccattagacctgtgcttgaaatatcaaattcgatgattttgtgctgccactgaagccaagatggaaacagaggcccaatttgacaagatgcaagccatgcagactccagcctgaagggtggaagccaatctgaatccattgaaaacttcaaataattggaagacaggtctatgttcttcaagcttatcagacctgcaaagtgttcttccctgataacaccactgaaagtgttattgcgtaggaccaaagaagtcagattagtaagcacaccaatctcagcaggtatgcttccacttaggcgattgctggagaggtcaaggctggctaagcttaacaaatgcataacctctgttggtagatgtccagaaatatcattataagagagatcaaggctaactaaagacgtcaagtctccaatccctggtgatatacttccaataaggttgttagaggagatgtcaagcatgcgcaagctcgtgaatcttcgtatcgaatttggcaaggctccagtgaaattgttgtaactcaaatgcaactccagtaattttttccttgcagcacactgtgacgacaaaccgtcaatcaacattgtcatatctccagttatctccatgttggtgagatctagtatttccaaactgcatagattgttcagctctcctgccatcactagtccttgttcagattgttgtatgaaacatcaaggacttggagagatgtcatgcttcctagttgttgtggaaattttccaaccaacccattgtaggatagatcaagcatctcaagttttgtgagattgagatgacaagtgactggtttgcattttatatagtagcggtaaattatgaagtttactacattgtttagcaaattataattaacatgagcatccttttagactaaaattgataacaacaattaacccacacatttaattaacatgtgattaaaattttaatattcacaataacaaatatataataatgtcccgtgcaatttgatcacggctgattatcagttaataaagttctactagcacataaaaatgccatattcaatgaaaaaggggaaggtgaaaagtataaaaaaaaaatttcatttactcccaaaaaaaatgtcaccagtgatcttaattctatttattaaataaagacgcatgtaggaggaaatacatcaatataaaatgtacgcatacagatcacgtcccgcttgttttagtgccatctgatcaatgacactttcacgtacaaccatatgaccttggtacgtggcaacattggcaacgatgtgatgtttcactttctagctgaaaaaaaaaatacacgccattcatatatgttggccagtggccacttagcttcgaccaccaagtggagatgatgttcatcagttcatcactacaccgaggtatcatagcattaaagaactttatgaccaaccattttgattgtagtttacatgcatctatatatggattgaattttgcttatgttttccctttacatttgtgcaaaagaaagcaataatttgaaaactggattaattaagctcagtgtaagaacaaccatgtagatgatcatcagttaataattaattgagcactgcacaattgcgacgaatgttgccttgcgacccggtcttgaccccaacccggcccaacttggtcatagccgtgacgaaggcctggttgaaggcggcgctgctctgggcccaagaatccacgatgggcctggaccgtgggtccgagtacagcacctggtcagagcccagaaggcccatcccgttctgcaggttcttgaagtactggttgtcgaaggcccgcggcgtcaccgggtccatggtcacggcgatccgcgggtccacgttgggtgggcacgacctctgtagctgggctgcgtatcttgggctcatcgttggatccaccgacgacccacggatccgacccaagaatgtgttgcagtgtgcgaaccccaccgtgtgccccgctgcacagtttaacatgacaatgaggtcaaatgtatacatacaaaaaaatacagtaggtttttgaagtagcagtgagtaacaccacactactacaaagcggatttgtactggggtagaatctattttcgcaagcggacgaagcgtccaccatattggctagtgaaaatcgatgaagtgacatctcggttttttattttttattttagtgacagtatgtaaagatatgtgacagctgagtggctcagattgattctacctacttccttcgtaaaaaaaaaggacaacctaggagaggaagaggggatgtgattcctcctaattcaacgaatctggacaggtgacacgtcctcttttagattgcctttt

SEQ ID NO: 1023 - DNA, 1595 bp, Oryza sativa
gaattcgagctcggtacccgacccggtcttgaccccaacccggcccaacttggtcatagccgtgacgaaggcctggttgaaggcggcgctgctctgggcccaagaatccacgatgggcctggaccgtgggtccgagtacagcacctggtcagagcccagaaggcccatcccgttctgcaggttcttgaagtactggttgtcgaaggcccgcggcgtcaccgggtccatggtcacggcgatccgcgggtccacgttgggtgggcacgacctctgtagctgggctgcgtatcttgggctcatcgttggatccaccgacgacccacggatccgacccaagaatgtgttgcagtgtgcgaaccccaccgtgtgccccgctgcacagtttaacatgacaatgaggtcaaatgtatacatacaaaaaaatacagtaggtttttgaagtagcagtgagtaacaccacactactacaaagcggatttgtactggggtagaatctattttcgcaagcggacgaagcgtccaccatattggctagtgaaaatcgatgaagtgacatctcggttttttattttttattttagtgacagtatgtaaagatatgtgacagctgagtggctcagattgattctacctacttccttcgtaaaaaaaaaggacaacctaggagaggaagaggggatgtgattcctcctaattcaacgaatctggacaggtgacacgtcctcttttagattgcctttttttaaaggatggagagagtaggtccaaatcggaatgtcgtgacagggcatgttgctataaaaaaaacagctcatgggcaagcacatagttttgtctcttcatgttgggctgttttccagagatgggcttgggatcgagtgatctcgatggatggaaggatttgtacggttgtttgtacagttgtagcagatggttccaaccacaggcaagcatggttggtaggagttggattgtgtgcaagccagggaatatttacttagctacagagatctggttgcctttatctctctctcagatgcaacaaaagctagcaatatgcatgcatgggagatgtagtaactatgcttaagtaggagataatacttagtacacatgaacaagttgcttttgcaattaattggttgcctaatcattaaagcacaagcaatcagtaattggtagtggctatttctcagagtcactgagtagatatgtactgatatattatcaatatagttgccttcacttggaagaccagaaataattgatataattattttgagaaagtgttttcatttttttagggtatatgtcacctaagtacgtagttttttttaaaaaaataagatagattaacataagttattcactccacaaacatatttgatttctaagagataaaaaaaatagatacataatactagattcagtttaatttattttcgaatttaacctttgttagtatataactcataaatctatatattttcttaattttttcaatgatcatccctcgagaggaatgagaaaaattgaaaaaccatcgtcgaaagattttgattaagtttaattgatgggagctgttcataactaat

SEQ ID NO: 1024 - DNA, 902 bp, Oryza sativa
  unsure (1)..(902): unsure at all n locations
nnnnnnnnnnnnnnnnnnnnnnnnnnnnnnnnnnnnnnnnnnnnnnnnnnnnnnnntggctatttctcagagtcactgagtagatatgtactgatatattatcaatatagttgccttcacttggaagaccagaaataattgatataattattttgagaaagtgttttcatttttttagggtatatgtcacctaagtacgtagttttttttaaaaaaataagatagattaacataagttattcactccacaaacatatttgatttctaagagataaaaaaaatagatacataatactagattcagtttaatttattttcgaatttaacctttgttagtatataactcataaatctatatattttcttaattttttcaatgatcatccctcgagaggaatgagaaaaattgaaaaaccatcgtcgaaagattttgattaagtttaattgatgggagctgttcataactaattaattgcagtaagtgatgaagactagtgtggctgaccggagagggcgatcatgtcggcctgagagaggccgttggcggcgaagagcgccgtgagctggtcgaggttgaacgtcggcggcggcagcctcccgttgacgctgctcgccgtcgatctcagcccgtccagccgcccaagctccaccgcgtacgacggtcctccggcctgcacaccattgattccgatcagatgaagattcgctttctttgcatatgtacccatgccaacacacacacacacatctctcagcaaaattaattagaactttggttaattatgcgacatatatgatgataaatcttgatggtgacgtggcgtgtctcctgttataggttacaagatgttttaattttagtccactctaagtttgtctaattctatagaaaaaagtagggg

SEQ ID NO: 1025 - DNA, 12544 bp, Oryza sativa
ttagaactttggttaattatgcgacatatatgatgataaatcttgatggtgacgtggcgtgtctcctgttctaggatacaagatgttttaattctagtctactctaagtttgtctaattctatagaaaaaagtagtaatatttacaacactagtatagtttcattaaatctataattaaataaaatttcataatatatttgtcttgagttaaaaataatactactactcttttttataaaattagtcaaactcagagttgtttaactttgaacaaagtcaaaccgggagtacacgtaccagcgcgatggcgtctctggtggccatggcgaggatgtcggcgcaagagacgcggtcgcggcatcccggcacggcgtcgacggcggccttggccttgatgacggtgtcgaagccgtcgccggcgagggagaggttgttggggtggtccttctccgccgtgttgttccccgccgacgcgaccaccaccgacgcgtcgcagccgtcgacgaagcagtcgtggaagaagagccgcacggtggcgccgacggtggcgaacgtctcctggaccttcctcgccacagcgccgcggacgatggactccacgttggggcacacgccggcgtagtagttccgccggagctgcgccgcgcacacggtggcgccgcccgccatagcgaccagcaccagcatcgccgccgccgccatccgccgcctcatcaccaccaccatcatgtacgtcttctccgagatcagcttaagcttaagcgaagctaagctatatagtgagctaagctaggtgtgaattaagttaatgtggtgtactggttgcagtggagcacaagtgaagctagctaggtagacgacgatcgatgataatgctctaggcagagtggccggtgatgaagtggataacggcggcgatggtggtggtggtggatttgtataaatcgatcgatcgtgcattggtgccaagtggttggatgaactgtgtgtggccggcgaggaagaagggcatatgcaggtgacgtggtttaatcttggccgttggatgaggcaaccgacggtgcagatggaggccacgtcgtcgtcgttgtcgatatgatgcatggtccccgggcgtaaagggcagagtggtgtatatgtaggtgttgtgatcatcgatccgatccgggcatgacgtgaggttgatatgaaactgaacgagacgggtatgcacaactaactgcaccaacaaatctttcgttgcgtggatatacgtatatcgtttgtgaattaatgtgcccaatgatagcttgatcggcaaaaatgttaatccaaagaaaagggctagctagattatactcacatcgatgtttgatagttagacgatgttgttaatttttagatatatgtatacgcttggtcattcatcttatatagtacataataatttgtggaaatatgaaaattttacaagtcatgtttatcgataaaaggtaattattttgaataaaaagaatgattaaatatatgttcaaaagttgattatgatatctaaaagtacttggcatatactccccgtccctaaatatttaacgtcgttgattttttttaaacatgtttaactgttcgtcttattaaaaaaattaagtaattattttttttcctatcatttgattcattgttaaataaacttttatgtatatatataactttacatattttataaaagtttttaataagacgaatggtcaaatataagcttaaaaaatcaatagtgtcaaattaaatatttagagacgagggagtatgatgcacgtcacaagtgagccatgcaggctgaatcatgatgcagtgcatgaggatatttatgttagttactctttccgtcccatgcttttttatcaaaatcaaactcgatagcccttgactaatgaccatacgtactagctatatctataccatgtattatacatgttatatcagtaattttagattttgatatattttcatttgatgctaatttcatatttattaaaaacatagtcaaagtgtgttattaaagaacgtgttaaaaaggagtaattagcaataattagaccaatgtgaaagtgtgctattaagggcagacctaacccatagtgtccataaacagtgtctatggtaccatgtcaataagacatcacaatagaaactacaatctacaacccatggtttcttaaagtgggccattaataaatacatcatctctcttctctatcaatcatatttattcttcatctattataaagacactattctctcccaatgcaaaacttgatagtgtctagtatataggttctcgtgttgaagctgtcttgcatgagacccagtttcttcctctcttcactctctctcttaattaatatagtgtcacataagttaaaagtcctacatggcaatatagttaatgtcatagacaccattctagatagagggttggaactgccttaaagaacgtgtaaaaaaagagtaattagcaataattagaccaaggtggaggtggtctcaagggaagcatgcactagcttttatggctagcttgtttgcactccatggataggacattaggactccactgctaaaagtatatactactagtattatcttttgatgcctctagctaatggtgctcacccaaaaaacggccacatgacacaactagtggcttgcctagagatagctggacggaaacgagatgtggccgagatgatatgcctatctttgtcgatactatttggaggtggcttctggaaacacctaaaagcaattaattgtacacttatgatttcctatttttgcatatgattttgttttcgtttttttctaagaaagcaataacatgaagaacaatattgtaacaaactctttcataattatgactctcttgtgtgttccatatatataaactgtaataatagtgttcgatcattcattcactaattatttgatataatgcttaattatgtaaatttgcaacctatatataagacataattttattggataattaataaactatatagttatcatattttcttgtaaatggcctagtaactattttttctctattatgtaggcacatgcacacacactacaacacgactacagaatagcttcacgcatgagtacacgtgcaaaatgaagcagcccctaacagtacacgtgcaaggagatggaggccacagcccacacacaggagatatattgttctcatgtatgaatccaccgtcgcttctctcgtcccttcgcctcctctcgttccccttcctctctacagtaacctctccaaaatctctcccttccggcccctcttccccttcgattccgatggttcgccgccggcgagggttggaggaggggtccggccaccttcccctagtagtatttagtcaggtttgtcctgttcgtagctagtctcgtgtcctagagtttgccggtgttgcctcccatggtggcggccggtgtggtggtccttgatggcggtggtggttggagctggtggctttgtgcctctatgatggggaatcgaagctctggtgggggattcaccctcccgctttggtcccaaagggtggtgaagattccagatctgagttaccttggtggtgatggaggcggttccagcggcggttgctggaggtgccctgcgtgcgtgtgggcacacgctggtggtggcaactacgtcgcgctcggcgttgtggcggtcgtcgtctccctccgttgtacttgtgctggaggtggcgacggcgtgtacgccgcccttggcgttgctgcggtcatcgtctcccttcgtcgtgcttgcgctggcagtggcgacagcgtgtgcacggcgctcggtgccgctgcggtcgtcgtctcccttcgtcgtgctcctgtcgtctgctgcgccccagcttgcgctgcccctgttgcagcctctgcctctgttggcagcagccatggttggttagatgacgacaatctcctccaagtcaatgtctttgggatttttgtgattgggtgtttgcttcggctagattcttgtggttccaagttgcaggtcacctccttcttagccatcgtcgtcctcacagcaagacataagtcaattggcaacctctcaaatgccccattgttgatggttggctggtctatggtttggccctctcttttgtttcctagcagcagaaaccgcgtatagtttgtcattcgggttgagctcggaacccctgtgcaattttcattatcagggttgttgttagagttcctcagattcaatgacgaatcccgtggggatgcttcgctgaatccggtgatgctcgcaccaaaatctatggctcaacaattatcctcgatcttgtgccgttcccgtgaaggcaaccaaaggggatcaacggtttgtcaagcggtgtgcaattcaactgaggcccaaggtagcagtcgtcgcggttttaagacgtcgtggctctacaatcgtcacggcatcaacgcagctccctatcggcttgctcctttttctgctattttgttacatctggaaggcttccatagtttggttaatcctctttctttagggttgtctctaatgctttcagctactatcctttgttgtgtactggggtttatcccctaatatctgttcttacttaataaagttgtttgtgtttaaaaaaaaaatccaccgtcacgcctcgatctccctgttgattgttgtaagagaaaaactaattattaattaactagagtaaaatttagagaaatgcaaatttaataactaaattatcaatatttactacaacattaattggtcacctagttcattgctgcaaggattaaggatgaaattattatgtaggtaaagttgaatctagaaaaaaaaaaggtatgtaaagctccaacaagttgataatttggtcgctaaattaatttgtacgtacatgtctaaaattcactcaatggagtattaatctctatctcttctcgatctatatctatttgtacatgtgctaatctgctgccaatgaaccgcaaccttaattaattaagctttaatctcgttgtctctagcgcgatctcacgctgctaatttgtcctgctccctctccccgttctgcatttatttacttgcatgatgcatgtcattcagatataattattattcgatccaagttcattttttatgattcaagtttcgtataggtttcttttcgacgtcattttttaatgatagatgctcatgatatattaattgctcttgctataagtggttaattacatactaatggagtataattaagttcaacaaaatcaattgaagtaatttgattcttttttaaagagattagaatataaaaactgaacctaaatgattaatatttatcttagttttattttttttcctttgcaccgcaacgtacttgtaatttttctagttactataataattagtaataaatctattctacaccctgaataattcctaataactaatagctctcgtccaaccaatcgagcccatgactggcacgtctaattaataggatctttttttttggaaaaatacctaaagtcggtttggcttttctggggtttcggtttttaccgaaacaaatggagcgttctattcgtgaaaagctgaaacccgtgtgtaatgtgttaattgtgtgttactagttctcaaaaaaaaagaaaaagaaaaagaaaaaaaagaatgtgttgtgtggggaactgggggatcaactattccaatttaccaggtggttatttacgtcggttggatgggccaactgatgggctcgagcgggcgagatatatagggccgggctccaaggccctaattaattaaatagcaaaataattaagctagaatatcatatcgaccaaattatattaaaccctagatagagaaataattagagagagaaggaagcaccaccgcgtgcgccatggccgcagctgctctccgccgatcggcggcggcgaccggccgccgcctcctctgccacgcatcagatcatcatcatcatcaggtaatccagcgcccgtacgtgtacttctaccttaattaattaggtcacaccactgcctgcctcttaatttctctcgaccgatcgatcaaccaatctcttcgtctttcatagtagtatgtccctatagctgatcagtactcgctaattttggcctaattaatgaaacttatcgtatcttttttttctttctactaatacgtaatgcctgtttaaagtttattatatttttcttttatgcacgcagcaggtcgatccattgctcttgaagaatgtcgaaaatttggcaaaaaggcaattacttcgtgacttgactaagaggtacgtagtacactattatggagtaatatacatatacgcacgcatgcgtgcttgaattaattgtctctacatatctgtctaagcaacaaagcttcatcttaattattatcatagtagatttaatactatagccaattcatacaatagttacctataaatatataccacactattaataaatgattcctcaatcatacgcacattatatgttgaagtccgtacgttctgcagctgtctataaatatgtagctcgctacttttttctttcctattttatcttctcgatatatgcttatatatagttagcttatagtctgctattgtacttgcttttgctcttagttcaccgtctttcctttttttaattaagcctcatattaattaattacatctgcatgcagattggctaaggagaagcgtgcgtcttctgtagcgccaacctttagagggattgcatcgtcatggccgtttgcttcttgtgcaattatgttaattatggatggatatcagaagcgctttaagaaggattgtaagaatgcagcagcagctaagaatccttaattaggaacagttctaaattaaattagtttgcttcaatcccctggccaaagttcataccaacaacaacttaattaattgatgtgtctttctggatataactgtatatgaatgatatatacgcgtccatctcgtctgtctaaagcctataactaagaatgtaatactgtttaatttctcgcttttctctcctccctaaataaatatgcagagctccttccatcttaatttcctgattacatctcccttgacgcgcctgactgtgtcaccgcaggtgcaacagtctccacccccaatgtgtctcgggcgctcggcaacctgcatcttgctccgcagcatcagggacacatcaccctgcctttgttctgtcgcatctgatttctgttgtgcattacgttatgttgtacgtagtctatgcagcctagattctcatggctagaacctagttctcggtggcagaatttgtatcgagatatttgaacgtatcaactgtggtcgaaattgtttttgtctatctgcttcatgtgttattcatgtaaatcattgctgcagtacctataaatctgttaaattaacttattctggaattatatgaatgtctaatgaatgatatagtggaagaactgctatacccgtgacaatggaatcgagattcaggagtttctttgttgacaaataagaggcctcatataactactagccggccaacactattgtttctattctcctctacaatgaaatagaacaagtcctaaatttggcatcatgacctcaagtaccagaatttggcacccatttataccaagtcccaaatttatgaaaaaaatttggcataacctcccctacattcatggacattcataacaagcgggttataagaacttcgatcacaaaacattcatacacataatatcacatttaaccccccccccctcccccaaagaacttgaaaacatacataggcacatagcttcacatacaacacaggttacatatatccataacctacagcctcccaagtacacatcacatgttacatatatacccataggccaaaaacctcgtaacgtactccttggcttgagcccacaaaatgcaaagtgattgagtgcaccttcaaacatattttggtccaaatcaccaaaacctgaaataaaatcaacacttgtaaggttcgaattacaaagtagtccaatatagcagcctggctagaagcaaccattgttaagttgaacacggaatctaagattgctttcctgaagagctctatcaggatagtgatatgtaaaatgcagattttaattgttgtttttgttttaagtggaaggtagcattgggccgaaatagttttttttagacatagtgctagatatacaaaaggatataacacccatagagcatgagacaaaacagcatatgtgtgttcccataaaactcatgttataacatggcatttcatagatatcagattttgacgaatataactttgccaatggatagtttgcatcacaacatctttgatttcttgcaaaataaacttactaactttcagtcctctgttggaggcatgtcacgcgggccttcgaccgaagctgccgaaaccactataccgacgaagcaccggtcaacgaccaaggcgttcacctagggcgaagccaggacggttcgccatcatgcctaagggactcgccgtgaagtcttcgcttaggatgaagctatagggcgaagcaggagggattcgccaggtggttggacatcttcgccaataggcccaaagggccacacggcccaaaaatgccattcgacataattgggtcaacttggaggcccacttagggggccccgagccaaatgggcactatttaccctcataaatgtcccatcttaagagtatccggccacgtaaattcccctgtacatatattaactctagggtgcatgagcttgtactaagactataaatagccccctaggggtatgtaatagggggatcccaagaaaaattccattattcaataaattactttactattccactcttctactgtgtgaaccacgtccttcgacgtgagcagttgtctttcgacaacactctctaatttgaaatcttttgagttgtaaatatatatgatatatagaactacaatccatatatcgcttcaagtatgtgaaatctaatttgaaatcctgtgtgttttagcttgaagtgtgactatacagaaacgtccttgtgatccaattgtgctgtggatttaggataagttcattgtgtcgacatttgagattacgactacggtattttgcatagtatggggattgttggtgctagggtatatgtgagattgaagtaagagagatggagacaaatatttttgtacaggttcggaccccttatctgacaggtaatagccctactcctgttggctgaaaccggtgttgctcttattaatcataatcacttcaatacaatatttgggataacctatctaaccgttgtcgagttggcggcctagaataccataccatcacttagtcgacaatagggtagtcttcctccttgaatccatactcgacgggaccagagatagcgctagattcctcttgtcggcctccgcaggcaccggattaagtctatctaggcatatatctgatgtcgatatccggtggcatgtcttggcgcgtgttagcttgtattggtttgtgtctatcttgattgttcatgtgtccccccctcctagggggtcttgtatttatacacatagatgtccccttgtccaagtagaactagggagaccaatatggatacaatccgagtagtctttgtagtttctatatagaactccttttgtccttccttatctggaactgcttctatataagaggtctgattccgtataaaacttggtatatggtgggccctgccgagcttagtcaactactattaggcatgtggtatccataaccatgacacactgaccttgacaataaggaaaaaaacgcaggtgttagaaagtaagaggacttgccattttcgatgagttgaacttttcaatcgtggcagaccaccactgccgatggcatggctgtggcgaggatgccatcggcaggtcgatctcctgccataggaaatgtttgggggccgtggcttggtggacgacctcgtggatctccatgcgcaccaagtttccctttggctagaggaagagaaccctggtggctgtgggtggaggaacgttgggaaggtggggaacgctggagctagcacccttgggggtggcgacaccagatctagcgccccttaggtttggggcagctggatacaatccctagctccaacactgcctcatggccagctagcccttccttctcactgccggtggtgacattcttgctcatacaatgtgcgatggagctatgagaagagaagatgaaggggcacgggtgcatggggcgtcgagcgctgggagcctcagccgatcgagcacaagcatttccgacaaggataaggataaatatgaaattacgattttaccctttgaagggtttgtaccgggtgaggtgagcgtcgttaccgctagttacttgatatgtgacggccgtccgatcatcctatttcattagcccatatttggtaccgccctcctctgctagagtgtaaaaattctcataatatagtgttcacattatgattaattatctgttgcattgtttgtgaatggttccggtgtatgtcctgatttctttcgaatcgacaaatgtatgcatgaatgaatatttatatatccatcagtcatactgttccctaaaacaaattagcaccattgagtcagaggtcacagctcaaaattaactaatatactgtaggaattataacatccttgattagaatgggtacgatcggaagtgattcaaattcatatttgttggttgtagcttctttgttgctagcctccttacgggttatgtgtgtaagtattatcggtgcgtgatgaggctctttttgcttttctggcaattgccttctagtttttactctagtttttatgtgtgtaggtattgtaggtattgtctggtgttggtcattcaaaaagataaccatatttctcttttctcccccttgacatagttagaatgacacaaaaaaaatgcaaacacggaggtactaatagcttgtgcaaaatcagtacagaaaattgctcgcgagagatctataaatttccatatactactaaacaaaggagtaaattaattaaaactgtcctatacaacaaattcaaatttgtctagctagaagtcttggtcgttgtcagggctcatcagttcgatcatcttggtttggacgaagaaccggggctctgttcatctgggcggttgccaataccaaccaaacgaaagaacgctttccggtacggtccatatgcaccccacatggcaccaataaagatgctcgatgaaatggctaaaaacatgtcgcgagaccaccgaaaaccatcaagccctatctccacacgtgcgtcatagatgctacgaattcgaacaattaggagcaaatggaaataaataatattagtatatatgacatttaataatacaaaagataagacatacattacaggacataaagcaacaatatgtaaagtttcaagtactcatggatgcatatacacacacacatgatacctcttaagatgttcctccagccttccgacatctattctttttagatcattgagacacttatcaacctacaaagaaaaatatccaaattcatataaaatataaatgagtgattttatggtacttgataggtatttttttaattaaaaaatagtatttcctcagcttaggtgtagtacgcacaaggatatataccgaattttacggtaggagactatagtactagtatctcttagtacctagtactggagtatcgtatggtaaattaaatctctatagagagtgttctcctactttagccaaacaaccaagagaataaagttggtcatgccatattagtcgtcacactggtggagaagtgctttttagtcccggttcgtaacccccctgtagtcccggttttcaaaccgggactaccaatccgggactaaagatcgctatctttagtcctgggtgaaaaaaccgggactaaagatcgatctttagtcccggttgataacaccaactgagactaaagatccctatcaaccgggactaaagagagggtagcggcagtctatcagctgatccttttttttcttttttattttctcccgaatcgagtggtatgcatatcgtcaaatcaaaccccaaatccacatcacaactccacagcacgattcacagattcaccacaaattcattcacaatatccattcacatattcattcacaacatcacaaatatatccacaatattgattcacaggttcattgacaatatcgagtcacaccctcattcacaacatcacagattcattcacaatccgattcatagattcattcacaaatcaaaacatccaaaccacaaattaaaaaaaatcaaaaaaaaaatcgactcaccggccggcctcccatcccgccgccggccggccacccatcccgccgcttcccctccgaccggatctgggggaggggagggcgag

SEQ ID NO: 1026 - DNA, 21781 bp, Oryza sativa
  unsure (1)..(21781): unsure at all n locations
agggggtgagagaagagcaaggggagaggatggaaggagaaggatggaaaggatggagataaggaaggagaagaaaaagagataaggatgggagatggagagagaggggggctgcacatgcgcttgtgcgtgggctggtggactggtgcatgcgctttcttcccggttgatgttaccaaccgggactaaagatctcagagggcctgacaaggtctgacagatttagaaccgcatctttagtcccggtaggtaacaccaaccgggactaaagatcaaatatgcccgctgtagtcaccaaccgggactaaagatgatctttagtcccggtttgtagtggaactgcgactattgtggatttcggccgaccgaccaaagatggtttctccaccagtgtcatcagccataatatcccccgttaaacttatgaaaaacaaggagaaaattaattaaagggctatcaacaaactgatgtaagtattttaggtggaaaactttgaaatataattctagtagagtagagttatagtgtaattacactgtcagctatacaatagttaaatttaacttttataattttctatataaattaaaaagagtaaataatttacataactttctataactcttacaaaggaaattttacatagaagtaacaatgctataatgtaattatattataattatactaatatggttacaacatagttacactataatatattaattgtactataattacatttgaaacattttcctcttttctgggggaaagatccactactagaaaaaacgattttctctgcaacatatatatgccctagctagatatagaaggggtgtacgtatatgctgcgtcgatctcaccttagagaccggatcccacgacgaagagaaggcgcggtggccggcggggaagtgctgccggagggcaaggggatgagtcgccgacgctgacgcggtgcgacgacgaattagggcgcaggcgagagatcgccgcaggcaattagccatcagatcgatcagatgaattagatttagggcacaaaaagcttaattagctagctaaaagaatattgaagctaattatatactgtatcatctctctcgtacgtctcttctcgatctgccctccacacgcggatcgacggctcggattaactatctgcatatatttttgctatataattaaatttgtctagggtgtagtttggatattgatttattgatagtaaatcccccctgtcacgcctgcaagtgggggcccagtcgtacatatgatcaactcgtactcgtgtgcttttttttttaactagttattatgtacccatgagttgcaatggtataccaactgcaaattatatcgtacgggatgatgttaaataatttaaatgatggtaaaaaagagaatttttaaatgtctattggcagaaaattaggtcaaaatattgcaaatttctaacattaggatttgcttcgtgattcatgctctgacgatccctggtctttctcctccagcttcaccaaccggtgatgatccggcgagttacgattcagggtcccgggttggagtgatgatgggaaggggggttggggagagaggggagatcgctaagcttagagggatgatcgtgtgaggcggctgcaggcgtcagactgggcgctgccgcgtggtcgagaatgagcggtggatcggtattaaatgcagaaaatgtaataatgacacctactttagggaggttgtagtgcttgaagcaccgtcgtcgtcctcatccatgggatcctacatatggattagtttgacccgaaagttcctgcaactatacatcgattttgtacactcaaattgaagttgttgccaacacacataaaaccaatctccaaattaaatgaatttctcttggaaacatagcacacgttcgaatttaaccttggactaccagtccatcggttcgatcgcatttaaattatagccaataatataataggcctatattaaaatgttgtcgttggagaactgcgcctagcgcattaggcagggtctgcggtggtgcaccctacagcctctgttcaaatcccaacgaatgcactcactactctcttaatatatatcgatatgaaagccctttcttttatatccaacgtctttttaaatgttgtcgtttactgtcttatgaaaaaaaaacctcaatcctaaaatataacaagttctgcacataaccatttaatttgtcaagttacagttattattatcttgatcagcattgttagtaataaagaattacatgacaatatattataatcaatcagtactgaaggagagagaccaattaaacgacgacttagtgaatctatagcacagattaattaaagagagaaattcagaagcttttcgatcgatcgatctggactcgtcttaattcttggtctcctgagcaggtgattggcgttgaggagtgatgtacttgtccatgattcgttcagtagaggaggaggcaagcaagaagccgacacagaacatggcggcaatgttgatttcccctactacctcctctctgaacttccccttgggcacccccatagctgtcagcttactgcatatatgcatacatgtattgacatgtagatttgaagaatgtgatggattaattatgtattgcaatgatgcatatatgcatgagctaattactatatccctcgatctgtataaaaaaatgcaaggcatgcgtctatatgttattgacacgtagtacgtctccaatttaattaattgagtgatttactattcttatgaaatttgcacataaaaattttggtatctattgatatctatttaaaatttatctaattaattactttcataataaatataattaacatatacgaaattaatgttatatgaaaaatatttttagatacgattatattagtggtaccacatgggtgacattaaaaccagatgaatactccgccgccacgttgctgcggaaaggaaaattaagttgcatagtatgtacaaacaagatgcaatatgattattaaaaataaaaataattaatatttataaattttgatcctaaaaattgagatcacatagcgttatgagagaagatagaagagacaatttaaactatagatctatcattcaaaggatagaaataattagctagggtgatgtggcttaataagagaagagagaaataacattaactaaacttagtgaggatgaactatacaagtatatagtttatcatagatatatagttagtttgatacttaataatgacgaaaagtaaggacgtcgatcgggagagagagtactacctccatatgagatgggaattaaaaatccgttatattttaggacggagtagtatgtacgacataccagttgaagaagccgtgttgatgagaggaggtgtgagcgttgatggcgtggaggttggccgcgatctcgtcgtcgagtttggcctccatctcccgcatcgtccggagcatctcctccttctccgccccctgcagcttcctcatggctgaccagcaagaacagccgggcttccattgccgccctagcatcatcttccctgggatggatcggagaagacaaagataatacgaccaagccatggcgccgatcgatcggatcaaggatcgagctagctagctaggacggaggtattaatttaatttctgttaagttagctagggcaggcaggcaggcaggttaattaatttctttctgattgattgatttcatatcatatcttatcgtatgggatacgtacggcccatggtacgtacgtacgtggctcggcccaaattaaaccaaaaatcacacttcaattctcctagtataaagatctggtcctgaacgatcgatcaaaataaaccctagatagctagagaccagagagatcgagaatactaactaataataactcgatcgatcataaaagccatggccgcagctgctctccggtgtcgcttggcagccgctgcgtcgcccggccgccgattcctctgccgccgcgcctcaggcgatcaggtattcagctcaggttcacccccaccaattccacagtctctccatctcctagtccatctactgctcctttactagctacctacgtaccattcaaatcttattttaactatatatcttgacaagtaatttaaagattagtaattttccgttcgttacaaatatttttcatccgtgcgtcatatgagctgcagccgtcccaagatatgaaaatatatacaaaatatgggctttcagctcagtccacgcgcaaacaaaataaaagaactacacatgaaaatcccaggccgcaagttcagacgcgagtcgtctcatccttcctcctcctgcaatccggtggcttttgatgtttcatatatcagttttttcatttaatggcacatgtaccaaattaaaaaaattaaaggtgtcggttttttgtcggtttgcacctataccacggtttttttgggtttacacctataccaaattaaaggtgttgtttttttatcggtttttctctacaaccaacacctattactttacaaatgtgcccgtttttaccgttggtgcccccgctgtcgttcgtgtcacaggtcattgcatccacacatgttccttgcgtctctcccttgctttaaaattagctccatcggttatactccagccaaggagctaagataaaattaggctacattatcactggcgttgttgttgtacatacttgtatacgtgctattgatcgataagaaatcatctgcatgaataatgttcaaatcatgaatataaaatcctaattacctaaagtttaacgtgattttaatatattttccgttgcaacacatgagcaccttttctagtagttataaaaattagaaaaaaaatgataagtagtgcatgcttaaattattttgacttctacaagttaaaaaaaattattgtgaacaatacacatatactggttagaattaaatttattatttttgttataacttgtggagatcaaaactgaactttcttgtttgtgtattgctgtatcacataattctatattgtcaaacttttttgaatcttctctaaaatgggtcatttttctcgagggattcgaatctattttcgctattataaaataatctgatgcagcagcaggaaagggatgcgctactgaggtgttgcgtggaatccaaattgcacagctacaaggcgactatggaatatgctgatgaatttaacggcagtctaaggtacatctggcattattctagatcataattataactaggtgaaacaccgcgtgttgccgcgggagtttagtatgataataagaaatagaaataatgtgtaagatagctagacgatagaagcttgcataagttgatatggtttatcataatttaaatagtatatagaatgatgacccaaatttaaaagtaatatgatgtggttttatgagagaagaaaatgagagagataattccaaccattgattaattatttgagggctagaaacaattgaggtgatatggcttaatgagagaagaaagaaatagcattaactaagtgagaatgaattgtataggtatatagatattatataaaatgatggaaagatatattaaaatattttgagaattatgtggaatgatgatttaacatgcttggatttttttaaagctctaaaatttaagtaagaatgaactatataggcatataggatattataaaaagtgatggagaaatacattgaaatattatgtgaattatgtgggatgataatttaattaacatgcttgcattttaaagctctaaaacttaataaattagcatgcttgtatgagatttgagatgtagtaaatgttagtggatgatgtggcatctttgcatgttaagctttagtatgtagtgggcctgaactttatagaaagataggactagttggcaccctgcgtctttgccgtgggttatgtagttttatcgtcaaacaaaattatagttttaaatggttaggtgcaactctatgtatatacaaaacatatgataatatggatttatatatgccttatgttattacaatacaattcatactttatttttttcaagcgtcattgtatattgttataatatatgaatattattttcatgcgcaatatgtgtatcgttatagttagacaatttgcatgtctctactttgctcaagtttttttttctggaaatagatttaggtaaaggtacctaataattatatgatatcttatcatgtataataatacataacaaatatattaaacaataatcacatattaaaaaaataatttgagttgtattaggaaaatatggtgttatgcacaaaatatataacagtgttttgtgtgaatgtgaggtggagcaaagggatgtgaatggataactaatgaatgattggattggatgaataagtagcttcttgatccaacgggtattatctttgtactaatatgatctaatggcttaaaattgttgatgatgtgacttcttgcatgtcttactttataggagtaaatacatcttagtgggtaccaattacataggaagataggattagttgattatattatatattgatccctgtttctcacttattcctgtctactagctactagctagtacctggatctatcgatatctcttgtgatgtaattcgacatgtggtagctgctgcatgccttaaaatcaaattcgtcatgtctaaatttggtcttattaatttgtttcaggcgtgcaatgttcggcatgaccgcgctctccgttttgtgcccttttgttggactagtcagtggattatgggcatcctcgattgcccttacagacgacgacgacgatgattagcccttgcagacgagattgatcgacttgattgaatacgcataacagcatatatatatatatatatatatatatatatatattcagttttcatacttaattaattattagcctgctcgatcgtgccatcatatatgtatggattaaatttgttgatgctatatatatgtatatatatatatatatgtatatatatatatatatatgtatatatatatatatgtatatatatatatatatgctcctgttgactggacatgcgtacgtgcatgtcggcatgcatgctactatctgttttgatcatcgatcgattctctgcggaatagtatattttaatcaaatcctgttttatcatgataaaacatgataaaaaataacctcgagaaaataatcaaatcctatttatgatgatcactagaggcaccatggtcaactcccatggtagtaggcgcgcgcgcaccaagttaaagaaaaccacatggaattaatccattatgagtttcttccatatggagtcatcgaggtctaagcattttatcaaacacataaaggacgtgaccttggggaggaccttggtgatgatgaggaggttgggtcctacatgaaagcggttaatctcctctacatgtattccctcggacgtgaccttggggaggaccttggtgatgatgaggaggttgggtcctacatgaagacggttaatctcctctacatgtattccctccttgtctatcttcttatcgtggctacttatggtgaatttggtggaggatttggtgacgattttctctaggaaggaaggggctcagatgccaaattattaacgaagcaaatatgtaaatgtcaacaatttcaaaaggaacaaatatcaagtgaacatgggatattttagaggttaaagatggaggaatacaaggggcttagaaagttgtagaaactaggaaatgtggaggtagagggaataggtactcaacgaggatcctagcccggatcttaagctgccaccactctgctcgcctagtcgccgactctagtcgttatattgccattatttttttaggacaattgcgtttgtaccccactttcgatctcaattgtgattttactcttcttttttagggtttgcgaatttgcctctgcttttttcaaacgaagccaccgtttgcccctattatggatggcagttaagtaggtcccataaaactgagttgaataaatagaaatgaagaagaaaaaaatatttcaaaaatatggtacctttctacccccaggattatatagtaaccaatcttcatctggcttcagtacactcaccattccccaccattccccatcgtcaaaccgatgagatacattcctgccagctgacgcggcgtgagggctcatccagcgtcctggcgcattgagcgagaatgcgagctcggattgatatactccgaggtattcaactcccattgagcaaaaattttatgtaaatgtataagatataaatcacacttaaagtactatgagtaataaaacaactcataacaaaataaattataattacgtaaattttttgaataagacaaatggtcaaacacgtgagaaaaagtcaacagtgtcatctgttaaaaaacggaggtagtatatgcctccgtttgtccaccatgaacagccaccacgtgtgacccggctgcagtgctctgctagctgtgctggtacaaccttgattaatttcttctgcagggatgtggccaagtaggggatgaaggacatttgccatgtctttcaggctctccatgcctcgctctagctaggttatcactaacgcttaccgcttagcaagcactgggttatcgagcaacatgaagcttaatttgcaacaacttgatgtattatttgatctgtgaagctttgcaatagttcgatcatatataaattatttcacaaattttcagttcaaagcagaataggagcaaaaacacaactaatgtccgaaagtaggggcaaatatatatgcaatggcaagtaagggtataaatgtacttttgtgctcaaactaacaccgtcaaactaatcatcgactaggggcaaaactcttcttcatttcaaaaacacaggggtaaaaacgcaaaccctaaaaactaagggtaaaaccacaattaaacttcaaagtacgggtaagaatacaattgcctcttattttttcgatgaatccttgatgttatgctgctgcggggaggtctaccgcatgagtgactgtacgtgggctcgaacacgcggtcaagccatgtcgtggcggcactccctttttttccgttatgctcccatagatggtttttttaaagaaaaaattaagagaagaaaaaaaattactaatagaagcaaaatgatgctgcttagctagaaatattcgtgtgtataaagtttatacatattcatacattaaaattttatacatataaactatatatgtacttttaatcaagcaaaattcttataaaacatataaatccgaatccgcatttgcatccaaaatcgtgcttagaatcgtaaaggctagcctatctttggctggtactaagggttgcatcagagtttcagccgatcttatcttatatgcatgtttcttaatatgttttatgtaaatttgccacttatatagaccgatctttttatagcattgcatcaagcctatgtcgtatcggctgggacaccaaaattgattatcggcttattcttgataccttgctatagattggtctgcctatataggtttgtgctagagtattagctgacacgttatctttatcgctccaaatatcatcttatcggcttattcttgataccttgctatagattggtctgcctatataggtttgtgctagagtattagctggcacgttatctttatcgctccaaatatcatttataggtttgtgctagagtattagctaacacgttatctttatcgctccaaatatcatcatatcggctatcttccttagtattgtcttaagctccttctgttaatctccatagacaatattggagccggtagggcatgtttaggggtttttatctaccaagtctgtaaccggtttggtattatccaattggctagaaccaccaacgatacgctatcggcctatcggctatcggctgactaaccctatcttttgtttccttgctggttacaggatcaaaccagctagcatgcccttagcacctcgaggcaagccttggacctgcactggagctaagtagatctcacagaccgccgtgttttcttgtgaacagtgctcttggtctacaaaggattaaacgatattgggcttggcggtgcctgtttggtctaatcattgcaacataattactggattatccttccaccttaattaagtaaatgacttaaatgaccatcaaaatcaacgatgggatttattcttagttaggctgtgtttagatccaaagtttagatccaaacttcagtcttttttcatcacatcaatatatcatacacacacagtttttcagtcacatcatttttaattttaaccaaaatccaaactttgcgctgaactaaacatacagccttacactactactacatccaccaatggtaggtactgtaaaaatacctaatagctaggcacacctttacagctgtggtgttgacatctcctgcttagatttttggaagccctcgaaaagggacctctcgtattggtagttggcatatcttcctccaagtttgcagctgaagaaggtgataacggctaaaccgaataatctacccctgaaacaaataaacaaacaaataaataaataaagagcaaagtagttagataggggactttaagggtaaggacttatgtgttacccctaaaagtgtcacattaaattagatgatgaggtggagatcgaagggaagtgaaaagagaacataacccaactctcatgcaagaggcaaaaagaaagtggaatagtgtgagagtggaccaattcaagaaaatgttaggatttgtgtactaaaagtaacataatatgcatgttacatcttaataaatttatagatgacatagctaaaattagatgtggtaatcacatccgctgtaaaacttgtcgtcttgccctaatgtagcagtaacagcaattactggtggttgtagagctagtatataggcagtaggattacgagcatatatatctcaccagctgacgatttgcacttcggaattcacagtcgccgataccacctccgtcttcgtgccgccgctgttctttgcgagcttctaatggaagaaatataatcaggcataaacatataaatacaccatataagcaggtagattaattggttacaataatcgatcgatccagtgaggcggacctgatgatgatctgacgccgcgttgcaaatgaggcggcggctgacgatgccggcggtggttgccgacgagcgactactcagggtcgtcagggatcggagaacagtggccatggcggcgagcgagcgagcgatcgacgacgtcggtttcgtctcgtttggtgatcagagtcgcaacgggtttctgaccaaaaatatataggatcaatctgcgatgtgttctaatccgactcggagtggacggtattaggcctctacgtccaccaagacggacatcaacaagactagtagttgattgaacacacaaacatatgacgatggacaacctataacaaattatcactactacagaaatacaaattagagtcgtttgggaaccccgcatagatatcagttttcccaaccagcacccaacaggtgacacttatgagagaaattaaaggtgtcagtttaggaaccgacacgtttaacacatttgaggtataaaaaaaagtggatcgaacagaaacatcgagcaattgataccaatcaaccatgagatccctataatcaaccatgagtacacgtcgtccgttgtatttatagtaccatgaacggcccatgtttatccgaatgtactataaaaaaagtggatttttatagtcatcacgagaggaggtaccaaatcctgtacgtcaatgtaactagatctgacagctgatgatcctcagtaccgtgaggtactggagtatccatgcggtggtacctcccgtccgcccgcatgcggttagcaagtgaaagggcaaaagtggattttcgcatcgttttcggttgcgctgagtcgctcctttcccgatcccctccttggaacggcgcatccctttcctccaagatcgccggccggatccaagaagtcaacgacctcagcctccctcactaccacctatcgctgccaccgcccccttcttctccttctcctccccctccacccttctcgtcctagtcctagatccagaggccactagttcaactcccccatcccattcacatggtggacgcctgatttgtccatggtgagggaggagcatcagctttggtccatcatacatggtgctggagatcgatccacctgaattttggcttttcttttcctcacccaatgatgttcctgtgtccaatttttttcttacacgatggtccatggcaacggaggagctgatgctatctagttcatggtgatggagatccggtgtagattagttcacggaggagtttaggagctcgtccatgtccatggcgaaggagattcccagcctggattggcatttactcctgtgcggcacttaccccaagctcgccagcgaccccctcttccgacggtccgaccggacgagcatggtggatgagcagaggatgcacggtttctgcctcgcggggagggggaggacctctcaaccgttgttcccatcgtacccttttagaccttttagattggacggttggattttacttggtacctggaagtaccagttgccagaggtaccacctgttggaccatagcaaagctcataaagaaaattcaaatccatgtacctgttggaccgtagcaaagctcataaagaaaatcctagttatttgtttaataggaatcttatgtatctctaaaaatcttatttgatctgaaagagaattttctcattgaaagaaaaaaaagaattggcagctatatatggccagaaaagattatcagtctacaggtgctaaaatctattgcatacctgctgaataccatctacggcagaaaggagcaatatgtgagaatttgtaaactaagacaatttctgcattataagtaaaattcacccacgaagtacatcggtaaaaaggttggaaaaacatgattagctcagaaagctaaaattctgtggctgtcaagtaggcagacatggcatatttctgtaggttggtataaaacataatgaataataagattttcatgaagcatcataggcagttccagtgaaaaagaaaagcatatccatattcaacatatcaattccaagtggacttggtcaagcatataaggtgcaactgatacacacaattcaggctagatcacaaaaatgtcaaaactaattaacaagtaattgatgtaaactatcttttgcttaaaatgaacttgatcagccaagattgctccctgttttcatagacaggaccaaaagaagtcatagcatactgatcgactcattcccaaacaaatatagagcggattatcataatgcgaacagttatcctaatatagcacggctcagccacagaacaaaagatgggatattcatagttgtcggaagttgtcagacacgttaaatcattaactaattgttcatatgaaaggggggcaaatcattgacaccaaggtgacaatgcctctaggtatagattagtattacaaaacaccaactggtctgatccctacatgcatgcattaaattgacatcatcactttggaagctctccctctccattgagaatctcatattgttgtccaacttcgaagctgaagaagctgaggaggaggcttagtccgaatgctctagtcctgaaataagtagtgaccaaattaaattaattagaagacttagcagcagctagatagaagaagaagggattagaatcagggagtaaatagtaattagttagtaccagaaattaggattggcatgtgcatctccccagtggctgctgtgcactttggattccagagaattcttcagtaaagcatcacttccctgctgctgatactgcatagttgaattagggaatcaagcagagcaggaaggcataaataagcagcacaaagcagatagattagattggttacaattgataggaaacttgaagaccaaatgtaataagatgatgaggagatggagaaattacatctatttatccttattcttgcagtgaaaaaacaaaggtggcaatagaactaccttgtccaaagtcctgaggatgagccttcgtagtggcactttgaatgatttaaaactcatattcatatccttttctagttccttcacaaccatcccaaattcttgagaaaatgtcttagtgaaacccttttgttttggaacatcaccgagcgacctcacaagcgaattgataaggcgccttactctagcttcattgtgcttggcatacacctcattccagatcaattcttcaagcagtgcttcccgacatcgctgaatgtaatgaagaagaaaagttagttactctatcactgcagaaatgaatgatttcttattagcagaactagagaagcgctattattgggataaatcataataggttaagcttgaagtgagcaccttgaccatccaatgttcgaatatattctctaaacgcttcttgctgtctcgaaaccagttatgatatttctactcaattcctttaacaagtaacaacaatccagcagatacccgtaatcaatagaattgtcacttaatcggtgttagcttgtacacataaattagtactttaaccataaagttaggaacccaagaaaaatgaagaaactgattggttgtacgctggtgctctgctaatctatcgtcagaccatcttagccgcgtgcccgctatccggagatccccgaactagcaactgctctgtgccagctacgtcaaatgacaattttacagcagagcttgatcgatcgcttgctccttgcctctgtcatcactcgccaccgtgacaacctacgaaacattcagcatcgttgtttagcaggggctgttcacaccagaagctaggtatggcagctgccacaccttgccacaagggagggtccgcccatggctgtcatgccgtcagcctcgagctttattcgctttttctcctgagttttttttttttcatcacacatgcagttccctaattctagatgtgagcatgtaaggttaggagttctatttctaagcagcatgcacatgtgaacaggtacttcggttgaactgatggcctgatgcccaacaaaataactaggctatctatttaattaaatgtcctatgcagttccaaataccaaaatgaaaagcaatatctgaactcaagcaaaatagtttgctgaattagcagagggagaagcaacggaggtcgaagaaaattcaaggctgatagcaagatggcagtcagcaagttgacctattttactcactctcgtaatggttcatctatcatccttgatcactaggtagtttgactaacagtggcagttgggctatacatcgatttaccggtgcatattagtttgttggattaagagttcgatggaacaatcagtgcacacgtgagcatcatgcctacagatttaacttctggatttgtgtgctcacatctagaattagagtgttgcatgcgtttagatgaaaaaaaatcggccttttctctgtcctaatccaccaaaaagtattgtttgacttagagaaatgggaagtgcggcgaccagttgaaatgtataccatctgcttggatcgtcaagatcataatatggagtagcaatcttgatttgtttcacataaaagcggcatcagcaaggagaggaaaaaaaataacagggtcagggtgatgtaattgtaatactagcgatatctgttagtggatcatttgctttgtactattgtatacctactagtttgactagaaacagaattcaggacactgggtaggtgctcacatttggaattatttgtgttgcacgtgcttggatgaaaaaaaaaaagggtagaagaagtgaaatgggaagtcatcaatcattactcttgctacaaaatgcaagctgttcttgttgccatcttctcaaacaaatgaaacaatcaaagacctgacaagtaaacgttgttgatgctttgaccacaaaaaaaaaaaaagaactactccagatggaagaggtgcacaagtgttgtctcacctgaatggcgtgtttggtgttggaggcggagaagtggccgacgttgggggcggagaaggagcgcgcggcggtgccttggggcaggaggggaagggcgcgggcgcggcggaggagagccccgagagccatcttgccctagccttccttcttcctcgcctctctctttctctggtgatggtgatggatttgggaggagaagccgaagcggaggtgggggagtatctctctcgccatccatctccgttccgttgtgttgctcccgttctccgttccgttcggctgcctctctctctctcaaggctgtgttcggaaccctcgcttcccggcacgtaaaacaaagcagcacttaacacgtaattaattaagttttaactaatttttttaaaaaatagatcaatatgaattttaagcaactttcgtatagaaaccttttgcaaaaaaacacactgtttagcagtttgaaaagcgtgcgtgtggaaaatgagggagaggggatgagaacccctgcaaccgaacgcagcctaataatgaggcctggaggcgcatgtgaaatctcatctctacccttccacctcaaccctcaaccattcttcctctaccgttggatgccacggatgcacacatggcaggtagcgagagagatggtgccgaccaccgtaggatgggattgagatcctctaacttaagtcacatgactttgagtcactgacatatgggttttctttgctatgaacccacatgtcagtgactctaaaagtcacctaacttaaggtagagaatctcaatcaccggaggattatgcggcaccggacacgtgctgcgagccctcgtcgagtgggatgttgctctgctgccacctacgtcttctccgcatgcctttgccaccacctcctgctcttttcccgttgaccgaagagggacggagcggcgggtaaggaggatgtcgccccctgcttccggctctccttcctgcggtctctcatcccttgcgctcgccgccgcgagggatggtgagaagtcccgtcgacaccgcagcacaccgctaagcgtggagtgtttggggaaaaatatagaggggagaaagaggctgacaagtgggcccctttttaaaaaaaatctaatcacttgcatgtcaagtgggggccaccttctgtcccccttactatcatatctcaccctctctccacctttcttcttatcggtggggagcggcggcggcggggctctcttctctttctcaccctggccctttcgggccgacgatggtgacggagtggccaattgagagccgggatgtgaggcggcggtggagaagacggcttggaggaagaagtggagaagcaaacaagcctgtcgttcgggagcacgtcattggcgagggcctccttggagttggcttacatatgggcctcacttgtattttatgactagcttgccacatcagtaaaaaaaggttgaccaagtcaaaggccacgttagcgaaactgtcctccaaaaccgtcgaggaatcaaattgcattgattgtaatagttgggggggtcaagatatccgttattataattcaggattcgaattagatttggccactagttaagagaatcaaagtggacttactacaatttttaataagagtgaaggagagatggactggctggcccaaatacaaaactagtcttgatgtgtcgctggcatgataaaaaaaaattcggtccagagattccaattccaacacatatgaaaaaggaaaaaaaagttcaaatacccggtagcgctaatccacgcgctgcgtgcggaataataattcgagcgccgtacaacgctccctccttccggttttcctaaagcttctgctgctcagaagtccttcgtctccacatccatgtccctcccgaacctgcacaccagcatgtcggagctgctctagggatatgtctctgtatggctccacctctacttgatttccttgtagatgaaaaggatcggcacctccattgataaactaaactcgattcgactgttggaaatagctagtgacttggatgtttggttggctttgtttggacctactataacaggcatacagctccatcacccggcgacggcggcgttggagctcatgccctgctagtggcgacgcaaaaaggtgcgagcgaaggcagtgaagtttcgagtcgtctgaatttaatgtttgtcttctggtgtatttaatatcgtatcatttatatacttatatcgatgtaccccaatactctcagaatatgatctatgtatatccccgtcgacagattaagctaaatattttattaatacaaatatcatagctacatattttattaagacaattactatataatttaagtagtcaaatttgttccttccatgttgaaaaccaaatacaaatttatagttactgggctaaatagtttattattattattattattattattattattattattattattattattattattattattattatttataatttaagttcccagtttgatcaaactaaaataaatttaaacagaccatgtgatattttggaaaaagaataatagaacgagtagagtcgagggaggataaatagaaaacacctaaaaataaaaaaaaaatagaaaaagcattgaaccatcgtgctaggctgctagcaccactttgtttactttaggagcctgcataaaatattttggacgagctctcgtgatgtgacaatttcattgcggacgttgtatctcagtgcccactttgatgtcattttttttaaaaaaaataatcagtttttgatatttatttttgaaataagttgtataaaatgattagattgtcaaaaattcgagaaggggacaatcgatcaacgcctgaattgtatcggtgtttccttttatcgtcgttttgtttggttgaaactacgagtactatacatgtaccaccggtggctgcgtgtacgtgcagaggtgcagccatatcgtaggaacgagagtttgtgaaacttctttatttaaaccgcatggtgttactataaagatacgtagcacaatttggaaaacgtactttaacttttaaaattaagttttcaaatcccttctttctatataaagttaagacccaaaactgctatctcctgcctccacgtcaccagctaattgaatccgttggatcaattcatatcagctactgccaagcgtaatattaagcaccatgatctctcttcagatgcactttggaggcccatttctcagtttaggcccaattgattgcgagctcagagcgcaagagaaccttcatctctttgttcgaggtgcctgtggctgcagcctagagcgacgacgcattgtcttctctcaaatcaatggcctcgctaattaagtccgttcaaatgcatggcactacactaatctacctcatcactacagttgttttgtgtgctcatacactgattcaataatccgaatagccattttttttctttttttccttaaaatgattcaattgaaagaaacttgcttttatagtttcattcataagttcacagggtctacagtataatgtttgtgatgtgcaataaactgacctaacaaaagaaaaaaagatgtcttcgtgcatgtctgggattgcatgcactttggcctgccaacacaatgcaataattatatatgcattttgtgaacgaatgttctatacatcctccccatctctcacaggtaatttggctatcttgatgacttactctaatggatcaacatgcaaatacaacttcaagttctttgtgtcatatcttattgatatcttattgctttctctttattattattattttttatttttacaaatatacttctttagtttaatcaagagaaaatttggcttcaatcaaatccgctctaattcctgtgccaacgtttagtgtccaaattgcctgcctctttcttcttctcttacgaaaccaaaacaacataaatttgtcttcagatgattcatctatattgtttcccttccttttcctctctcataaagttacatcaccttagttttgcttagttttgcttttagttgatcaatctataatttaaattgtcataaaccgtatcatctaaattgcttatagcttttttcaactatcaatcaaagatgcaaattttataaagtatataaaattatgttgtctagctactccctccggtttaattttaattgatgttttggacaatggcacggactacaaaatatatctttaaccttatttttctatcataatatatatattaaataaatacatgtttacttttgttatagtgctttgaaagacaaatctatatatatattgttctagtttctttaaactaaatatttttaaagttattaatggtcaaagttataaaaatttgtccctaatcttgtccaaaatgtcaattattataaaaccggagagagtacaaaacaaatcctaccattatcatgcaaaataaattctgcagcaacgtgcgggctttcatttaaattataaccgccatttgtaagctggagggcaaatgacggggagtcccctaaaaagatcaacaaccttgctacttgtacagtcaccgtcaggtgggccacgccactcgctcggatccagggccccacctgtcattagcactggccaatatccccaacttttcttcttttttttctttcccctttccctctcagaaaaaagaaagaaaaaggaaaaaagattcatctcttcctcctcgtcttgtccccttccctcgtcgaaaccctagctaggctcgccgccggcgacgcccgcctcgccgatgcgctcccccacctgaccgctccgcctcgctctcccgggtcgtcgttgcctcaccgctgtgcccgcccacccccacctgggcagcgggcgggatccagtcccagatcggcgccatgtccaaggccagggtctacaccgacgtcaacgtgctgcgccccaaggagtactgggactacgaggccctcaccgtccaatgggggtgagtgcctcccactcctacctcggtacctcgctcttgcttccaccctgtgttgtcgcctctgcatctgcgtgggtcagtttagattcagtgtcggatgttgcgtgctgatacgtatgataaagctttttagttacccgtttcatgactttgcaatcgccggtgttatcatcaagttattaggattgtaaatagaattgtttgtgaatcaactgctgctcttgttgttattggagttccattgtttcaggttgcatgttagattagtgatcttgtgcggagagctgtcaaattgtttagtttagatagaactcggtcttatttattgttacagtcgatttcaattaattatttgttatactccaacaatacaagccaaggattatgcaatatacagagctaaattgaagaatacgacttagtgtacactggtaaaccatgtcaatgaaatgaccgtgtagattataataaacttctcctacatcaaataatcataaattggatctatnnnnnnnnnnnnnnnnnnnnnnnnnnnnnnnnnnnnnnnnnnnnnnnnnnnnnnnnn

SEQ ID NO: 1027 - DNA, 531 bp, Oryza sativa
  unsure (1)..(531): unsure at all n locations
nnnnnnnnnnnnnnnnnnnnnnnnnnnnnnnnnnnnnnnnnnnnnnnnnnnnnnnnnnnnctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacagcggtgaatttatccggcctcagtgcatcggcaaaaccagccatagtaaaatcacagtgcctataataaggtttttggattgttgagattatagacatgtaatgatttaatctattccataaataaatcatgacattacagatgaaaactagcatgaacgcatcattagatctacacatgtaaactacacagtagggtaccgagctcgaattcgcc

SEQ ID NO: 1028 - DNA, 580 bp, Oryza sativa
  unsure (1)..(580): unsure at all n locations
nnnnnnnnnnnnnnnnnnnnnnnnnnnnnnnnnnnnnnnnnnnnnnnnnnnnnnnnnnnnnnttttgataaagttgccaaaaaagtggctacatttagtttgctgccaaattttggtaactatataagaaatcatgtcaaaattttagcaagttggtaaggtttttttgttaataccaaaatttttttttgaaaggaagttaataccaaaattcggtaaggttttttttcatcaaagtgaacaagctctttctctttcatttttccttcctttcttttacaacttcttttcttaatcttggtaggccttttgggccacatgctgggcccaccacaaccttcttgattggccatctccatttcggattggagctgaaattgcaagtcgccttctcttctttttgccggcgaatggagaagaagaagaagaagaagaagaagaagaagaggcctggcccacaaactggcatggagctacgctttcgaggcccatcatgtctgcttgccctttgcaggggttggtgggggcccacctgtcttccacctggcaccaacatacctcccatttttggtagtagtag

SEQ ID NO: 1029 - DNA, 585 bp, Oryza sativa
  unsure (1)..(585): unsure at all n locations
annnnnnnnnnnnnnnnnnnnnnnnnnnnnnnnnnnnnnnnnnaactcttaaggttatgggagttaggaactatctttgacacaatattagaaacatttcaaaataaagaaaaagagagtatcataataattagaaactctcgatgatccaaattatccgactgaatataacctcaccacatagaagcaaaattacacagctatatgcatcacatgatgtagaggctgagatttttatttgactatcttaaatatattgagtacaaaattgcaactatatatggactaacgaagctagtccaacataacaatatatataggtactacatcgtcatttggtcggttaatattctaatcaagcaggtctcactccctataattctatattatatccgagcatatcctcatcgctcgtagagaaagaaaacacatcgatacttttaatgttaccgttgcccatcaaataggaacggataataattaagaggaacaattaaaaaagcaacgatgaggacgacgacgaggaccggcagctaaagcgaaacaagacattcggtcaatcggctgctaatttcctcctgtagg

SEQ ID NO: 1030 - DNA, 1599 bp, Oryza sativa
ctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggcccttaaggtatgccgttttctgctttttttatcttagtagcaaaccaaataagatgaatacaaatatttatcctatcaaacaatttgtagtatcaaaacttaattacctatgctaattttggcaccaccctagagatatctgaaaataaatgaagcatatataagtttgttttagccacacgtaccgtgcttctcattttcttcccttgctgcagcccgatgtatatgggctacgtagtacgtatatgtttcttcctctttgatctgcagcactcgcgcccgctggtgaccggcccggtcgatgtactgaacaaccaccccttctctctatgttttcagtgctatatatacggcaaatgttgagtagatcgaacgatgtgattaatactatatattagtgaaggatgggatgctagtagacattaattaaagagtaaagtttagaaaaatcaaagtttgcggaaaaccacatgtattataacgtgtgacacataactagagatagcaatgggacccataactcgagactcgatggatttttactctattagaagctaatcatgttctaactcttatagctatgggtctattgacggacggaaactcttacccattggatacgtggtatggttttattctttacccacccgtacccatagcctaaaactatgagcaatataagtctcaatgactactaaatcagcataaaactcatttcacataatcacatcttaagaattgttctagactagttatatatgaaattgttatttgattcgatcgccagcgagtacatacctcctgttagaatatatgattagatgcttaagatcgaatcatacctactgcactatacaattaactgtttggaaaatcagagtatagtatagtacagtaggtatgattagttgttgtttgtgcaatcccttccctaattgtgctgctatcccattttgcttgccttgctagtttgcttataaatctaagattttcaaaaatatctgaaaaatatttggaaatatccgaaaagttcagcttccatacttacttaaaagttttaaacgcctattcaccctcctctaaacaacatcaagatcctttcattgatcctcctccctttcacttccatgtgttcaactttgtgtggaaggtccttcaactactggaaagggcttgtgcatgctcctcgtctcacgaggatgattaagaaagtcacccagttgactcacaagttgcatctcaagactgatgtttcatcaggggctggtccttcctcttcctctgcttatccgagtatagtatagtacagtaggtatgattcgatcgccagcgagtaattaactgtttggaaaattgatgatccaccagtgtagtttagttagtatagtacagtagttggagtagctcttgaccgacagaagaaagt

SEQ ID NO: 1031 - DNA, 6914 bp, Oryza sativa
agccgtcgcgaacgaacaggagcaagtcgcgcgaagcgcttcccaaaaaccttattgccgccttctcccggtgcagaacgtcgaaggcagaggttccgtagacctgctctcccgatcgccggtgcacgccggcgagcggtatggagtagtctacgagcgacggcgcagtacagagtagaaagcaaaccctagattgattttgcgtatgttgcgtgaagacggcaggtcggtttatataaagaagggtcgcttgatcagggtgcccgcacgatctctactgcgcgtaaccgaaccggataagtcgcgcgtaacttatccggactccacgccgtttgcacgcaccggatcttttggaacgtttccaaaacaaaaacgaatccgaatttgcaacaaaacaaaactgcaaaaggaggctgcatctgcgcaagggtgaggagccaatttttcggaccattcgacgtgcacgcgcgccgcctgccctgccctgccctgccctgccctgccaggcgaggcgaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacctagtgtgaaaacatatccactagtggctttgatctcatccacatcagagatccagttagaatcactataaccctccagtaccgcaggacacccagtatagtgaagcctcaattccacagtacctttcagatagcgcattactcgctcaagcgcacgccagtgatcatctcccggattagaggtaaatcggctcaacttgctcacagcaaaggagatattaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccctcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttaaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccacacaggtttacacccatagagtcgctctgtcacctcccaagttccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaagatagaatcacgagactccataattgtaccaacatgcatgtccggtacctcggatttaactattaaaaatctataggcaatgctatgatgagcatatcccagaaaaacacagtccacagtcttaggaccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcatcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggtctccgcactcataacctttaccaataaaatatccatgtttagacatgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattggtgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacagcggtgaatttatccggcctcagtgcatcggcaaaaccagccatagtaaaatcacagtgcctataataaggtttttggattgttgagattatagacatgtaatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgattttgcgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgtatctgcgcaagggtgaggagccaatttttcggaccattcgacgcgtacgtcgtgcacgcgcgccgcctgcccggccaggccaggcgagcgagcgcgcgcatgtttcccctcttctctccaccacacatgcttcaagcgactaggagggcatcctcccttttaaggaggtccccctctcctagaataagcaaagtggtactaaactccatatgcatgccatcccatgaggtgggcttttgtgattttccaaagaattaatcttcgagtgggctaaggcccattcattaattccaacagatgatttggatttgctagctccccttagcgagctaaagggattcgacctgggggctgagggcaacatgcactgacgcgcatgctccggcagcgatggctacctcaactacaacatccttatcctccagctgcaccaggttcctcatccagtcatccacttccatgcaactaggctagctgaaagttgcctccattgctgttgtttgtctgttcattgagactgtgcatgtcctctggccgtcttatatgaaatccatcagctgggcagctcccttccctttcacacacacataaaaaaagaatatatattattttgaagattttgcatttatatacatgattttaaaatattatcgaaaatattccctggccacgacttggggatggcatgggaccgttgctatgtggtaccgcggtttacccgtgccgcgacaatgcgcgacccactcccggtcacttaagcgcggcaccaccgtggtcccgcggctcggccatgcgccaccaacaagagccgaccgtgttccgaaatttatgtaatttggatccatttgaatctttcatatctcaattcaaattttaaaacttccatatcgaaattcaaaacattcagctgaatttttttacaaaattaactcacaattcgaattttgagttgaaagtttttaaatcttgagttaaaattctcaaatttgagttgaaagtttacaattcttgacttgaaagtc

SEQ ID NO: 1032 - DNA, 2371 bp, Oryza sativa
ggttgccgtcatcgttgtcactccggtgtgaccggcaactacctctctctggtttggatctagtgatgtaccaatgtgagggagggggaaattcaatggtgtattgtaaatgtagaaaacctggcgtcgggtaagttcataaaacttaccgagtggatgctgggtataccaaaggtaaggttataccagagttcacaatcttctttgttttcttgtcggtctgaccgccaagaaaaaaacttttcctcatggctagcagccaagaaaattagatttcccttactctctagacttggtggttcgccaacaaaatatatcgccttggcggtttttttttaacgactcgcacgagacggtgcgaagttctattgatagagcaggaaaaaaaattacaagattgcaaccctggagggtcgtaaccagaaaaaaagaaaaaatataggttttgatgttatccttggcggttttagctgccaagaaaattcaggtttcttatagtgtacgtaggtaaggtttaatcgagatgcatattttagatccaatgatccacatgtttccaaattttcatataggtataggtctcaactacatatttgtctcgtttattacgattcgcaacacaagcaggcaggtactgaggtacatttgtgtctcgcttgttagtgcaaaaatgacaaattaagaaagtgcattaccacgctgatcatcaccatcatcatcatatagtgaaagaagaattgatgttaacccacccttggttttttaccttgtgaatcacccctagcctttggtcggacgggccaattaatttggatcgctactattgatatcaattaaattcttgatgagccgtactagctgtaggcctaatcttttgcattctggagacatcgttgtttaacttttttttctttttaaaactttggagagcatcctcagccgtgcatgtcattactttgcttatgctttgttgtattcgaaaaccctcgcttgagcaaaactctctttatgcccttcttctgcagcacagaatatgagcgcacgatatatgtacacgcactgtccatgctatcactgttctcaatttaatttgaagctagctaccgtgcctgcatcttgtcaatgtgatttcccctgaataatcccacaaaccgcaataggtgtgaaaaaaaatccccttcaattcctctctatagagattaaccgaacaagatctaattcaatttggagagaaagacttatctcaattatgtcgattcccggagagacaagattcaagcatagagctagttaggagagatatcagaaggccgcaacttatccttcaggtatatatatccgttcgtatatatataaatatagttgacataggattgtatgcttacatttcaataattaattgccagtaatgctttacttgcaaattaagtatagctaatagtgcatgcatgtattatgtgcatccttatctcctaaataagtaattaattaattaatactcttaagaaaaatgtccattctcaacatttaaaccatttccattttcttaagaaaaatgcatattcattcttctcaagctagaaaagtgagaaagatcaatctgcctattgatcttggaaaggtggtttagatctagcaaacttttgcagtacaatatgttgccactatatattggtagtatatatatgggtaaattaggaattttatagaaaattagaaagttgatgagttaatccggtttaattgggactcgttcatgcatgccaccgccaccgcttggtctcatttgtgcacctatgagagatgatggcacatgttgcgacgacatgattcctggccgattctaatcttaattgaaaatctaaaaagtttacaagtgactaattaccagtcaaataatgtaagttatatcatatatagcatatgtgtgtggaaggccttacacattttaaatcgtgctagctagctaggttaacacattcatacaacctgacgtgaaaccaaatttttttttatctagattagctactttctttttaacaaaaatgaccccgcggaataactgcaagaaagacaaattaacccttcaattttatactatgatctatataaatgaaatatcaaattaaatcgtttatactaattgtaccgtaaaagttctctagatctataacaatgtagggattaattgtattgcatataagaaatacaacattgcaaaaaatgtacggaggtgcacgtgcgcgatatataatcaattgagtaaaatatacggtcggttcttaaatttggaccgatatatgaataagaagaaatgaaaggcctgtgtccgtttgcagttttgtagttcacgtcaagcacaagatttaat

SEQ ID NO: 1033 - DNA, 20206 bp, Oryza sativa
  unsure (1)..(20206): unsure at all n locations
nnnnnnnnnnnnnnnnnnnnnnnnnnnnnnnnnnnnnnnnnnnnnnnnnnnnnnnatcaggatacagattacaaaaaatggaggaaaaaaaataggactcttttcaaaaaataaaagaagtgggacagcagcgtccatatgtccattcagatttcagaccatttatagctccatacatgatatatacatatacaaaaacaacggctggtaagttgttcaatccttcaaccctttgttgtacgtgcttctctcagattgatactgctttgcaagtcgacataaaaaaaaacaactcaggagaactgatagaaccttggtctgaacaaatttaccaaaatatattccaagatgtttctgatttacaagaacaagtgactgaaaaccaaagcatatataaaagcacaaagaaagcatggattaattctatagaccgagctaaaataacgtaaggccttctatgcatattccatagaacaatagaagtaaataacaaaacctggttgataaaggagaaataaatcaacgatcacatagtcaataatctagttaagggggcaaggtcatcctcatctcatcagctcctactggttgaatctccttaaattatatccgtcgtcccgtccaattatttgattcctcaaaccgttaaaatacagcaaagggtgtgcatgcagatatgaagaaagaatccaataagggcctgtttagttcgcgaaaagaaaatttttggatgtcacatcggatgtttgaccggatgtcggaagaggttttcggacacgaatgaaaaaactaatttcataactcgtctggaaaccacgagacgaatcttttgagcataattaatctgtcattaacacgtgtgggttactgtagcacttatggctaatcatggactaattaggcttaaaaaattcatctcgcgatttccatacaaattgtgcaattagtttttttatctatatttaatgcaatttaagattcgagttgaaagtttcgaatctgggtttaaaattttaaaaatttgactttagatataaatttcattttcaattttttaattaaaaatatcctaactactaccatcatttatatctaactgtaattatactactaatagattactaacagccttagcgcggaaaaggagggtggccgcgtgcgcccctggcgcgcacgtgccgagtaggactcccccgagacgtgaacacaaaatcggacgcgccaatgacgtaccaaacaatactgcaaaatctttaaatcccgcgtcatacagggagggaatcggacaaaaaaaatcaagcgttatacgaggatgacgtactaaatacctggcaataacattttaatctattaactaactagagtaaaatacccgtgcgttgcaacatgtaaactaaaattataccaaatataaaatattatattattagggttgagttttccatgatatgggcctttaagaaaatatctttctagagaaataatgaaagttcaaaaaaaaagaagaaagaaaatgcctctttaaagtttagacccgctggtatgctagggcattcgcacgcgctgcccagcagtgttgcagcccggggagggaggcccgcccgacgcgggatcaacctgagcccgtcattttcatcgatggctcgaattgattctgatttcatcaaaaccgccaaccctaaccctaattcactatcccctttccttccccactgcgagccgcctcccccctctctcttttggtgccgnctcttccccttncgcgntncttctncccctncccggggggattggtccccctccacccaccgacggggacgctcccccttcacccacttgggggggcggttcattttcctttttttcttccgacccggcttccccttgcccttttttttgccttttgtgcgatggatccggcaacagcgaccacgggtggatccaaccgtggtggtggcggtcgaggacggattcggtgcggtgggctctgtccgacccctctcgcctccctctcgcggcagatctgacagcagtagcagcgtgtggcgacgcggccgggaacgccggtgaattgtaacatcccggcctagggcttaataggattaatagaatactcatatcagcaagttgcaacttcttttccggaagccaatctccaaagaactccagggttaagcgtgcttggcctggagcaatatgggatgggtgacctatgaaagctatcagatgtaagtgggcccggcctggaccgggaaattcttcctgggtgcacaagagtgaggacaaagtgtgctggagcaatatgggatgggtgacctatgaaagctatcagatgtaagtgggcccggcctggaccgggaaattcttcccgggtgcacaagagtgaggacaaagtgtgcagaaaagatatgtgttggtctgtgagggcagtctatgacctatgaaagctatcagatgtaagtgggcccggcctgggggaggcgggacgttacaaaatggtatcagagtcgactctcgcggtttcacgggcgcgtgtgtcgcagttgcgcaggcatggtgcgcatggctggtgtagaccgggagtggttacatagcatggcacatgccactggacacatggacgtggccaagagatgacgttcctggcctagggttgatcgacgggggcgtcgatctctcttaagggggtgagggtgtaacatcccggcctagggcttaataggattaatagaatactcatatcaacaagttgcaacttcttttccgaaagccaatctccaaagaactccagggttaagcgtgcttggcctggagcaatataagatgggtgaccgaccgggaaattcttcccgggtgcacacgagtgaggacaaagtgtgcagaaaagatatgtgttggtctgtgagggcagtctatgacctttgaaagctatcagatgtaagtgggcccggcctgggggaggcgggacgttacatgagctcgggagtgacgatgggctcgagagccggtcgcggcgaaaggcggcgatgcggacaacgttgaaagctatcagatgtaagtgggcccggcctgggggaggcgggacgttacatgaactcgggaatgacgatgggctcgagagccggtcgcggcgaaaggtggcgatgcggacaacggcaacgacgacgacggtggcggcgaccgcgaggagggcggctgcggggaggcggctagggttagggttaggctgaggaagacaatttataaataacttaaattcaaaataaaaaaacaaaatattgaaaacgaatttagagtccttatagaaatacaattagaaataacagattgggagttagaaatgtggaaatattagaagaggagtctacggtccacacacaaaggaatttatagaactaactgaaatttagaaataaaaaaaaataaaagtagagtttagagtccatatagaaatacaatttagaattacaaaaaatgaaaataaaaagctatctattatcttattaaagtaatagaaaaagaagccatcacgtttgctctcacgccctaaaaattcccatattaatcggagaaaaagaaaaagtagagtccatatagcaatacaatttaaaaatagctgaaatttagaattaaaaataaaaaatattgaaagagtagactagagtccatacaagtatacaatttagaattaattaaaattcggaattaaaaataggaaaactaaaagtagaagttagagttcatatagaaatgcaatttaaaattaactaaaattaaatattttttaaaaaagcaagattaggagaagagtatagagtctatataggaatatataggaatacagtttataaataacttaaatttaaaaaaaaacaacatatcaaaaaatgaatttagagtccatatataaatacaattagaaataacatactgagaattagaaaagtagaaatattggaggaggagtctacggtccagacacaggaatttagaaattactaaaagttagaaataaaaaataagaaaattaaaagtagagtttagagtccatataaaaatataatttagaattaaaaaaatcaaaattaaaactaaaacatattgggagaagagtctagcatccatataagaatactatttataaataactgaaattcgaaattaacaaataaggaatattgggaaaaaaattctagcgaccatataggaatacaatttagaaattactgaaattaaaaaaataaatattagaaaaagaagtctagagtcaatataggaatacaatttaccaataattgaaattcaaaattaaaaattaagaaatattgaaagaagagtttagagtccatatagaaatacaatttataaataactaaaattcagaattaataaaaatgaatattgaaagagtagtttagaatccatataggaatataatttatgaacaaaggaaattcgaaatttaaaaaaaaataagggatattaaaagatgattcttgagtccatatagaaatataatttataaataactatcacatatatacaatacaataaaaatatcacacatttgttagttcaaccaagaatttaaaattatgttgtcattttaatatattttaataataaaatgtgaaaatatttaagctattatatgagaaaaaaaatctaatgaggcaagccgcgggccaccatgctagctaacttattaaaggaatagaaaaaagagactccacgttcgctctcacggcctagaaattctcatattaatcggagaaaaaaaaacagagtccatatagaaatacaatttagaaataattgaaattcagaatcgaaaaataaggaatattggaggaggagactagagtcatatagaaatacaatttataaataactgaaattcggaattaaaaaataaagaatattagaagaagagtatagagtccatatagaaatacaattaggaaataatagaaattcagaattaaaataaagagtattagaagaagagtatagagtccatatagaaatataattaagaaataatagaaattcggaattaaaaataaggaatattagaagtagagtatagagtccacataggaatttaaaactaactaaaaatcagaataaacataataaaattaaaagtagagtttagagtccgtataaaaatacaatttacaaatagctaaaattcaaaattaaaaaaaacatgggaagaagagtctaaagttcatataggaatacaaattagaagtaactgaaattcgaaattaaaaattaaagaatattgaaagatgagtttagtccacatagaaatacaattagaaataataaaaatttagaattaaaaatgaataatattggaagaagagcctagagtctatatagaaatacaaatttacagataacaaaaattcagaattaaaaaaaaatattgaaagatgattctagagtccatataggaatataatttacaaataactaaaatttgatattaaaaataattaataactaacacgtatataaaatacaacataaataatacacattagtagtttcgtaaagttagtaaaaagtttaaaattatgttgtcattttaatatatttgtataatacattgagaaaacatatatcctattatataagaaaaatataatgatgctagcgcgcaatctacgcgggtcaccatgctagtttttataataggcaaagatagtcaatctagtctctcaagttttatccaaggcaatttgatccttgaggttttattagcattctcaaattaattagttggatctcaccttgctaaaaaaacttacgaatggaaaagtgtgcacacatacgtacgtacatacaaattatgtgtgtaaattcatgatttgtttgtgtgaatcaactcatatgtaataactaattactgtatgcaaaaaatggacgatcatatgcagggcgggtgcaggctagctagatagatagaagagatggagcaacatgtggaacggaatgcatcaagcgcacaccacctgagagatgtgtggctgagcattggagggacggtggtccgcattgaggtgatggcaatggtggccatctttctcaccttctacgccgtcaccttcggatcctgccgccgctggtctagccgatggatcatccaaaaggttttcctggctgcgaatgcgctgtctgtgtccctaggaacatacagcatagggctgatgcagtcatcgctggtgaagagcaagatgtaccctgtgtggtcggtgtcattgcttgccctctttgctagcattgactccatcaacacattcggcctcgactatagtggccaattcctgaagctgttgtatcagctcttcctctactttgggtatgtgcttgtgatcagcatctccggcaataccaataatggcatggtggccgctgcgattggcatgctttgcagcgtcaccctatgtaagggattccataggctgatggcctatgtgctcccgaccaggctgcggagcatgaacaaagagattgcagatcgtatggaagtggtgaagggggggccaaactttaacgcggccatcatgcaagggtatcaatacctggttgataagacttattatccatccataaccctggaagaattgtggaagcctgacaatggcatggacaaactaggaacagatgctgatgcctacaaggacatatgcctctctttctccctctgtcacctgctacagcgacgcttctttggttttagttgtgctgagtctgaccggccagagacccgtagctttgtgttggaaggcttgcttcaacctgtagcttcaagtagttcatcatcacaaggtactggtggttctcgtggtaactacgagagggccttcaaggtgattgaggttgagctagccttcatgtacgactacatctacagcagcaacgccttcgtccattactatgaagctggagcttgcaccgcctgggcaatagcttcaatcctgaccacatgttttctatgtgtggctgttgccctacagcaaaaagaagccattattgcatcatctgcggtcactatgttggactcggaggtaattagcacaacgatgacaccagacattgtcatcacccttgtcatactggtgtcccttgcttccctccaagtgttgcagctggtgaactccttgtcgtccaattgggcaagagtctcccttgtctgtcatcttttcaggagaaatgccaacaacctggagccatcgatgggcttgaagctgaggttgttcctttccaggatcaaactattggacaaataccagtggcagaacaagcttgggcagtacgagagctcatcgtggctcaagaaagctctagggtttgtcagcttcaagataggacaatgttgctataagccagtgtttcatttcatgctctactgcgtgcggtgcatgatgcgatggccaaccatttgctgcccatgctatgtggtgtgctctccgctctgcaactgggtgttcaaattgcagcctagttggcagttgctcccaggcccttgttgggtgatatactccgccctctacaagttgtttggcctgcagtacattcaacaggtgctgacagacatgttgggcattagcactgcaagctccattcagctgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctgcccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagttcatcacccatctctgggctctcctcttccacgccggcatcctgtaccggccgtacaaggaggaggaggagccagctgcagccgggacagtgtgacgaataaccacttaattattaattatcttgtgtttagcagtttgtttccatactttttatgtttgtagatgcatgcaagatgctgatttgcctgcgggaatcccaaaaatattgcaaaaaggaaacggataattaagcaagtttgtagtctcttctgtccactctagcactagcactgaacactgatgagatgtagggatgaatcgtgctgcgtgtcgcccgcggagagggggtggcggacgctccgcgcgggagaccgacttttccgttttttttttctttttctgtgttttccgtttctgttcggttggctgttttttttttctgttcaaattggttttccctttttttttctcttctgtttttttcggttttttagatgtatgaatacaaattttgtattcgtacatatacaaagtttgtatacatgatgcaatttcttgttttttttatttttttaatacgtatatatataaagtttgtatatatcgtacacaaagttcgtatacatcgtatacaaagtttgtatatgtcctaaataaactttgtatacatcgcatataaactttggatatatgtatatatttttatgcattaaaaaatatttataaatatatatacccgcgtgtatatatatatatatatatatatatatatatatatatatatatatatatgtatgtatgtatgtatgtatgtatacgtatgcatatgtagtatatgcataagtatagtagatacagagaagagactagagggggggggcgaactgaccgtgcgcgtgccggggcgcgcggctgattgcgtatcagcgccacccatatatgtctactccaatccatcaaaaatctcacggatggtcgcctggtcggttttctcccacgatgatcagtttgttggagcacacacacacgccactgaaataattgcatgccaaagcagagtaacatcagagaagctcccggtttcagtttgcccctcctccacagccacatcatgggccttttactgttacaagcccatatgtatgtattgattgtttgcaaactcggcccaactagacgggccgcacattcctcaaattgccgttccggcccaactagaccgtgctgttggacaacatatggcaccggcaacaaagcgtttccgggagttttgaattatactagaaaaattacccgtgtattgctatggaaagctaaaattataataaacaattgagtagagttcaattttcatgatccaagtgctttaagaaaatatttttcatgttgcgtgcgaacacaatctcgtgtcaatgtctagacaccaggtttttttttcaaaacaatctatttcacattacaacgggtaaattattttatttgtacaagaccgtggcacaaaaaaattgaatacggacgtactgttacatacagacatgaccttagtggtgcgcaatcatttctcgcaaattgtgttcttcactcgagctgatcttgaagatgaaagcattgtggatattagagatggcggtgtaatcaaacatcgaaacggtacctcggatataggaaggttgttggttattgttgaactagatattcagaaggactagataagaatattggtaagggtttattgcaaagattattatacttaacttacaaagctcgcattcctcgcaacagtaaaatcataatcacaagccgatcagacaagattgcgaggttaggaaccacaccacctctcagattacagctccttccaaaagaagcttactggtacttcttcaaggtgtgcacatttgggagcatggatgcttcagagcatcctgaaattgcatccgtagccatggagctagcaatggagtctgaaaggagcttcatggttgccaatgtctttggtagattactgaggtcgaataccaacacgctttactggagattggttcttgcatccctaagagagttcaagaagaagattcgagttgttctgttaggaggtgctgatcagcctcaaggaagatttgatgcacttggatggaaatcccagatagcacctaactatagctacacgtatagctgtgagatacagaggccaatgtgtattgttagtagataaaccttgtgtgtttgcattttaaatttctgttatgcatgcgcgcgagctccggtttgtggaagccgtgcgaatagctgtcatgccgcgagaatagctcggcgtggcgctagcaacggggagtgcgcgcgtactgcggatccgtggggatggacacgatcaatccgcgacgtgggaacgtttctgaagcccatgtttctttctgttgcatacctatcccctgtattgctctgttcttcattttcggatcagctacagtgcgtttgcaaagtgttcgtccaggtgttcgcgtgtgttccactcgccgattcgttgggattttcctgacatgtatggtcgccaggaagaagaaaatgcagaggaatggcggctgaatggctgaccatcttaggaatttatctgatgcactctagtattgttacatgtaggaattgtgtctttatatgtaacctctaatatgtaaaactttttccgataaccaaagaaaatactccaggcctctacatcccaagtatacatagttgttctcttgtggtggagcctattcatccgagttaaggaattaggtatggtgctcacgtttaaggctattttttttaaagtagtaagtaaagtacccattgacagcaatgcgtctgtgataactttatcaattgtaatatatgttggcccaatatctgaaggtgcttatattgatatggtttgcgtgtgtacatgcatttgtaagcatcggcatttgaactgtactttttattaaaaaaaaaagtataacatatatagctagagctaatattcattttgcatcacattcaaagtgagttttttattatgaatggttattataattgttattttctggaaaaataatattatggttgttttaatgtattctagtactttctcttgatgataaaagaaacttgacataaaatgagtgtcaaagagaaaaaggcacaaacggactacttcctgcatcttaaaataaatcaatctaacataaaatgggagtttacttagtacatgaatatagacagatgtctatctgcattcattattatataggtatttccattctattttaggctcgcttattttgggattgggacggaaggagtagtagagaaagatgggaagcacactgtattgaagtgctagaagatatgattgaggtgagatcttgtagtggtaaaaagtaaattgcagtattggaagaatacacataaagtttagagtcaaaatgttgaacttttaaaaatctatagcgtttcaattctggaactgagaatatttatcttgtttttttctgaatgaaaccagcacaagattgtgcttattcattaaatatagcaggagaaaaatacagcccctaaggaaaaaaggaaagcaagaaccgggaaaagctgtacactattcaaagcgcggaatagttgaggtttgaggttgcggcctccttgtgctcatatatccaccagtttcgctccatccaaatttcccaaacaatgagaatatttatcttgtgaattacacatagcaagaaacaaatgtatttgtttaaaagaatcaagaaacaaacgtacaaaagatattttcagtaataaaattttttaaaaataaaacatgtaggtatgatgtgaccactggcatgactagtctattttggtcaaaaagcttgcaagagaaacatataaagtcaattgaccgacctacattgttgtttctagaaagcgcaacaaaaaactgcacatgaaaatcaaaattacccatccagtagttgactgattcctatacatggaaatcaactttccatataactaactgcattccaagtcattcttccaaatctggctacattaagacggctaattatttcatttaatttgtggcagtcatctgcgcaggggtatacaagactattacactacagcttcgttattcttggattaagataaaaattttaactcggtttgagttagtgcttccgaaattactaaacaatctagacattgcttgataatattagataaatttattttcaaatttaaatttattaatacttaattaattatgtgctaatagttttttttcattttatgtctggagtttgaacgggacaaattaggggcgtgttcggtaatcattcctttacgctgcagtgcttgtgttgtgcggctgcagctgcagaaaataccagccgaataggtcctaagacaccaaaatccagccctgcctaattggattgggcttatcaacacgccaggccttacacggcccattacattgtttggaatgcgtgaactctacttttttttaaaaaaaagaaagaaaaatgatgacaaacaattaattcacttctagcaggagcgtacattttttttaaaaataaacacaatgcaaacatagatgcttaagtgcatctccattctaagcatgatgatcgtacttctgaaaatggtaaaggaaaaatacaatcatccatggtcgtcgtggttttggcattcaccatggacaagagcaccctaaaatattaaatgtgagaggaaacgctattaataatattgttgtgtggtggaattatatatgttgtccataagtgcatttttagttggtactggtagaaagtagaagcggggccagacatgggtcaacttaggcttgagcctcaggcttgactcgaaaaactccatataaatcctttagaaattatatagacatttcaaaaatatataatctctaactaaagttgtcatatttagtcttacaaatattttttgggctccacaaagaccataagtaatactccatatttttatttttttacaaaagagacttatagtgaagaaaatagaaaagtaattaatgggccattcaatctttatcatccatccaaacatctaatccaatacctaaaaacccatcagatctttcaccaaaagatacccaacgcccatctaatccaaccgcacgtacgagagcactaattaacaagttttttttagcatgatcaataattggggtcatcacaacacaatgcacctagccatcaatacatgatggaacatctaaaggtaacacactccaattagacaaatcacattagccccatatcatggaattaattaaaaggcatggcactttgtttttactagtactaaactagaagctactactaccaaaaatgggaggtatgttggtgccaggtggaagacaggtgggcccccaccaacccctgcaaagggcaagcagacatgatgggcctcgaaagcgtagctccatgccagtttgtgggccaggcctcttcttcttcttcttcttcttcttcttcttctccattcgccggcaaaaagaagagaaggcgacttgcaatttcagctccaatccgaaatggagatggccaatcaagaaggttgtggtgggcccagcatgtggcccaaaaggcctaccaagattaagaaaagaagttgtaaaagaaaggaaggaaaaatgaaagagaaagagcttgttcactttgatgaaaaaaaaccttaccgaattttggtattaacttcctttcaaaaaaaaattttggtattaacaaaaaaaccttaccaacttgctaaaattttgacatgatttcttatatagttaccaaaatttggcagcaaactaaatgtagccacttttttggcaactttatcaaaatttggtaaggttgaaaatgacatcaaaatgaaaaggcccgaaatttactcaacagcaaggctaataaagaaaagaagagatttggtttctagagagagaaagagaaagatgtctccatgatctttgctctagatttctgttgtaatatgatctctcttttttaaaagggcaagggtgttggaaaatactagtgattcttttatttcctttttcttgcacttatcaagcagcctgccacgctgacctgagaactaccggaaaacaagtgttgtcaaaattgattgcttcctgcactaaatccatagagactttttaaggtccaacagtactttacggtactaaatcttggtcgttggatctggtccgatccaacggctggtagtgtttggtaccgcgaggtaccaaatatgtccctattgcggtacctctcgcgtagaagagaggtggaagagcaaaaatgtaactttgtgtgcgatagatgggaggaatagacgggcggaaccaattttgtcacattttacatcctcttctgcgttgccgtcgcgtttctcttccccccgccgccgatgtgttcctcttccgccccaccgccgccgtgttcttcttccgctgccgccatgttcctcctccggcgccgcgacttcgatctgggcccttgcgccgaagcgagatcgattgcggcgtgcagggttgtcccctctcttctctgggattcgtggtcctccgccagtcactgcctggattgatgccatcaacgccgccgccgctaccgccgcctagacgccaactccgccgctgccgggatcgaccgccgccgcctcctcctggacgtcaactcggccgccgctgggaacaacgacttggacgccaccaccgccgggaacgacaacttgaacgccgcatccacccttgctcatcttttttctcccgctcctacccatcccagattcaacggttagatatcgatgtgttttggtaccgagcagtaccagtaccgaccggtacaacctgctggactgtaaagacgctcaaatctataacttaaacatcgcgatcagagtctacttagtgagtggacaaacctgttgtcgcagacatatggccacatatataggtggcctttttatttttctctctttttctctattaccttaaaagagggagttttatatgtatccgctacctttccctatccacacgacgcacaacaataatattagattatattagattgtatgggacatgttttgttgtttcatagcaattcataggtagactaattaaatgaaaattaatatttattttttatatggcgcctgccacctggtgagggggagaaggcatgtgttgctttctttttttttttggttttgtctgaactgatgagactataatactcttcatttctatcactggaaatggggagcaatgctctcctagtttaaaaaatatatttttttaagataatggaaatgagttacatatctaacctctgtaagatagggacataaccatagtattcagttttctaataacttgtatagaaagtatttacatgaaaattgctgcgcaactataactatgcagactatatatgcatgcacttccggaaaaaagaacaaatatatgattgatacccatgtatacataatgcatatggtgaaaccgtgaggagtcaaagtactgtcaaacatcagtttctcaaattcctctgaaactgttgagccatctgaatacagaaagagggagagagaaaggacacacagtactaccactgataagggaaaacaaaacagtagattaacgaataagcactgctgatgcaacttctgcaatcatcatgtccagggagctaaaacgaccttactacccttgccactattggccgccatatatcaatcaatccttttctctcttttgtggaagaagaagaagaagattaagatgctggtgttgagtcgtgtggcttttgctactgatcagattgttcagttcggaattcagataagaaactcatctcaggatcagacaaacaatgggtgggtgccagttcagaaagagagaatatatacggcagcaagtcagcaaccatatgcagaaaagagcagcatgctaatgtctttacaggatgcgcataaaatcactctttttcagttcttttctagcctagtaaagattttatgccttggggacagatgagattattattgagatcagaacatcatgctaaggatctcatcttcttctttgagcatccgaaatataagtctaaataagctagattccatattttaggactagcacaaagcttagactatatattcctaggatttcacttctccatgccaagtaaaaagcacataatatatacctcaataatacatctaaaaaaaatatacctatccaacatagtaggatttttctgggcattttacaattctcccatatcagtccagatgttaaccattttttctcttgaattccttcatttcaagctacatgtgcatatataggggaattaatctccctgagttaattttgaagatagtattttgtagtaaaataaatattaagtaataagatatgactatgttcatggcatgatgcagagtttgagatatttttactccattatttatttttgaatgaaccgatatcggcatgtctatttcattaaatatagtaggaaaagaaaaagacatttacaggtgtaaatagaaaaaacatggttacactgtaatatttgccaaaggactaagatatatagaaaggtgactttaccattctttaaaaaagtatcaagatgtatcatattttctagcgtaaaatttagtgcttttggatactaggtaactcgaggttgtaaaatttaggtttctcaataaagaaccgtaaaatttatcaagatagaaactagtcgctttgcgccagccatgcatctttttactccattatttaggatgtcaattattaatagctaagggaatttcactacttgtgtgatgcattcgatctctccattaacaagatggatgtggacctttgatgcctatgcaaacaccatgattgagtgtgtccatcaagtagctagtcggttagctaggtcaatatcttcaagttaaacacgtacaaatcgatctatctagcttcatctctttctttctcttccacagtgtcaaagacaatgtgtcggcatggcagacagctaccgtccgacttgaaagccatatatattactaattgctttcttcttacttaattattctatcctaattaaagtaaagatcgagataataaacagattaaaactattgtcgagatggattatattccctccttgggtaatactattaacatgaaagagaaagagataattaacgatggagatatatatacatacggatacacttgagcatcaacaatataatgcaagttcatgggcaactactacatatatagctgactaataagagcaagttcaatactatagccaactactagctccaattcatctatagccaatctaatagctcattcatacaatagttatatactacactattaatacctagtcccacatgtcatagacacactgcgtcttggagtccgtgctacagctggctataaatctgtagcccgctgctcttttctctcctgatttatcttcttaaaatatgtttgcagctggcttatagcctgctattgtacctgctctaatagtttaaattatttggttttggaggagtgtgtgtttagctttcgttttcccgggacttttgctgcaacagattgcaagggcccccatgcttgaggctgacacgacggctgcaattggccaaattcgagtgtctctctcatggcgcacgcttattagctttgcattgttgcccactaattaattaatctgatccattacatgagtaaaaccaaattacaacttgtgttcaatttatccaagtcgatcgatcattgattaattaacggcttgttcgatcttcatcgatccattttaaatccgctagttgctaattattaataagtttcatatgcttaatatacttttacttagtgcgtgctttttggttatttgtcttatatatacggagagagttcaagtcgttttcctcattgaagctattttgtatcaacttaaagttttttgtacattctaaatacaaagacatggaatgtaactgatcatcttttaatttaattcttacctaaaagtatctcaatcatcgtaggatacacacaacccccatttgatggaggcactcaccctaattaaaaacaaatcaagatgtatatatatactagaaactaatccatcaatctaccccccatcaagccctaattaacttgtcacttaattgccgttaccgatcaatcaatcaatacaaataaatccatcgtccatgcattgcaatgtattgcatccatatatctcgattgcgagtggctagctcgacgataaagttaattaactggtcgacgccatggcatggcccagcaggtctctcgatcaagatgttgaaatggaagttgaagggcaccatgaacacaataaataaaaatccccaatttgagatgctgaaagagacttcataattagcggtaactatgatagcggcacactatgtccatcgccgtagtttgtttttgacttttcagtgccctattcattaccgtcactatatactagtacgatttaatgatattcccggtgataagaataataaataaattgcatatgattgttaatatatactccctctgtcccataaaaaaaccaacctaatactggatgtgacatattttaatactacgaatctagacatacctctgtccaaattcgttgaactataatatgtcgcattcagtcctagatttttttttggacagagggagtatatgtcaattaacttatatgggaagctcgttgttttcatggatttccaccaaccaaactatttggtgagaaaatgatcattcctaacctcttaacataaatgtgtaagggttcgttttccttccttcctaccttcacctctagtggagatgacgtaatgccaaacatcggtgccttagggttcaaaatgaagagcaagagttagggatcatacataggtgcagattgatatatagtgagattgtatgataatggcactattgaagctatcgacgaggaagctaatagttggtaggctctacaagatctataagaatgagtggttttgaagcgacacctaatggtgccaacagctagacattgctaaataagatgacgaaagggagctagtaaatggaagatgcatgtttgtccgcaatgagagggccaacaccaatagtaattttgtcgaaaatgttcgagtggtttctaggagaggatatatataggtggtcgtggctagaagtaggagagggaatggctagaattgtatagggatggagtggcgggcttgaaccattcgataacacaaattcaatgccccaaaatttaatatagttctttgagaaaatcaaatagctgtaacataaaatccgatatatatatatattttttggtgcacgattaattgatcagttgtcgcagttttggcactattggaaactccaagtagaatggcatagctcacctccttattaaatgcatattactgtgcacaaacatgtggtttaattgtgcaaatcataacacacaccacctgcaacatgctgatggtcaagattctatttcatgtctcagatgattgtgcagttgcacaagtacaacacacctgttgctctgatggccctactaaaacttttgacactgttttgctacatgcatgtaaaacaaacagctgcaagattttaaaattagcttggaacattccatttccactagaacttcgtttactcaaaaggaggaaaaaaaacagaggaacatttcactaaagcatgcaaagactaccaagatcacaccataaacacaaataattaagccaaacatatatttataaaagtccattggtatattccactgatgtaagtatgaacacatcattaattacaccctcacaaaaaaacagcgaaattacaca

SEQ ID NO: 1034 - DNA, 2743 bp, Oryza sativa
catcctctccaccagcctcctcccgatccctcgccgccggtggcgcggcgagacccggaggccgagcaggtacgccaccttggagaagagctggctgcgcccgcacgccacggtcttgacgcagccgcgcacgacgccgacgatctccgtgccgagcgggccacccacagcctccgcgacctgaaaaccacattccaatacccgatccagcaccagtgtgaggtctcgcgatcaacaatggcggacaagcaacgccccccgacgagacgtacgagcatgaggtaggccggcgagtggcggacgcggcagagcgggtcgccgaggaggtcggtgaagaggcagagcttgccgccgctcggacccacctcgcaggcgcgctcaaccagttcgacgccgggacggtcgcggccgccgtcgaactcccgcaccaggaccacctcgccgccgtcctccggcaaacaagccaccgccatccttgctccgatcaatcaatcaatcaaatccccttcttcttcttgatcgatcgagcggtgcgttgcaatttatagcggcgatggagtggcgggagaggagaaagcgcgcgcgatcgatggaaatggaggtagtggcgcgagtggaggaatgggggagtgataagatgggggccacgttcccactttcccgccatctgtacaccttttctctgtgtgctccgggtggggcccacaccccaagttaaactgccccttctgctgctccatgctaaaactggatcgacttgctaattatttgtgtgatttaacaatgattagtgttgttggagtactatcatttttggctcatcagattggaggagtaagagagagctagataatgtaagattcgatagatcctttgtttgctgctgtccgatcttgtcatgattattagggtaattaattagttgtttggaaattatctcttttctattatcatactcggggggatttaggagaagttattttctttttctatcttaattatattgaatgacctcctctaatcattctcacataagttatctttttttctagaaatataggagtatatgacatgttgaaattttgtagccagtattttggataatctttttccttaaaaatgaaaatgtttcacatcttccaatagacacatgttctaaaagcccaataaaaagaacttttcaattagagccagaaaacctttcaaaacaataggaatacaaaagaaaaatgtatatatcacaataataagagactctcggttatcctctatgtcgtaatactatatatccaactaaatataaactcaccacatgagtacaaaattaaaaccgacggctaatgaagtcagtcaaacacaacagtgcatacaatgactaaattatttggttggttagtctcattctctataatcggctgttatatctaaacgtagtcttgtcgctcgtggagaaagaaaacacatcgctacttttaatattgtcgttgccaatcaaataggaaaatataataattaagacgaatgctttaaaaagcaacaagacgttgcagcggcgatcggtagctaacgcaaaacaaacatttggtctgagttatcttttttggaataataattaaaaaatggttcaaatatttggcctatgctaaataattacccatgttgtaaatgtcaaatagaaaactcttaaggttatgggagttaggaactatctttgacacaatattagaaacatttcaaaataaagaaaaagagagtatcataataattagaaactctcgatgatccaaattatccgactgaatataacctcaccacatagaagcaaaattacacagctatatgcatcacatgatgtagaggctgagatttttatttgactatcttaaatatattgagtacaaaattgcaactatatatggactaacgaagctagtccaacataacaatatatataggtactacatcgtcatttggtcggttaatattctaatcaagcaggtctcactccctataattctatattatatccgagcatatcctcatcgctcgtagagaaagaaaacacatcgatacttttaatgttaccgttgcccatcaaataggaacggataataattaagaggaacaattaaaaaagcaacgatgaggacgacgacgaggaccggcagctaaagcgaaacaagacattcggtcaatcggctgctaatttcctcctgtaggtcgatcgatcatggggaagaagagaactgtgcattgaccatgacaacaaacctatctaatatcgatcgatcgatcgacaaaattatcggatttatttatactacacatggtggttcgccatttttctgttgatcacacctgcaggtgtagtgtgcacacgtcagcattcgatcgggtggccgcagcaaattaccccgctctctctgtccccttcttccggaagatctcgtccgtccgatcagcagcggacggcccggatgacttgatggagtgagtccgggtggggcccacaagggggtagtggtgggcccgcgagagagagagagcggcggctttggctgcgcggcgacagcggtggggcccaccggagtatcaacggtcgggaacgcgacgacgagagccacttgcggcggtgtacgtggcgggggcggccgccgtcgatttggccgccgtacgttgacgtcgacgtacggacacgcgtagcgtagatcccgcgcatttggcgccataaaattaaatctct

SEQ ID NO: 1035 - DNA, 1400 bp, Oryza sativa
attaccagtcaaataatgtaagttatatcatatatagcatatgtgtgtggaaggccttacacattttaaatcgtgctagctagctaggttaacacattcatacaacctgacgtgaaaccaaatttttttttatctagattagctactttctttttaacaaaaatgaccccgcggaataactgcaagaaagacaaattaacccttcaattttatactatgatctatataaatgaaatatcaaattaaatcgtttatactaattgtaccgtaaaagttctctagatctataacaatgtagggattaattgtattgcatataagaaatacaacattgcaaaaaatgtacggaggtgcacgtgcgcgatatataatcaattgagtaaaatatacggtcggttcttaaatttggaccgatatatgaataagaagaaatgaagaggcctgtgtccgtttgcagttttgtagttcaggtcaagcacaagatttaattttgtcacgcacgaggaattaattaatttcataagctcacccttaattagcgatcgaatgttatcacactgaaagtcaatttttttttattttaaactaaaaaaatgcccgtgcgttgcaacgaatgaaggcaatctttctatcatttatcttcttccatgatatatatataggcatttaaaattagagagtttatttttttgccatcaacaaccacctggttctacgaattgtcatcatcaaatgctagtatcatcacgagctccgttagcccttgtctaaataccaatttacccttgtaaactatagaacctcctctagttatgatagtttactcaaactgttccaattacaataaactctcttttattcattcataaccaaaaataaaatcagcatcatatttttcatcgattactgaatcaaccaaaacatatattatgacattaaaaaaaaaccaatttcaattattctacgatcacatcaggatacagattacaaaaaatggaggaaaaaaaataggactcttttcaaaaaataaaagaagtgggacagcagcgtccatatgtccattcagatttcagaccatttatagctccatacatgatatatacatatacaaaaacaacggctggtaagttgttcaatccttcaaccctttgttgtacgtgcttctctcagattgatactgctttgcaagtcgacataaaaaaaaacaactcaggagaactgatagaaccttggtctgaacaaatttaccaaaatatattccaagatgtttctgatttacaagaacaagtgactgaaaaccaaagcatatataaaagcacaaagaaagcatggattaattctatagaccgagctaaaataacgtaaggccttctatgcatattccatagaacaatagaagt

SEQ ID NO: 1036 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnntatttggttttcaacatggaaggaacaaatttgactacttaaattatatagtaattgtcttaataaaatatgtagctatgatatttgtattaataaaatatttagcttaatctgtcgacggggatatacatagatcatattctgagagtattggggtacatcgatataagtatataaatgatacgatattaaatacaccagaagacaaacattaaattcagacgactcgaaacttcactgccttcgctcgcacctttttgcgtcgccactagcagggcatgagctccaacgccgccgtcgccgggtgatggagctgtatgcctgttatagtaggtccaaacaaagccaaccaaacatccaagtcactagctatttccaacagtcgaatcgagtttagtttatcaatggaggtgccgatccttttcatctacaaggaaatcaagtagaggtggagccatacagagacatatccctagagcagctccgacatgctggtgtgcaggttcgggagggacatggatgtggagacgaaggacttctgagcagcagaagctttaggaaaacccgaaggaaggagcgttgtacggcgctcgaattattattccgcacgcagcgcgtggattaacgctacccggtatttgaacttttttttcctttttcatatgtg

SEQ ID NO: 1037 - DNA, 572 bp, Oryza sativa
  unsure (1)..(572): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattaataatatttctccgaattgaccacttacttcgactgtgaccaaaccagaactcatactagcaccagaaaaaggctggaagcctttcattgtcatgcctgtaaggttagatagatgccacggtatagcaccagatatgttgttatctgataggtccaagtactggagagacaaaagatttgtaattccagctggaatgctcccagaaaatgtattatgacttagtcgtagaatttgtaaatctctaaagtctcctatccacgcaggtaagctcccaaagaacttattccatgcaagatccaaaaactgcaggcctgtgcagttctgcaaaaaagccgggaaattttcctgataacgtattgttgcttagcaggagaaaa

SEQ ID NO: 1038 - DNA, 338 bp, Oryza sativa
ttcatctggtgactccatctggctctctttgtcgtccctaaatttgacaaacatttaacaatttcagtttcagcagcaatatgaaacaaaaagggtttgatgcaaacaaccaagtgaaactgaatttgcaaatattacctatttcttgacgctctgcagtcccatgctcactgtcaacatcaacataaacctgtgatagaggttgctgggctcgtcgatcggacaaattgcgttgatttgtcatggtcatctgagaagagcctttcgatggcattgctttcctaaccccaaaaaaaaagaaagaaaaaagaaattcataatccttatcagagggggat

SEQ ID NO: 1039 - DNA, 668 bp, Oryza sativa
  unsure (1)..(668): unsure at all n locations
ctcggtacccggcttcttcaactggtatgtcgtacatactactccgtcctaaaatataacggatttttaattcccatctcatatggaggtagtactctctctcccgatcgacgtccttacttttcgtcattattaagtatcaaactaactatatatctatgataaactatatacttgtatagtcatcctcactaagtttagttaatgttatttctctcttctcttattaagccacatcaccctagctaattatttctatcctttgaatgatagatctatagtttaaattgtctcttctatcttctctcataacgctatgtgatctcaatttttaggatcaaaatttataaatattaattatttttatttttaataatcatattgcatcttgtttgtacatactatgcaacttaattttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1040 - DNA, 435 bp, Oryza sativa
  unsure (1)..(435): unsure at all n locations
agctcggtaccccaagagcttgcctcctctcacttttgcgccatcttggggacgagcgtcgagcgtgaactagccctagacctccactctcttggcctccgccctgcgcagcttgaggggctggactgtctcttcacagaggatgaggtctgggcggtgatcaagtccttgccctctgataaggcgcccggtcctgacggttttacgggccgtttctacaagtcttgctggcctgtgatcaaggtcgaaattctggcggctcttaactccttgttcctgaccaacggccaaggtttcgcttccctcaacgacgccctaatctccctcttgccgaagaaggacgaggctgttgacgttaaggatttcagnnnnnnnnnnnnnnnnnnnnnnnnnnnnnnnnnnnnnnnnnnnnnnnnnnnnnnnnnnnnnnnnnnn

SEQ ID NO: 1041 - DNA, 1036 bp, Oryza sativa
aaatcgtttgccgattcggggtgccgaaggagttcatcactgacaatggcaaggagtttgactctgaaaaattcaaagaaatgtgcgagggactaaaatttgcaaatcaagttcgcctcggtcgcgcacccacagtcgaatggggcggccgagcgagcaaatggaaaaatcctcgaggcactaaagaagagacttgagggggcggcaaagggtaaatggccagacgagatgttatccattctttgggcccttcaaatgacccccacaaggccaactaagttccgccctttcatgctcctttacggagatgaggcgatgacgccggcagaactaggggctaactcaccaagggtgatgttttccggcggcgaaaatggacgtgaagtgtcactcgaactcttggaagaggtgagggtcgaagcactagaacacatgcgcaagtacgcggaaggcacttcggcaacttataacaggaaggtttgaccgacagagctcagcccggccatctcgtactaaggaagaaggcaaaacctgtggcggtcgagaaactagaatctaagtttgaaggagcatatttgatcaaacacagatcttgaacaggttcttttcggctggcaacattggagggcgaagagttcgaccattcctggaacgctgcttcccttagacgattctaagtgtaatatgagtggaacccaatttgccaattgtaaatatgtatatattatataagccgttcggcacaaaaagcaaaaaaaagagaggaaaatgaaaaaagaaaaaaaaaactagacgtagggttattatccaccagtataaaatctgtgtcttccatttttctttttgtgaatgatgtcttcgtggaaaaaccccaaagcaaatgcctgatcagcgaatgcaccaggggggcgaaactaatcggtcgaagcatagctcaccgaacgtcgaaaccacgacagctcgaattttgaaaatgcaagtcaaaacactgttgtactcggcatacccaaaggccacgatgcttggtagcacgcct

SEQ ID NO: 1042 - DNA, 4446 bp, Oryza sativa
gctgtaagacttgatctaaactgtagctcaaaccttgctttacaactttgccattggtcactagctctaactctgcctggaactaattttaatctgaacccaaagttggaattccacctctgttccagacttagccaaaacctagatctcctctccttctctctcactagtcgctgccatgtgggccagggctgcatggtgggaccacattgtcagactcatattgctctccacacgggccactgccagaacacgcgcgccacgcgcgggagcacgcgtcgagcgcgggagagggcgagctcctcctctccatttccgccggtgaccgtacttaagccgaccgtccgaccatctttctctccctcttgcccttgtctcgtttcgcggaagaactgaggtaccccgcctcggattcaccgggaacggaggcgtcatctccggcgccggcgagagaagtcctcgactccgtcgcaatccggtgagccccattttcgttcaatgcgcgttctgtaatcccctctcaatgccgtctctaataccgccaagaacacctcatttggtgcagccaatttccgggaacgcgaccgcgtcaactcggaacaccgacgcgctctggacgccgctgcttcgcctttgctcgtcgcccggcttccacagttcgtgacaagctgagcctcttcaccacgagcttcatcaacccctgtagatcaagaatcccgaaggagtcgacacgaggtggaccacggtgggagatcgttttcttcttccccaactccggccaccgacgccattcctttccttctccttctctggtgagcttcggcgcaatatttttcgcctagagctaccttgtgctgatctaaaccgaagcatgcatcctctctatgcagtagaagcctgggggtacaccgtcgacgatgaccgtagcagccgcgccgtcgctgaaccagtacaccgtcgccaagactttgccgagccgcgtccgctgcttggtgagcctcctagtagtccctagagtccttaccatacgcatgcacgattagatcgagactaaaaacccacatgcatgtgcaagccgagcttagccactgcttctaacaccctaacagccgctatagagcaccaaagcttgcaagaaagacaccaataggttcgcacagttgttctctataccttttgttttgggagcttgagctgaatcgccgccaatcgccgccggtgatgctgtgaagctctcggctgtgctgctgctctgctctatccagagcaagggcatggcttttgaaatttaaagactcccaggaatgtattagcaactcgagcagtcacttacatatggggtcgtgcactaatctgtaaataacataaaacacaagtcccattttgaataaaatcctggaacacgtgctaggggttgtgggatctattttctgaaaacccaggggcttttgcgaaaaacgttagtcactgactggtagacccgagagaggaaaatgatttaagaaaattggagaaaatgcaaaactaatttcctatcaactgaaaaatgacagaactttagaaatttgtagaaaattcatcctgactctaaaaattgcaaaataaattttgttggaatcatattttcatgctctgcatcataaaaatgtttaatttaacagaatcataaagattcatgtcttaataatctgaaatgcatttaggaccataattaacatgtaaacactttaaaaatctgtaactttgaatgtaaactgttagattgaagtttctttcactgaatatcaaattaacacagagcacaccaatttcataagaagcattcattttagagcatgttggatttttatgtatgttttaattttgatttttgcatatgtatgtttagacgattcgcagccgagtctcgaggagacctactttgtagctgagcaaggagtggaagagcacggcaagccacctccccttttttatctcattgaacctatgttttggaggtttttgaaaagtttgcaaaatatgcatgtctattgtacactaatccattaaaatcttgtaaaatttgatagaacaactcctcaacttgcattatcacctaaactccacaaaagaccttaaccatcattccaaaccttaggtacaattcattgtgtcacgttaagaatgatgtttgaagtcacaattctatagaagtgcttagccatgcttagtgatgagtttacttaccatttgggctcaattacatgtataaaatgatttattttgtgatctggattaaaatgataaaatgtgatatttgttagataaaatgttagaaaatgtggattttaggtttgggcctcatgtggtacacatgtggtgtttagttgtgtgccgatagggggagagtgtgcccaaaccgacctaaggacttcactcagcgtcagttcacttcgtatacagtacaaccacatgtgctagtatgggatagcccaagcttagtaaattatttatgatttagccttatattctggtaggctggtgtgtatgagttcggataactcagaggaacttcctatttacccccgacgtggtagtataggtgactaatctatccaatacaacggtattgtgccacgtgggtgggttcccgttgtgtccgccaccacggcgttaagtttaaggcgtgggcccgccacttaacggttctaggtcatatatcgtgtatggcttaggatggagtgtcacgtatcgtgctagtgtaaggctaaatcatgaatcttggaagggctttgttgtgagtaataaatcgggtacttatgtatcgcgtgccatgcttttgcatgattattatttcgcatcatgtgggtaaggtgtacgtactctgcagagttaaaactaatcgattagtcgtgctcacggtcaagagcggtgtgtgaatatgtcatgagtatagacctgtgttttattctcctaaagctgaatttgaaattcaaaatgtgatgtgatttgtggattatatccttactgccatggaaggcaataaggggctatgttatatgtgtttaacatctattttgatgcccatttgctaagtgtatacttgctgaaatttaattgaaaataaatctgaatttgaaatgatctttgcaaactaaaaatttgctttatgctaaaattatcccatgttagctttactttgaatatgccatgcatgtagtgtactaggcttgcttggtgcttgccagtacaatttatttgtactgactcttgctcgtattgttgttttgttgcatgtttagagttggttgcaggtgagatcactcctaaggaggaggatttcgttggggatgtttctttcttccaggatggttcttactagggtctaccctagtcagttgcatgaaagatcttttgggtagtaaatgcttccgtgaacctaactattcggtcaatcgaccatatttatctaagcttatgttgtatgaacctaacttagaacttagaacttagaactccctatgttgagatatcatgtgcttggatgaaagtgaggaagggctgctgtgctctcgcccgtttcctcctctcgccgcccttcctcctcgccggatacgagctcgcgacgtcgctctctctctccgccgtcgccaccgatctccagtccgccgccgtcgtcgccccgggccgccttccacctcggcgccgcctccgtcggcttcgtcgcatcctcgccgacctcgtccacctctccgtttcggtcgccgaccgccggagcgccgtcgaccccgtcgacccgagccgcgcctccgccttcctccgctctggctgcctttttcgtcgtcgccgtcgacctagggtgagccgtggaccgccgcctcttttcccccttcccttcccctctctcggctgccgctccgccatgcctatggccgccgccggcgaccatagggtagcgggcgccgcctcccgccagccgcgccgagtggccgccttcgggcgcgccgagtggccgccctcgggtgcggctgacacgtggagccaacggcgccggccggtgcgagcccgggtgcacccggtccaccgtggaccgtgaggctgccgcgtgggccccactcccgtggacccggtccgcgcgcccccttcccctcggctgacgcaataaaccctttttaaattaaaatttaaatgaagaaattcgcaaatattcatttaaagagcatataaactcaaatggccaaaacttggccatttgaactcggaattggaccgttcaagtctctaatttttccttaagaagtcaagaacccatttttgtgctttgttcctgcttgatatatggagtttattagagtaaaagcccttttattttccgttggtcgtgtagacgttgcagcttcggaagatccgctcttcgtggaggttgaagccgacgtttgggaaagtgagcaaggcaagtcacatcat

SEQ ID NO: 1043 - DNA, 7266 bp, Oryza sativa
ggggtgctcccgtgattttgtggagaagaaagcaagccgaagaggatgtgcgttgactacagagctctcaatgaagtcaccatcaaaaacaagtaccctcttccccggatcgatgatctgttcgatcagcttaaaggtgccactgtattctccaagatggatcttcgttccggatatcaccaattacgtattcgcgaagaagatattccgaagaccgcattcaccacgcgatatggactgtatgaattcacggtgatgtcgttcggtttaaccaatgctcctgccttctttatgaacttaatgaacaaagtgttcatggaatacttggataagtttgtggtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacatgatatctgctaaaggagttgctgtggaccccgaaacagtgaccgccgtcaccgattggaagcaacccaagacagtcactcaagttcgcagtttcttaggtttggcaggatactaccgaaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccagtgttaatcttgccggatactcgcaaggatttcatggtgtattgtgatgcttcgcgccaaggattggggtgcgtgctcatgctggatggtcatgtggtagcctatgcctcacgccagctacggcctcatgaaggcagctaccctacccatgatttggagttggccgctgtggttcatgctctaaaaatctagaggcattatctcattgggaatcgctgcgaaatatataccgatcataagagtttgaaatacatcttcacccagtcggatctgaatctttggcagagaagatggttagaactcatcaaggattatgatgtgggaatccactatcaccctggtaaggccaacgtggtcgccgacgctctaagtcgaaaaagcagttgcaacactcttggcgtccgtggcattccaccagaacttcatcaacagatggaagccctgaacctaagcatagttggtcgtggattcttggctacgctggaagccaagcctagcttgctcgatcaaatccgcgaggctcagaagaatgatccagatatgcaagggatcctcaagaatatgaaacaaggtaaagccgctggtttcacataagatgaacatggaaccctatggaatggaaatcgtgtatgcgttccggacgacaaggaacttaaacagctgatacttcaggaagctcacgaaagtccttattccatccaccgtggtagtacgaagatgtacttagacttgaaagggaaatactggtgggttagtatgaagcgggaaattgcagagttcatggccctttgtgatgtgtgccagcgtgtggcagagcatcaacggccggccggacttctccaacctctacaagtaccagaatggaaatgggattaaattgggatggatttcatcaccggacttccaaaaacccaaggcggttatgactctatatgggtagtcgtggaccgactaaccaaggtagctcggttcattctcgtgaagaccacctatggagggaacaaactagctgaactctacttcgctaggatcgtgagtctccatggcgttcctaagaaaattgtatctgatcggggaagccagttcacctctcatttctggaagaagctccaagaagagttgggtacccgcttaaatttcagcaccgcgtatcacccgcagacagatggacagaccgagcgtctaaatcagatcctagaagatatgcttcgcgcatgtgtcctagattttgggaagacatgggataagagtctcccctacgccgagttctcctacaataacagctaccaagctagcatacagatggcaccgtacgaagcgttgtatggccgcaaatgccggacaccactattgtgggaccaagttggggaaagccaagtgttcgggactgatatctcgagagaagctgaagcgaaggtcaggaccattcgggagaatttaaaggtggcccagtctcagcagaagagttatgcagacaactgacgccgtgacctggaattcgtagtggatgactttgtgtatctccgggtcacgccgttgcgaggcgtacaccggtttcagacgaaagggaagctcgcacctcggtttgtgggtcctttccgtatcattgctcgacgcggagagtcgcttaccagttggagctgcccgcctccttgggcaacgtgcatgatgtgttccaagtgtcgcaactcaagaaataccttcgagtgccgtccgagcaggccgactcagagcagattgaagttcgcgaagacatgacctacgtggagaggccagtgaaaatcctggacgccatggagcgcaggaccaggaaccgggtaatccgtttttgcaaggtccaatcgagcaaccacgctaaggaagaagctacttgggagcgtgaagacgagctgaaggcagcccatcccgatctcttcgccagttcttccgaatctcggggtcgagattccgtttaaggggggtaggtttgtcacgtcccaaaatgaccctaaaatatatcctttaaattatgcctagaataattaaaatccatgtgaaagcctccaacaattaaaatgtgcaaagttaaaagccaaataaggcttagaggatttttgtaaatttcctaaaagcctaaaatgcgtaaataaattttagtggaattttcagggcacaaataataattattaagaaataaacaaagttaagatgattttataaaaagaaaaaccctaaaaagtcccccttccctcccttgggccgaattcggcccatctccctccccctctctctcctctccccgcggcccactcggcctctccgggcgcgcgccccgctgacgggcgggccagcccgccaccctcgctgacgggtggggcccacccgtcatccccttcctcccgccgctcacgccgccttccccgcgccctagcaccggcggcggcgcgaatcccaccgcctcccgccgtccccgcgtgcaataaagtggggggaatcactccccgtgatcccctctccctttccccccatttttccctctctctctcgcgttcaaacgggcggatttgcccccgcaaatctcgccggcgccattgatggcggccggacctcacgcgccggtttccatccactccggccgctctctcccccttccaaccctatttaaaccctccccgcgcctccctcgcccgtttccgcctctcaccgcccttcctcctcgccggattcgagctcgcgacgtcgctctctctctccgccgtcgccgccgagctccggtccactgccgtcgtcgcccacctcggcgcagcttccgtcggctttgtcgcatcctcgccgacctcgtccacctctccgtttcggtcgccgacggccggagcgccgtcgaccccgtcgacccgagccgcgccgccgccttcctccgctccggccgcctttttcgtcgtcgccgtcgacctagggtgagccgtggaccgccgcctcttttcccccttcccttcccctctctcggccgccgctccgccgtgcctatggccgccgccggcgaccataggggcgcgggcgccgcctcccaccggccgcgccgagtggccgccttcgggcgcgccgagtgcgcccggtccaccgtggaccgtgaggctgccgcgtgggccccactcccgtggacccggtccgcgcgcccccttcccctcggctgatgtaataaaccctttttaaattaaaatttaaatgaagaaattcgcaaatattcatttaaagagcatataaacttcaaatggccataacttgaccatttgaactcggaattggaccgttcaagtctctaatttttccttaaaaagtcaagaacccatttttgtgctttgttcctgcttgttatatggagtttattagagtaaaagcccttttattttccattggtcgtgtagacgttgcagcttcggaagatccgctcttcgtggaggttgaaaccgacgtttgggaaagtgagcaaggcaagtcacatcatccttgaacatattgaatcccagtttataaaattattttgatttaaattattgcattatcgctttatttaaattcccgcgttatcaccgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctggactttgggaatactcttatcacctggacactatggaatggttggattattgtggaattggattcacacctccccctctattcaaaaccctcaaaatggttttaggctgggctcagggtgcatggttttgatagtagcacctcggccatataaggaccgatcttcgggcctctgttgcaaagcactaccgtacttccacatgtctagtgggtaaggcttagtttatggctcagtctggttataaacaaaagtacacggatcgagatggacgaagtcgggggtcgatggacatctctatggcaaatgaaagctacacgagctgcggaccagtagtcgagatgtcatggcacagggccggtgtcctgctgctaggggctcagtcctgcctacctgtcccaggggttccggccgtaggtggggttgggtcggtactcttgtttatggctaggatgggttggaaactatgtcatgtcttccgtccgtatactgtggtggtatgtggcacgtggtcacatgtgaggaagatgtgtcttgtgggtaaagatgtacacctctgatcagagtataatctattcgaatagccgcaccctcggttatgggcaagccaagcaatgtacccaagttagtgtttttaattcttaaaacctgcttaacaactaaaatgtggaatggtaggcctgggttggcttgggacgaactgggacccaggctcgggttgccagttcggtctgaatcatcgtagaccttgggttaaggcaggttcgtgtgggttcacggccttggttaataatattgtatagctctaggaccatgtttacaaagtagctttgagcaactaagtgacttttaatgctgtttactgcaaaccctaaccccctatattataacccccttgtactcccttgcatttattctgcacttatgggtgtatcttgttgagtatggtggttgtactcagtcttgctcaatttttcccaaacccagaagaggagcccttggatgatgaaggctttggtgtctagctcgtgcctgccgtcaagcgcctgtggtcgtcgccctagtcttccgctgtttcccgtttgtctttgtgtgtgctgggccttcaccgcccatgtaataaagtaactatttacgcttccgcttgataaactctgaaatgtatcaacttttggtgtaccttgcctcctgggacaaggaataatacacgcacgtaaggaacgcccgttgggttatttccggtcgtgacaaacatggtcacaaccatgttcgtgaaggaggctgagcacgaaacctgcaacaactcgcgcgcagaaattgccgtatgcgccaaccacttcgacaaccgagccggccgcatcttgcatccactcagaaaaatcgaacgccattccatcatcccccagagcaccctccgcacgtgccccgaggacatagagagccagccgaagagtgtagcaggcttgcttggcggactccgtcgctggcgccagagcttcggcagcagcgtcctcagccgcagcaagttggcgttcccgtttggcggcccaagcgacttgatcttttcctcagccgcagcaagttggcattcccgtttggcggccctcttgtttgccacttccaggtcggtgcggagagatttgttttccccaattagagacttgtcctccgcgtttgccttcttcagggtgtccgccacgacgcggcgtttgtcctccttgtggtggaggtcctcttcggccttccgaaggcggagccgataacggtccagcctctccaaggcggatcgtttcgtgctcaggtgcgccgcgagaccctggataaggaaagccgaatacattttagtacaacaaagacgaaaggcacaaaaagtgatgcgagcgaaagaaaagattcatacccgcacgaacaggctctccgcagccgcgcaactctcactgaactcgttgagttcggtaaagagaccgagacagttagacggcgcgacaatctgacacaccgcatccacgaaaggggcgatctccggccgagatgtgaaatccgcagaaacaaagtgtgggacagtcagtgtcatatcagacactgtcatctccacttccggggccttcccttcccgatgaggactggccgaagggaccgcctgttgacggtcgttattgatcagttttgaccgtcaatattaccaaaatagaggagaactagttatgcttgcaatgcataaatatgttagaataataatattccactagtatttggttcactaaccttttgcagagaataaccataaagtggaggagaaatgacatcgaatcagacgataaatcaatcagacgatgtcgacgatcagacttatgaatgaatgggccaagaactcagaattgacaccatgaattaggccaaaattcacagtgagcaacagaagaggaggccacctgccgagtttgggcaggtcggcccagcccatggtgggttcggcggaacactcctcagcgccatccgatccagggcttcgcttagacgatgtggattaggccccaatgacggttggaagttatttctgaccattccaaccatcacaaccgttgttgggaggctagaaaaggagttgccattctcacttcactcacacgcctctagcaagagctctcttatattctctcaagttagtttagtagtatcaagctagtggaataggaatagagtagaaatctggagtccgaaagccttcggaagagtctgggtatggctctagtatcttttcttt

SEQ ID NO: 1044 - DNA, 10960 bp, Oryza sativa
cgatgatattagagtagtatttggtagtttacacgtgatgatgtgaccattaagtatatgcatacatccaagcgcgagaaatataaacatggccaaagaatacatcgagtgaacgcaggatctacaagatattaaagtccaatgagttttggaacccaattcggcctccggagacagtactgacttcaaacggacctagcgccttcatgccaactccgatttggatgatcttggattacatggaaagcttatctcgctagctttcaaacgcatccagtctcatgtccaaattcatctcgagtcaacgggaatcgccaaaacaagacagtactattgctgaaaccgaacttgggctttgggccttgtaataggctaggcctatctcggaagtgtctccctccacctcaacgaattagcacataaccctagctttatttttctcaataaatagctttgtacatcctcaaaaacaattgggttttgtttagttgaatttttccaagcgccattcaccttgtctctagtccttgctcgattagtcggcgactaatgatttagatccctcaatagttggtgtgttgatttgccgggtcgattagatctaccacttcaatcgcaactatttctttgtgcttaatcacctattcgcaatatttagattgcatcttatcttgttcttgcagtgttctctcgtttgcattgcagggatcatcaaccgcgcgtcccagttggtacgacatcatttgtggtgtagcgattgcacggcgtcctggacttgttctggttgatagccacatcgcagacgtcgcactctatcaaaacgagagttatccctctcaccagaaaatcgggccacgagagagcgtcatcagttggtatcagagcttgcctggtgaggatttcagttgtatatatttttcctacccatcatctataaattgccataccacttttcccttcaccgaacatgagttctgagccttgcaattttcattcaattttgctttattgagttttagtccgctgtcgtgtcggagtgctggttctagctatagagtagtcttggtctgaatttgcaagtgtgtgtgttgcacgttgatctaggccgtagttttattctgcttagaagtcacagtttggctgccgcgaatatcaagtcgcactgttgtttgagtagcagatcggattgagagaaaatatggtttgctgatcgggattttgccatgagatcctgttagtttgcatgtgtgtcagataattagataattaggaaagtctgtttgcatgtgtgtcagataattaggaaagtctgttatcccttccgtcgtctgcttgagtaacagagacaccgaaacaataacaaatttgattgggtgagctttcctagtttgttacgcatgcatgcatcatttccttgtgtgagataaattccttgatttgcggcggcagcttctatagcgagttccatcttttaattcatacgttcagcccttgagttgtaattttttttatccaactattcacgtttgatagctgtgatctgtgaaaaaaaaagagaaaagtaaaaaaaaaaggcagaaaggtggggaaaaaaaagagccgcaccaaaaaaaatcagaaaaataaagaaagacaaaaaaatcagaaaaaaaaagagaaaaaaatcagaaaaagaaagtgtggagatttgttttgttggaatcttggagagagttgcttgagtgttgatcatttgcttgtttgagctagtaatgagtctaggctaggccagcaattttgcctattactttggactattattcaatttcgcaaatttgtttgatttttgctattccttgtgatatagttaagcctaccaagatccacatactactaacctttactaacctttacaggtctggctttgcaatcgctccactcatcaagcgtgtcattgtgccatgaaccaatcacggtgattgatctgtttttgcattatttgagaacattataagaacttggtatatgctatagtgctgagcgacttgcaaccccataagcaaaagattgttgttaacaagaagttacatgcatatgtttgtttttcttgtttgctactgacaatgacaggagtgtacagagagaacgggattgaacaaatgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgctcaagataacaaaggatggcataataggttttcatttgcaaaagcagcatttagcaaacatttgagaatttaataaaaccgttgagtaataattaaacaatattaatccaacactatacaacgtaccctgttgtataggcccaaccattctgaacaaccaaacccagctgtacagatctatctccaaaccaggaatataccattccaaaccaggagctaatcaaattattaccagttatagcatcttctaatatgatgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacattacccctcgtacaacacaatccactgcagtgcaccactcccggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggatttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccgaaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggtttattgcgtcagcgggctagggtttggtggaccggcgcatgggcggcggttcacacgaacggacggccgagattgatccgatccaaatcggacggccgagatcgatcgggtccacggcggctcacgggagaggatcccgatgacgtcagcggtgacgtcaccgacggcggcggcggctcggcgggcggggacggctcgggcggcgcatgctcgccggcgaacggcgacgcgaggacgcacacggagggcaccaacgggtagcggacggcacggcgaacacaccggcgaccaaaacgacggcggagaggcaacggacgacgacggcgacgaggaaggggcggcggctaccttcgggttgtcgacggcgacgatgctccggcggtctccgacggcagcgaaggggcggacgaggacggcggcgacttggcgatgacgacggcggccttcccgagtgacggcgacggctggaacgacggcggcgcacggctggagcggcggcggcgaaggcaaagctagggcacatggcgctagggctactccggcgacgagaggcgaaggcgagggtggcggcggaaagagaagagcacggggatccttttaaaggggctcggaggcgacggcggaggcccacggcgacggcaacggcgaaggaaactcgcggcttggaaagagggaacccgatccgaatcgaacttgattccaacgctttccaaagcgatttagccgatgattccaaaggagaaaaggtagaggagatcccggagattgtttcccctcaaccaattcggccggagaaggaaagaggcggccggatttggaagggaaacggcggcggcgcgaactagggtttcggcagcggcggcggctcggcgaagacgaacctgacaggtggaccccacctgtcagcggcagcgggcgcgcgcgcggcagtggactgggccggctgggccgaggagagagagaagagaggttttgggccgactttcggcccaaagccaaaagaagactttttaaaacttttttcaattaaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatattatttgaattttcagggtgtgacaacaaataaaacattggctttcacatcaagaagagatacatgatgaggcttgtgaaaataatatatcgttgcctttatttgttggtaagttcaatcctacagattatattgattgggagttagtagtggatgaataacttgaatattatgaatggtctgaggaacaaaagattaaggcagccacaagttcttttacttcttttgcacctctttgtggagtgatatttgttttgttggtaataaacctggttcttggaatgacttaaaaacaatgatgagagctagatttgtacccgattattatattcgttacttacaaaagaaaatgcaaaatttgaaacaacggaatagaaccgtgagagagtaccaccgggaatttaaaatgtgtatgttgtgcggtggtatagaggagtctagaggagatacaattaaaagatttttacatgggcttgatttcaaaattcagcataggcttgaaaataaaacacatagccatctttttcacttactttttcttgctcgcaatattgaaaatcagattgagaaagaaacaaaaatgcctatgatacatgagaatattcctgtgccttctattgcatctaacatcgtgcaggaaggtaaaaacaattttgaagaaaggaagaatgaagaacctaaattaggtgaagagagcgttttaggtaatttaattgatggtcaactggatcaaggtgagaaagattgtgatatgctacaattgtccactaattatgctatgttagagcaacctctagtggaacagatttctaatttgcctctatcacaagctaaaagttcagattgtgttgatatttgtcacaccctaaaaatcctaaatatataaattgttgtttaattggaattattagaatttattttaaaaagcctagaagagaagatctaattttaattaataaattccaatataaaatggggccagataaaatttcattaaataatttacttaactctataattcctagatttttctgggatttatttgagctaaggaagtatttttaataaatggaattgcatttaatgaataatttaaattgaaaaaggtttttaaagttctcttttggctttgggccgaaagtcggcccaaaaccttctctctctcctggcccagtccgcccgcagccgagccgccggctcgcgagcacgcgtccgcccgctgacaggccgtagtcttcctcgcgccgtcgcccggccgaaccctagcagagccgcgccgccgtctccttccaaatccggccgcccctttctgtttccgatgaaattagtagaggggaaatgatcttcgggatcttctctacctttttccttttggaatcgatcgccaattcggtttggaaatccgtggattcgagttcgattcggatcgatctctctcgtccgaaccatagatttttccttcgcgtcgccggtcgccgtgggccttcgccgccgcctccttgcccctttaaaaggaccctcaagcccgccgctacctgccgccaccctcgccttcgcctctcgtcgccggtagagccctagcgccgtgtagcctagcgccgccgtcgccgccgttcgtccagccgtgcgccgccgccgctccggccgtcgtcgtcgctcgggaaggccgccgtcgtgatcgccaagtcatcgccgacctcgtccgcccctccttcgtcgccgtaggcagccggaagccgcttcttcctcgacgccgtcgccgtccgttgatcttccgccgttgatttggtcaccggtgaattcgccgcgtcgccctctacgtgttggtgtcctccgttcgcgtcgacgccccgtcgttcgccggcgagcttgcgcgcccgagccgccgccggtggtgacgtcaccgctgacatcatcgtcgtcgtttcccgtggcccagtcgtggaccgatggatcttggctatccgttttggatgaatcgatctcggccgttcgtttccgtgagccgccgccgtgcacccggttcaccgtgaaccctagccgttgatgcaataattcccttttccttttcaaaaataattcattattgcgtcataattcaattaaaatctatataagtgttttaaaccgatttaatctttgaaaattcataactaattcatcttagctcggatttagttggttcaagtctctaaatttttctaaaattgagacctacatgttaaaaatatccacatgtactgttcatgcttgtttatgtgctgttttggtgttttgctcctttctgtttagattccgacgtttccggagagtccgttttcgcaggagaagaatttgaagagttccaaggccagcaaggcaagtcacatagatcctaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgatctagttgagctttatatattggttcagctagatattacatgtgattgcttagccatgcttagaaacattagcacactattgggataacttatgactcactattatttcatgatggcttactgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaatcatttaccgtgccaaccacaagccagcgtgggcaacggctttaccttttgtatagcatggttcattgcggagcaccagactgagaagtggcggagataagcccacgggggttcgctggggagtccataccttgtttataagggggtgattatgatccgggagtggtgcactgtggtggattgtgttgtacgagaggtaatgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatattagaagatgctataactggtaataatttgattagctcctggtttggaatggtatattcctggtttggagatagatctgtccagccgggtatggttgttcaggatggttggcctgagcagcatgggtgtgctgtttagtgttgattacaattgatgattaattactctcctgttttataattctcaaatgtttgctaaatgctgcttttgcaaatgaacccctactatgccatcctttgttatcctgtgcacttgcatatttgctgcgtggcttgctgagtatgtcatatactcaccttgcaatcattcatcagaggaggagatctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagccaggttgaccctaggttatgccaaatggttacctacaggagccctctaaaaatattggaaaagtagaactgttctcctccctttctcttttaattaaaccaaactaatggcacatggacttcataatctcttttaatggttctcattcaaaaatttattccagtgttattagtactgtacatctattactgtactaatggctcattttatcagtaaatgttttacaatattgttttatttaatcttgctgcaataaaataaatttagcctgttgattttataactttcttttattttatttcttttgaaacctgttgttcaaaagtgcaaaatttgtgatcttgtttccaactgtttcaacttatcttgcaagcttggtttactttatttacttaccttttactttgattttctaactttattcaaattaatccaaaaacttgcgctattaattggataaatgtcttaactccctcctttcacttgtctttagatgccgcgcttcaagcctgagtacttgtttggtgttgagggatttgtccaggagttgcgtacgatgtcctttgtcataagatttgggactgcccctttgtatgcccagattcctcatgatcgtcacgaagagaagtgccgagtcaaagtcaccttgaacagtaatagtgaagatatcccatcagtgatgttcgaagatggaggaggaaactacatccatgcatgtcaggaggtggcaaggatcgccataggagagctccgcgatcgctacagtgatcagttggccgacactgagtatcgctaccatcctcgccaacctcagggaagtgaccgtggcagctaccttgagactgaggggattgagaatgatgctactacaaggcatttggttgagatgctgtgggctatggatgaaacccgcgcggagattgtgctagcagctcaagatcgtgaagaccggaatcgtggtaagatttgcaagctagaggacaaggtggatcgtttggagaaggaactagccgcgttgaagggagaagcaccaccgcagaaggccaggattcgtcttaccgcaaggaagagagctctatttgtccctcgctaccaattagcgccaaaggtccgtgtggtggagaaagaagttaccccagccctagcggatcctccggtcgtcaatgtaagtgatgatgaaggagaagaatcgaagcgcacccattcaaaggtcgagtggggagctactcaagatgatggagacgagccgaacgagccttcaattaactccaatgcccggaagacctagagtgccttgtcaagccgttgtcttagatcgttgtgttagtttgtttgtttaagtttggttgtgtgtgtctcgcatgtgatttacatcagtggtgggatgtaagtgcatgcgtttgtttgcttttgagtgttaggaagttggtgagtttagtggtgtgagagtcttcagttctgtaataatgaaactcagttaagatcaataaaagttaagttagtaaaagaattaattctctgccctaagtagttttccccggtttctcttcttgtgatcctgcccatgccagatggtactcactcgtagcaacgggaatggtcccaacatcaacaataacaacaccaatggagagaatcccacacttgcccaagtcctggctcaacaggcacagcttctgaacatgatgatgcagcaactccagaaccagcagaactagggaaataaccatgcacctccccagaacaagttagcagaatttcttcgtgtgaggccgcccactttctctagcaccactaatcctgttgaagctggtgattggctgcacaccatagagaagaagttggatttgcttcagtgcactgatcaggagaaggtctcatttgcatcacaccagctgcatgcccctgcctttgagtggtgggatctcttccgccttaacagaactactgctgaacctatcacttggcttgaattcaccgctgctttccggaagacgcatataccatcgggagtgatgtctctcaagaagaaggaattca

SEQ ID NO: 1045 - DNA, 15826 bp, Oryza sativa
gcatttagtagaagaaacgccggattgctcacttcaaggcacaacaggggaatagtcagaggccacgtcttactttaggaccccagtccatgccacagggaggttcttcgtctgttgttcatccgcagcgtcagttcttcaacaacaatgctggcaacaacatccgaaatcaagctccacgccctgttgcagctccaacacagccacagcctgccaagagggagcaaggcagcaagcccggggtgtgcatcaactgtggagacccaggacgttactctgacaagtgtccgaagccccgacgcgtgaaggttgtccctgcccagagcaactctaccgcaccagcatcaaaggcccgtgtcaatcatgttgctgctgcagaagctcaaggtgctccagatgtgattttgggtacgttccttgtcaactcagttcctgcaacagtgcttttcgattctggtgctacacattcatttttatccatgagttttgcgggaaatcatgggatggaagtagaagatcttagacgtcctttgatggttagtaccccaagtaatcaagcactctctttgcaacgtagcccctctgtcagaatagaaattcaagaagtaccatttctggccaatcttatcttgttagaatccaaagaccttgatgtcatcctagggatggattggttagccaggcataaaggtgtgatagactgtgccaacagaaaagtaactctcaccaacaatgatggtcgagttgtaactgttcacgcattgtcttctgaatctttaaggtcaagtctgaaccaaatagctttggaagagattcccatagtacaggaatatgccgatgtgttcccagacgatttacctggtatgccgcctaaaagggatatagagttcagaatagatttggtaccaggaaccactccgatccataagcgaccatatagaatggcagccaatgaattggcagaagtcaaaaggcaagtcgacgatttgcttcaaaagggatacatcagaccgagttcatctccatggggagcccctgttatctttgtagaaaagaaagaccatacccagaggatgtgtgtggactatcgcgcactaaatgatgtgactatcaagaataagtatcccctacctagaattgatgatttgtttgatcagcttaaaggtgccaccgttttctctaagatagatcttcgatcagggtatcaccagttaagaatcaaagaggaagatatacctaagacagcttttaccactaggtatgggttgttcgaatgtactgttatgtcttttggacttaccaatgcccccgctttcttcatgaacttgatgaataaggtgtttatggaatacctagacaagttcgtggtagtctttattgatgatattcttatctactcccgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggcctcgcaggatattatcggaggttcatagagaatttttccaagattgctaagcccatgacacgactgcttcaaaaagatgtgaagtataagtggtcagaagaatgtgagcagagttttcaagagttgaagaatcgcttaatatcagctcctattttgattttacctgatccaaagaagggtttccaagtctattgcgatgcatccaaacttgggttaggttgtgttctgatgcaagatgggaaggtggttgcctatgcatctcatcagttacgtccgcatgagaagaactaccctgctcatgatcttgagttagctgcagtggttcatgtgttgaagatttggcgtcattatcttttcggtactcgtacagaggtgtacactgatcacaagagtttaaagtatatttttactcagccagatctgaacatgagacaacggagatggttggaattaattaaggattatgacctaggaattcattatcatgcaggaatggctaatgtcgtagcagatgcccttagcagaaaaggctattgtaatgctatggatggacgacagttgcctttggaattgtgcaaggagtttgaaaggttgaatctgggaatcgtcagtagaggcttcgttgcagccttagaagcaaagcccactctaattgatcaagttagagaagcccaaattaatgatcctgatattcaagaaatcaagaagaatatgagaagaggaaaagctatcggtttcttcgaagatgagcaaggaactgtatggttgggcgagagaatctgcgtccccgacaacaaagatttaaaagatgcaattatgaaagaagctcatgatactttatactccattcaccctggtagtaccaagatgtaccaggatctcaaggaaagattttggtgggcaagtatgaagcgtgaaatcgcagaatgcgtagcagtatgtgatgtttgtcagcgagttaaggcagaacatcagaaacccgccggtttgctgcagcctttgaagattcctgaatggaaatgggaggaaatcggtatggattttatcactggtttacccagaacgtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtccgatcgaggcagtcaatttacttcaaatttttggaagaagcttcaggaagagatgggttctaagctgaactttagtactgcttatcatccgcagacagacggacaaaccgaaaaggtaaatcagattttggaagacatgttgagagcttgtgctttagacttcggtggaagttgggataagaatctaccttatgcggaattttcgtacaacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgtgtagctcagtctcgacataagagttatgcctacaattgccgcagagatttgagttttgaagaaggagattatgtgtatcttcgtgtcacgcctcttcgaggggttcatcgttttcacaccaaaggaaaattggcaccgcgttttgtgggaccttataagatcgtcagtagaagaggagaggttgcttatcagttggagttacctcaatctttggcaggagttcataatgtgttccatgtgtcgcaactgaagaagtgtttaagggtacctaccgaagaagctaatcttgaacagatagaagtccaagaggatctgacctatgttgagaaaccaatccgtatcttggaaatagatgagagaagaaccagaaatcgagttatccgtttttgcaaagtccaatggagtaatcactcggaagaagaatcaacttgggaacgagaagatgaattgaagtcagctcatccgcatctgttcgccagttcttccgaatctcgaggacgagattctgtttaatgggggtaggtttgtcacaccctaaaaatcctaaatatataaattgttgtttaattggaattattagaatttattttaaaaagcctagaagagaagatataattttaattaataaattccaatataaaatggggccagataaaatttcattaaatactttacttaactctataattcctagatttttctgggatttatttgagctaaggaagtatttttaataaatggaattgcatttaatgaataatttaaattaaaaaaggtttttaaagttcttcttttggctttgggccgaaagtcggcccaaaaccttttctctctctcttctggcccagtccgcccgcagccgagccgcttgctcgcgcgcgcgcgtccgcccgctgacaggtggggcccacctgtcaggaccgtcgtctccctcacgccgtcgcctcgccgaaccctagccgagccgcgccgccgtctccttccaaatccggccgcccctttccgtttccaatgaaattagtagaggggaaatgatcttcgggatcttctctacctttttccttttccttttggaatcgatcaccaattcggtttggaaatccgtggattcgagttcgattcggatcgatctctctcctccgaaccatagatttttcctttgcgtcgccggtcgccgtgggccttcgccgccgcctccttgcccctttaaaaggacccccaagcccgctgctacctgccgccaccctcgccttcgcctctcgtcgccggtagagccctagcgccgtgtagcctagcgccgccgttgtcacgaccggaaataacccaacgggcattccttacgtgcgtgcattaatccttgtcccaggaggcaaggtacaccaaaagttgatacaattcagagtataacaagcggaagcgtaaatagttaatttattacaggggaagcgaaggccccgcaaacacaaagacaaacgagaaacagcggaagactagggcgacgaccacaggcgcttgacggcaggcacgagctagacaccgaagccttcatcctcctggaactcctcttctggggttgcgaaaaattgagcaagactgagtacaaccaccgtactcaacaagacacacccacaagtgcagaataaatgcaagggagtacaaaggagttataccataaaggggttagggttgcagtaaatagcatttaaagatatttaattgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacgggcaggcaggactgagcccctagcagcaggacaccggccctgtgccatgacatctcgactaccgagccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcataaaaccatttttggggattttgaatagagggggcggtgtgaatccaattccacaataaccaaaccattccatggtgtccaggtgatatgaatattcccaaagtctagagttgtaaaaccgcctaatgttacctaattaatcagcgaagcatctacctaaaattatactagtggtactatgagtagagtgtccactagttggggttttgtttattctagggtgaacaaggaaataataacaataacaatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaattgggttcttgacttcttaaggaaaaattagagacttgaacggtccaattccgagttcaaatggccaagatatggatatttacgaatttcttcatttaaattttaatttaaaatcggatttattgcgtcagccgaggggagggacacgcggaccgggtccacgggagtggggcccacgcggcagcctcacggtccacggtggaccgggtgcacgcggcttgcgccggccggcgccgtgggtcccacgcgtcagccgcacccgaggacgcgggcggctgacggccgggtcccacatggcagccgcggggcgcgcccgaaggcggcctcgccggcacagccgacgggaggcggcgcgcccgcgccccgatggtcgccggcggcggccatcggcgcggcggagcggcgcccgagagaggggagggaagggggaaacgaaatggcggtcctcggctcaccccgggtcgacggcgacgacgggaacggcgaccgaagcggagagaggcggcggcgcggctcgggtcgacgaggacggcggcgttccggcggtcggcgggcgaaacgaaggggtggacgaggtcgacggggacgcggcgaagccgaaggaggcgatgccgaagcgggaggaggtccggggcgatgacggcggcgaaccgaagctcggcggcgatggcggagagagaggacgacggcgcgagctcgattccgacggggagagaaagcggcaagggtcggaaacggaggagggaggcacggggagtgcttaaatagtgttgggagtgagagagggcggccggaggggaaggaaaccggcgcggcgatctcggctccatcaatgacgccggcgaagtttgcgggaggatttccaaacgaatccgagagagagagagagggaaaagtggggggaaagagggagggaatcacggggagtgatttccccctctttattgcgcgcgggggcggcgggatgcggcggaatccgcggcggcggcggcgctagggcacgggcgacgcggcgggcgcggcgcgaggaaggggatgacgggtgggccccacccgtcaacgagggtggcgggcgggcccgcccgtcagcgacgcgcgcgcgggggaaggccgatgggccgcgggggagaggagagagagagggagggagctgggccgagccggcccaagagaggaagggggggaaggacttttagggatttttctttttataaaacctttttaactttgtttatttcttcttaattattatttgtgctctgaaaactccactaaaatttatttacgcattttaggcttttaggaaatatacaaaaatcctccaagccttatttgacttttaactttgcacattttaattgttggaggctttcacatggattttacttattctatgcacaatttcgaggatgtatcttagagtcgatttgggacgcgacaaacctaccccccttaaacggaatctcgaccccgagattcggaagaacaggcgaagagatcaggatgggctgccttcagctcgtcttcacgctcccaggtagcttcttcctcggcgtggttgctccactggaccttgcaaaaacggattacccggttcctggtcctgcgctccatggtgtccagaattttcactggcctctccacgtaggtcaagtcttcgcgaacttcaatttgctctgggtcagcctgctcagatggcactcggagacatttcttgagttgcgacacatggaacacatcatgcacgttgcccaaggaggcgggcagctccaattggtaagcgacttctccgcgtcgagcaacgatatggaaaggacccacataccgaggtgcgagcttcccttttgtccgaaacctgtgtacacctcgcaatggcgtgacccgaagatatacaaaatcatccactgcgaattccaggtcacggcgacggttatctgcgtaacttttctgccgggactgtgccacctttagattatcccgaatggttctgactttagcttcagcttctctcaggatatcagtcccgaacacttggctttccccaacttgatcccacattagcggtgtccggcatttgcgcccatacaacgcttcataaggtgccatttgtatgctggcttgatagctgttgttgtaggagaactcggcataggggagactcttatcccaggtcttcccgaaatccaggacacatgcgcgaagcatatcttctaggatctgatttagacgctcggtctgcccatctgtctgcgggtgatacgcggtgctgaagtttaatcgggtacccagctcttcttggagcttcttccaaaagtgaaaggtgaattggcttcccctatcagatacgattttcttgggaacgccatggagactcacgatcctagcgaagtagagctcggctagtttgttccctccataggtggtcttcacaggaatgaatcgagctaccttggttaatcgatccaccactacccatatggaatcatatccaccttgggtctttggaagtccggtgatgaaatccatcccaatttcatcccattttcattcaggtacttggagaggttggagaagtccggccggtcgttggtgctctgccttgacacgctggcacacatcacaaagggccacgaactctgtaatttcccgcttcatactaacccaccagtatttctctttcaagtctaagtacatcttcgtgctgccagggtggatggaataaggactttcgtgagcttcctgaagtatcaactgtttaagttctctgttatctggaacgcatactcgagttccgttccatagggttccgtgttcatcctctgtgaaaccagcggctttaccctatttcatattcttgaggagtccatgcatgtctggatcattcttctgagcctcgcggatttgatcgagcaaggtgggcttggcttccagcgcagccaagaatccgcgactaactatgcttaggttcagggcttccatctgttgattaagttcgggtggaatgccacggacgttaagagtgttgcaatggctttttcgacttagagcgtcggcaaccacgttggccttaccaggatgatagtgaattcccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccaccgcggctaactccaaatcatgggtatggtagttgccttcatgaggccgtagctggcgtgaggcataggctaccacataccttccagcatgagcacgcaccccaatctttggcgcgaagcatcacagcacaccatgaagtccttgcgagtatccggtaagattaaaactggcaaggaaaccagcttttccttgagagtttggaacgccttcttgcattgcgggctccacacaaatttttcctctttcttcaacaactgtgtcatgggtcgagcgattttggagaagttttcgatgaacctccggtagtatcctgccaaacccaaaaagttgcgaacctgagtaactgtcttgggttgcttccaatcagtgacagcggtcactgtttcggggtccaccgcaactcctttagcagatatcacgtgccctaagaatttgacttcggacaacaagaactcacacttgctaagcttggcatacaattgatgttcccgtaactttcccaacaccagacggagatgctgttgatggtcttcatctgattgtgagtacaccagaatgtcgtcaatgaaaaccacaacaaacttatccaagtactccatgaacactttgttcattaagttcatgaagaaggcaggagcattggttagaccgaacgacatcaccgtgaattcatacagtccataacgcgtggtgaatgcggtcttcggaatatcttcttcgcgaatacgtaattggtgatatccggaacgaagatccattttggaaaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacgggagcaccccagggggaagtgctcggacgtatataccccttttctttcaactcttccagccgtttcttgacttcggccagttcatttgctgccatacggtagggtcgcttgtacagaggagtggttcctggagcaagatctatccggaactcaatctctcgcttaggcggcataccaggtagttcttccggaaacacgtctccgaactctctgacgatggggatttctgacagtcctatctgatgaagttccgaacttctgactgaggttgggggtgcaaagaaaacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaatcccctgaatttctatagggacggcaggactataatacttcgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcatgtcctcggccgtcacgtggttcacacgaccccgaatgacgtccttaccaccgttgttggggcggggaggcgcttggccttgctggcgcctcggctttgggcatttatccgcaaagtgccccggctcgaagcagttgaagcacagacgctgctgaccttgaacgtctctacggctcttgaccaggctgcacaacgggcgcaggaggacggggcgcacgggtctcttgctgactctgctgtgctgcggctgtgggacgcgcaccacgaattgaggtcggggcgcaaagcgtggttgctgctgctgctgcgaggaggatccccctggatagggattggtgtagcggaccctttggttagccccctgttgattgcggaaattcgccaagcgacgcttgtgcgactccagttccttgtgcttggcttccaagcggatgctcttgtccaccagacgttgaaaatccggatagtccccggagactggacgcacggacagctcaaggtccattcctgccaggaacttctcttgcttctcctcatcttcccgaacatcctccggggcgtaccgggccaggttgttgaactcatgcaaatactccatcacggagcggttgccttgcttcaactctcggaattcccttttcttaagggccacgactccggcgggcacatgggttcttcggaaagcggcggtgaagcgagcccatgtaataggctgtccctctggctgcgtagcctggaaatgatcccaccatagagatgcgggtccctgcagctagtgggcggcgaagatgactttctcctcatcgctgcactgcacagtgtctagctttttccccacggcatgcaaccaatccaacgcatccacggggttgttggagctagagaaggtaggtgggcggatgcggagaaactcggcgagtttagagtgttggggaggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggttgccctgatggttgtggttgctgccttcaggttggttgccatcaccggtgttagcacttctcctggtcatcaccatctgaaaaccccacacagaaccagcaaacagagagagctgacaattaaagctaaccacccacgactaccataattcttaaatttattactgctattaaattggttcattaaagttcaagttgcttaggcaaataaaataaagacaggctccgacacagttacaccacacaccggcataaccgtgccccacacaacccaacaagaagacaaacgagaaagaacacatgcgcaagcctactaactgctcgtctactgctgcgatgggccacgacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttttggctgcggcagacgcggcgacgcttggggcggcagatctctccctgggcgatcttgagctgatgcagctgcgcctccactgcgttgtcgcgaccgggaaaattgccttttcccgaacgctagtgtattaatccccgtcccaggaaaagccggggtacaccatacaaacatgatataaaagacacatctttattacatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggcagatgcatgattaatgcaagggggtacaaggggataataatataggggttaagttttgcagtaaacagcatttaaaagtcacttagttgcccaaagccattttataaagacaatcctagagctatacagtattattaatcacggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaggcccgagcttaatccttatagtggtagggtgctacttcccacaactggcatgcacccaaaccccaccgaaaacaggtttttaggggttttgaaagaggaagagaggtgtatgtccaattccaccataaaccaacaattccatagtgtccaaatgatatgagacttcccaaagtctaaagttataaaaccacctaatgttgcctaattaaccagcgaagcatctacctaagttcatactagtggaaccataaatagagtactcactagttggggttttgtttaacctagggtgaacaaagtaataataacaataacaataataataaggtcataacaaaggtaaataggtatggctagataaaacagtgataacgcgggaatttaaataaagcggtaatgcaataatttaaatcaacataattttacaaactgggattcaatatgatcaaggatgatgtgacttgccttgctcgctttcccaaacgacggcttcgacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaaactcattattgcgtcagccgagggagagggcgcgcggaccgggtccacaggagtggggcccacgcgtcagcctctcggtccacggtggaccgggagcacgcggctggcggcggtcggtgccgtgggtcccacgcgtcagccgcacccgcgggcgcgggcggctgacggccgggcccacctggcagccgcggggcgcgcccgaaggcggcctcgccggcgcggccgacgggaggcggcgcacccgcgccccgatggtcaccgccggcgaccatcggcgcggcggagcagcgcccgagagagcggagaggagagggaagcgaaagggacggtccacggctcaccccgagacacgaggacggcggagacgacgaacggagcggaggaacgcggcggcgcggttcgcgatgacgagggcgacggtgctccggcggtcggcgggcgaaacgaaggagcggacggggtcgacgacgacgcggcgaagccgacggaggtggcgccgagtcgggagggagcccggagcgacgtcggcggcgtaccggaggtcggcggcgacggcggagagagaggtggacgtcgcgagcacgaatccgacggcgagagcaagcggcgaacggcggaaacggaggagggaggcacggggagcaaatatatagcgccgagagggggagagcgcggccggagagggaggaaacggccgcggagatctcggccgccattgattgcgccggcgagggtttcgggaatgaaatcggacgaatccgagggagagagagagggaaaagagggggaaacgggagagggaattgcggggagtaattcgcccctctttatggcgcgcggggaaggcgggatgcggcggattcgacggcggcggcggcgctagggcacgggcggcggcgggcgcggcgcgaggaaggcgatgacaggtgggccccacccgtcagcgagggtggcgggcgggcccgcctgtcagtggcgcgcgcgcggggaagggccgatgggccgcggggagaggagagagagggagggagagttgggccgagccggcccaagaagggaaggggggggaaaagacttttagggatttttctttttataaaaccttttcaactttgtttatttcttctcaattattatttgtgctctgaaaattccactaaaatttgagggctccttttagaccaaggagaatttaacaaaaattctccgggtcacatttgaatttttcttgtacgtattttagtgtttgccaatttcttttcgaattttaattaattctattattccttttagagaatgatttttaa

SEQ ID NO: 1046 - DNA, 7007 bp, Oryza sativa
atgaatttatcaggacgtgacatgcgtccaggtccttcttgagctgcaggttctcctgacgcagctccaggatcttcaggttgttctcgaccatcccacggcgcaccatctgatggaagtcgatacgagccgcgtcgtacgcctccaccatgcgcgccaagtgcacaatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcagcgaagtccgctcgggagagccagcgaggatcactgcagtgacctcccaagcagcgtggggctctgcatcgtcaccctcctgctccggaagcggcctgggtatggttgttcaggatggttgggcctgagcagcatgggtgtgctgtttagtgttgattaaaattgatgattaattactctacagttttataattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaggagatctacagtgatgctgatggtgtggaggattaggtgtagccctggtcaagctgcctgtggagtggagtcgtctgcgccgtttatcttatttttccgctggttagatctttattgattgagaggaactatctacctctgtaatgacattttattcgcttattaattagagtaataattgtactctattatcaatttgttattgtgtgcctcggctgattcctggacgagggttcacacacatgtaagcatttggaattttggatagaaattccgggcgtgacaatattgataatgcttgtaatgaggaagagttgtgcaatgcttcacttaaatacatgccacaactagtgaaagaacacgttacttctatttctgaatatttggtttccactcaaaataaacgtgtctttgttattgctgatgaccaagaagatctgcaattattgtcttctttgtgtactttgggttatatcgaatttgatgttctttgtgatctaaataacttagagaagaaaatttatgattttccatgttattcttggaacaattatcatgtcattggtaaatataataatagaggatgttatatggtacatcgtgtttatatatgtttagatatgaatcctcctttaaatatgaaaaaatatgagacaccaaatgaatcgtacaatgttgatgctattggaataaattcacctaacgttgttctaaatatcgatgacaatattcaaggctcgctatcattttaagacatattcattcagtaggttgagttggtttcctcgtgatgtaaattggatttataaggattgcttgtttgctattttttcagttgatctttcctatgacgacaattgcaataagaaaccgaggacggtttccaaacaagaaggggatgatgatatgaccatcaagtatatgcatacatccaagcatgagaaatataaaacatagccaaagaatacaacgagtgaatggaggatctacaagatattaaagtccaatgagttttggcatccaattctgcctccggagacatcactgacttcaaacggacctagcgccttcatgccaatccgatttgggtgatcttggacttcgtggaaagcttatctcgctacctttcaaatgcatccagtctcctgtccaaattcatctcgagtcaacgggaatcgccaaaataagacagtgctattgctgaaaccgaacttgggctttgggccttgtaataggctaggcctatcttggaagtgtctccctccacctccactaattagcacataaccctagctttgtttttctctataaatagctttgtacatcctcaaaagcaattgggttttgtttagttgaattttgccaagtgtcattcaccttgtctctagtcctcgctcgattagtcggcgactattgatttagagccctcaatagttggtgtgatgatttgccgggtcgattggatctaccacttcaatcgcaactattcctttgtgcttaatcacctattcgcaatatttagattgcatattatcttgttcttgcagtgttctctcctttgcattacagggatcatcaaccgcgcatcacggttggtacgacatcgtttgtggtgtagcgattgcatggcgtcccagacttgttctggttggtagccacgtcgcaaacgtcgcacttcgatcaaagcgagatttatccccctcaccagaagattggaccacgagagagagcgtcatctcgtgctgtctagattacgggatatcattatttggggttatatgctgcggatgagaggtgggccgctgatggtgacagctcagtacgggtattcctccacgcgtgtatataatcctatgttaattccctggggagggtattcctccgtatttaaccccggttgtatggtcatgacgggctgtcgtaaggaactcggcagttaggggtggcttctcgaagtaccaggagggcatcggatagagagtattagctagtatatcagttaactagaatgtatgtatactatgtatactagaagtataggaatagattttttttctcttttctttccacttagcttagataatttagtatgagaatgagtagcttaatgtttgtgtgtcaccctacccttggattatcttaacccctgcttaggatatgattattacaagtaatatataaattattagtcaagttctctctacatgatcttcccacgggataaaataaatacgatacccttggaatactctcgggtgaaatgctacaatggtatatccgtgcgcttgcggatgaactctgtaaccataatataccaggagtatttctgcgccattgcagggaattatatttctagtaatgtcattaagaaataccaacaccgcctcaaccctttcggtcctagaggtttgtgcctccaccgactcgattctcctggcgagggccacggcttgtgccgaagcacttccccctgtcggcgcttcggcatcgctagcaggcggtggcgaaaggtgcctccttcgggcacaatgcgccgcggcgcaggcgaagtgggtgtaccatcagaagaaccttcgctgtcggtaaagccaccgtgatttgcaccacccctccattcttctttctagcgatcgccttttgtttcgccgcgaagctggaaatcgccaaaagcgtgttcgcgccagcaacatcttgcgcatgtacgagcgaaacatgagagctcactccagctttcacccgaattgggctgggggtatagccgtgcgacccaccgttttcatcgaacgcggcctctttttcgtcctcgtcctcatcgtccgcgtcggtgtcggccgcgtccttggtggagcgacgggttcgcccctggccacacttcgcaatgggccgcttgcgcttcttcgtcatcggtgaccttgaaggtgatcgatcggctagccaactcgccgacataaacttggttcaccctcccatcggcttgatgttggagcaagcggccgaattcggcggtggtcagacttccgaccatcttcgtcgcctccgcctcagcatgttccaatatccggactggacaaaaagggagtaagtcgaaacatatctacacacccagaaaaacggtgtgggaaggtaaaagaactcacgttcggcgccagggggaagaatgaggtgggggaagcccaagaaccttttcatcctcactaacacacaccccccattcgagggcgagcggagagatccgaagtaggcaaaactcttcacaaaggtcgtgggtacttagccgtcatgcaaccttgcaaagaagaatgagccgggactcgagtgtgccatcgacctccatgttcggcttagcgatgatagagatagcaagacgccgaaacctaagccagttcaccttaccatcctcgatggagtaaggattgtcgatgtagaaccacttctgcaaccagttgcggtcccactttgccatcgacacaggcaccgggcatgcatccgagcgctccggcgaagcatgaagttgacgcagccgaaaaccgttttctttgtccaagctggtgtgttcaagtccttggttgtggcacacgtcgtaaacaagacagcgaacaattcggcggtagggtcgaaaccgcacgtacagcacatccatgcgaagacgaccagcttcgggaacgctgacggactgagctggggacgctttgcctcgtacatctccagtacagaggggaggaaatcatcgcacggaaggcgaagtccagcggtgaggaaggcggcgaaaataaccgttcgcctgtcgccgggcgaagggataatggcttcacccccacaagtcacctggccctctacaagagcgccggagaggacgaattcggccaagttagactccttgacaagggacttgccaaggtagcacgaccacccttcaccgaggttgcaggggtcttcaccggttgacccggccttagtgggtttgcgaggggccattgaatccgtggcgaaagaagagcctaagggcgaaagggagcgagaaagtcgaggaagcaagcgcaggagcgtagcggtggcaaaaagctagaacgcaagcaaaggcaaggtgcacggagcacaactgcagtgaaagtgaaaagcgggggggggggagaagcggtaacccgggggggttatataaccacatcgcgcgacggttcaactaccagccaatcaggacccgacacatgtccgggggtagacaaaacggtaaattcccaccgggccaaggccaaacagtaaaaggccgaacgcaagaacagcaaggcccatggagcccattactattcagagtagtttaaagagcagcctagccccttcgccactaattggtgaacgcaggaagaaattttttcctcaaggatttttttaacacgagaacaagttatttgctttgcaggcgcataacataggtttcggcaagaccatcggccgaaaggggcgcctcgtggtataccatacgttttgcatggtctcggccgaagctccctactcacccttgcctatgaggggcttgttggaggtacaccacggggacattcggtcggacctaccgaaacccacaacttaggcgacaggcttagaccggaggcaaacggcgcaggtcgagaaggcaaccatatgggcgaaagccatggctcggaaaatgctgacttcgccaagcgaagacctcgtcaaagggccgcacaggcgaagatggtgaggcgaaagccttagcatgaaggcacgggtttcgccaagtaccgaacctcgccgtcaggaggcccagcaggccgctacgccttcggggaatttcgacaaatagatgggccaagccatttaagcccaataggggcccatacatgtaaaaaacattgtgtgcccccaataatgtccctatcataagggtaaccatgtaaatttccctgtaaaacctaaaccctaaagggggagcctgtaataggattataaatagccccctaaggccatgtaatacgggatccaaaaaattttactaagtaatgcaattgtctttcttttccaaccactgttgagataaccacgcctttcgacgtgacgcagttgtccattcgacaacaataatcatagctaattctctattattttagttatatttatggtcaaaatttgtctataacgaccatcaacaattatctacccttgccaaatcatgaaaaagagagagtttaggtattcatctactttcaagaggaaggaggaaggaaaactgatttgcagtagtaccaagggaggcagaggggagcaagctgcgagacgaggtggagtgtaccgtgcgcgatgagccggcaccaccgagaagcgatcaacggtgaactgcgacctgcccatagggcgacgagatgacagtgggctcgctttccgttccctgattcctaatttgccgagctaatttgcgggattaacgcctgattcctaatttgccgagctaatttgcgggattaacgagaggatggtagtggatgttcgacgcctcaagtcctcaacacccgcgtggattcgatgcaaggaacaaaaactaggagagtggggtcctcttatctgttgaactgggggcccatatgtcatacaattagtgatatacctgccagtattttatgagtggggtctagggcccccacaccttgtatggtaaatccgtccctgctgatgtattcagtacatactataagagtaaaaactgatactaatagtattattaatctgtatcacaaaatggtcgtatgaatgaaaaaattacaggctcaatcacacacaagtgataaaaaatagtcacaggtgaatcaaactagaaaagaaaaaatgacttagccaaaaatccatcatgaaactaggatccggatggctttgctggatcttgctataaggatggagaggctggtccgtgtcttgtgacaggtagtgaagagggcaaccggatggcaagtggtagtcgacgatggaatcatggaagggtgtagcggcatggtatagagatgggcgcaatgttgtgcagtagcagacatccatcatctagcaagcacgaaaaaaatacaaaaacattctcgttcatgtcatagatatgacgagtaaaagaaaaatagcaaacaacctccatcaccggcggacttcaccctatcctctgcagccagccacatggagcacgatgtgcaaatataagacctttgcagcccatcaattcagatcaagtaatattggaagtaatattggagattgcacgttaatttgatttgcaaaaagaaattggggcttcatgcatgaaggtaaaggagagtatgcatat

SEQ ID NO: 1047 - DNA, 23591 bp, Oryza sativa
cataagatcacgtacttcctctcaacccagccccttaacaaatctttaattatatgggcatgacccgttataaagcacggccatattattatcaagtgtttggctgtagtcggatgttggggtatattattattaagttttccaaaacgtatttaaaaaaatgctgttgaatgactagttagttaatgggaggtgaaagaaagaacatgagagagagagggggggaatgctgctactctagtagtaggagtagctaacaaccaagaggatgccatgtccttgttgcagggacagtggtggtaaggtaagaaatgcagcagtataagcagtaagcactccactcactcaccaaaagcagaaaaagaaagaaagaaagaaagaaaagggacaaggagattaactaagacacaccccacctacacactcttcttcctcctcattcaacaggatttttttaaatacgttttggaaaacttggattctattttactcctgtataaaatggcagtatattcaataatgtggcaattcaaaacatacctgtacgttgccaattgagacaaaaaagattcaatatgcctactagttacagcttgggctctaattttaaattttcgaatttaatttagggttttttttcaccgatttcatgagcatatgcctttagcttatataaaaatgcctccagcaaatgaaacgcgtcattaaaatcaagttactaccctcgttcattaaggataactaatgaaagtggttatctcttctagtgtcggatcgtattcctggttaatgaaaggggtgttgaatctaaaacacaacatgttttggatgactaaattaattaggaaaaaagtccaaacacccccccccccctaaattcccatggaagtccatctagcacccccaactttaaaactggatatccaacctctgaactttggcataccatccatattacaccataaggtggttttgaatgatggttttgcatattttgaaagcttaaacgaacaattttgaataactaatataacatatttgcatatcatcagttataagtcatcaatttatcctgatatagtgatatcctgctattattatgttggtatttgtttgtaagtgagagctaataagaagtggaaagaatgatttaagtcaaaattttaatatatatgtccaaagtgtataacatatgatcaaactcatctaacttatatataaattagataaaatccactatgtaaaaccaccttaggaggttatataaacggtattgtaaagttcagcgagttaaatgtttggtttcagagttgagagtgttaaacggacttccatccaaaatttagagggttatttggactttttccaattaattaactactacaagttccccctttttccttctgctattgttaacgaattttcaaaaaatatagatctcatttcagatcttttgatggtgccatctgtttattcattttaaaatattttcttcaaagcatactagacgaatttggaagacatgtttggtgcattgcaactaaggcaatgaataactagaaattaataacaaaatatggtaaaggtagtgaataatgataagggacaaaaaaaataaattaaataatgtacatatttatatcaccatctataacaatgcaaaatatatatttttagctgacgtaaacaaatatggattaaatttgtagtacgaatatgaaatggtttttatggagtaattgttttgcagctcagtctgttactctgtcatgtgtatttatgcaaatgtagatcaggtattgtttaaacagtcacggttgcctgaagttgaatttttccagcaaaatacaccaaaaattatgtatgcatgcagttttatgtaccaaacaaataagaacagaaataattggttgcagaagtcatattgaaccacaagtgaattgaattaagttatatacaaccaactgtttcttttctgacactaaaattaagagggaggtagcttgggcctgataaataattaagctgtgcacaaaatagggcccattatcctaccgatcgagaagaatctatctgtcccaatttctttcatggagagagagagagagagaagatgaacctctctctgcaattgcaatactaatttcgatctctttttaacgtcatgtccgcgccgaccaatttggcaatcattagcaccattagcgtaatacaacacccacggcgcaatgtcctcgcgtctgatcgccgattaaaaacacaataaagtcaccacctcatggaaaacacatataataaagccaataaataaatattttgtgatcaagggagtcagttaattataaatgtgccctgaagaataacattaggtgaactgtctaagagggtgctatgatcgacatattctttggtatcttgtggttgatgtggtggttaacaggttatcagtactagctaattaattaacaattgttaactgcaccggccgttgttaattaggtctagcctcttttgaccattcaaaccgtcttactagtgtcaatgtacgagtatatagtagcaactaattaaacttacatttcttcaactgattttgtatatgtcgccactgtcccttttcacaaggaatacaataagaaaatgttgtagaatctaacgagatgttgttagtgatgaggttgaatataatatacattataagaagatgcagttaattataagataatgtgggactaataatggtttttcagtctcttaaagattcccggggatataggtttggaatggagcagatgggcccatcaaatgattaccaagttgagatcgaatctcgactttaggcgccttcctgaacaaatccattcaacaaccacaaataaaacaactatataacgaagtgacggctgatgttgatccaagcttaccgacgaagcatataaatgttttttaggcaaacctaattaatttattataagcgggataacaattcacatctgatctatataacgttctgcacatctcaaaatacaagcttgatatatagtgagcatgatccgtcccaagttatgcgcttgttgctataccttaccgtaaataataaaccctgcaaaaataatctctaaaattatagaaacacataaatttaagaaaagtattcaaaaaacaagtaggaccagtactgagacaaacttttattattaaaatttaataaatcctttacacataactatttacgagtgctgaatctgtaatattggaaacaacactacaccagattctcacacctgtgacggcatatatgtgacgggcatgagtgttggtcagtgatgagggtcacctttgacgggtcctatgggatgccgtcatcggtgagccatcatgcggcgactcgtcacaggtaagcagtcacctgagacgggtcaaaaatggaacccgtcaaaggtgaggtaaagtcacctatgacgggccaaataaaaatatttttgacccgtcataggtgactgcttatctgtacatatgaggttcacatgtgatgtgagtacccgtcaaagatgataaaaaaattcgctctcattaaccccccccccctctcctccctgctcatcacgatcttatcctcttctctctctctctcccctcaacccttcttctctgagcgggcgtgcgggccggagggggaggtggcaccagcaggtgcacgcgggcacgcgggtcggagggagaggcggcaccggcgtgcgcggcccggagggggaggcggcaccggcgggggcgcgggtcgaaggcgaaggcggcaccggcggcacctccccccgcctcccggccgccaacgccatagacgcctccctcacctccgtcaccgaccacgctagccacaggatccggcctccacgaggccgggggcacgcagatctgtacaccaagtaccgcctcctccatccccacccaccgtccacctcggtgaggtttcttcttctcgttgtttttttacttaaatcttcttcttgttgttgttgttcatttgaggtgtttggtttgaggatgtaggctctaatggttgtttcttgcagcagaggagtgcctcttcgagatcctccgtcggccagtgtgccccttctatgaatgagatgatattgttgtatgataagttcttgccatccccttttgtgaatgattgctatatgagatctatcagtttgaagttttttgatggtgatgaatgtgactgtgatgagatatatcagtttgaagtttttgtgatggtgacgactgtgactgcgatgagcaaaccaccatagcagtgtgctccaattttcttgctagggttttcatacctgtgacgggctgcaatctatttttctttttttttggctgggttatagacatcactgacggctcacaaataatgggctatttgagataatagttacctgtgacgggttctatacatggcccgtcacaggggctggtcaccactaacgggcattcacccgtcaaaggtgagcagagtcatcactgaccactaatctctgacgaggggccgaatccgtcagaggtgatggtttaggcccgtcacaggtagcgtgatctggcatagtgtaagtacttaagtcccctttcaacttgatttctattagggcacgcacaacggcaattaatactaggcttttagagttgttaacaatgtatatttgctaatatgagagagagcgaaaaagagagaaatatcgatgttacggttaacatagactcttagtgtttataaaagaaaacgttgttccatgccgatggatcggagaaaagaaaaaatataataaaaaatgttttagtgcattaatttttagtcttttatcgtctcaattgtattgtcattaatcaccaaaataaacttaagtgcatagattgattttcacttagaacatgtccttatctcaattattttcagcacatctaaaaaaaattatgcatcagcttgcctaattcttttaagatcttttattattacactttccagtttaatatgatgtataaggaaaaattttagagattagctaaaaaactgtcgagtgctttttaagggggaaactttcaaatctagctatagtatataatttcactacaactatactataataataataacttatatatatattaaaataatatatgcaactttatatctaatttatatagagataacaatgtagtatgtagttatagtgtagttacactatagttacaatgtaattacaatgtaactacaatgtaactacagtgtaactgcaatgcaacaagcatgttactagaatgtaacttagatgtaacttgaacagatctaccataaacatgtgatgatgggactagcttgtgaaaagaggatttagatccgatagcaaaatatctcagcacaaatcttagcgtgaaatcaacggcaaaaaaaaaatgacagtttttagtcctgaaaactgtcacagttagctagcaaaaccgaaaattttattgtactctcccaaactattatattcttccatatcctcataaactactattttttgcctcagttgtactttaagttgaattttctctttaggataaactttatcttgagatttttaatcatttttttcacatgctagaaggagacttatttaaatcaaggggagcgggggtttctaaaacaacaccaagctgccatgacaactttaaaaaatattgttctaatgtaggatatacttggtcatataggatctataaaatttcaacttaaaacatatcaaggagaaaaatatatgtcccagtttaggggtacttttaagtagtgttggaggtaaaatgagataaaaatatatattttaaaaagtcaaaacaatttttttgtctttaaataacttttggtatctcaaaacttatagcaagtactgtggacatctaattacatatccctacatgacacatagaattaaatggtgaggtgaagggtagcagagaggagtgggagaaatagagtcacctctcatgtaagaggcacgctctacacaaaatcaaaaactgaaaatgaatagagtagttcttgtgtattagataattaaataactattgtgtatgcaattgtattgggtacaaatgcataattaaaaaaaactatattgtgaattggagttgtatattatatgtagcggtagtgtattgtatatgttacagtagatgatatggataaaattagaggcaacaattatctctactataaataaaacttcttactgaggtagctcagtgtttcatttgtctcatggtgcaattttaataacactaggatcacttcatcacctgcattaattggaagtacaaggacagataggcatgatcgatgaactacatcaataacgataatatagaacactctccatctctaacgtgtaattagcagctgcgctctacctagctgcgacgtgcacaccaagatcacctagccacccaacacctaaagtatgggcacaagcaactggccggatccaacgagatatcgatccacttttccttataccaactactacgtcgacgttcaatattcatctcctacgtcacgaaaaggcgaaaacgtaaccccaccatacatgcatgtaatagctatggagatcccattagcggcgcctcaaaccggtacggacacgactaatagctttgaaacaaaactagctagaaactacttggccggtggcacttttgctccactttattgaccttgaaaagcatgttgctttcgctgcttttctttgcatgatgttagttcagcgcacaaggtagctatagctactcgtatagttatcgtttcttactttcttaatttgcatgcatgagatcaacatatagttatattttatgctctgtcccctgcatatgtgtaggacacttgattacttaaagcttaatttggtggttacattagttaatttccaaagtgaacgggaaaaggaaacgattctgatgcgtactataagagcggcgggaaagataatgaatttgtatgtatatgtacccaccaactttagtacttctcatccgtccgataacaaacaaatctaacaactacaggatatgaatctggattagttacattatgtatcatgtttattttttatatataagactaataattcgtcgtgcatgagttatagcctggcatctatctatggtaagagatgcctatatttctgaagtggttaatttatgttgtttgagctttctgacaaggaattccaaggatcccataaaacccattaattaaacgagattttagagttgctagaatgtgttgtttataggggattgactcaagcttgggccaaggtttcgaccaggccaccctatttggcccatattactattaccttgagggaaaattaatttcagcccattaatccttgggccctggtgtcccaatccatgcagcaattgaagcaaaaagtacaccgaaggtccctcaacttgtcatcgagttacaaaatcgtcccccaaccgcaaaaccagataaccggcgtcccttaactaatcaaaaccggttacaatagatccttcggtggttttgaccccggttttgtcctacgtggtggctgaatcagtgtgggacccacgtgggccccacatgtcaggatgccacgtcatctctctcctccctcttctcttcctcagttccacctatctctctccgatgccgataccagccgatagcaatagagtttaagcaatcggctatatatccaatgtagatgatgatataaaggcaatcggttgatgatgatgtaataaaataacaatataatccagtataaaccaatcggtaaatagtgatatgataaataagcatcgatccgaaggttaaagcacacatcggctgaaggtccaatgtcatgaaatccacaagattagattaaacagtgaaacatttgttgtcatcggctaaatccaacttatatgtatatgcaatcctcatgagccgatgcaacgtccagataactcaccggctgaaactccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatctagcaacgcaatttagccgataccggcagaaaccctaaaatgagaagcagttgatagagctaaactgatatgctaagactagattaacagagacatatgataaatagttaggcaaatataggatccaaaccagagcaatcgaagaggtcgaatgtactgatgcagccttgaacaacgccgacgtaaacgatacaattgtctgggccggcggaacattggacttaccccttagccggagatcgaacaccgatgcagccccgcgtcaggtgccaagtcacgctggacgataaaataaagtaaaaaaggtaaaaggtggcgatgcgccgaattatattgatcgtgaagatagattacatagaccctgggtgtacatatttatacccatgggttgatacaagtccttatcagacaagaaagaaactttcctaaagataaaaggaaaagataaagtccttatcggacactaaacacactttcctaaagataaaaggaaactaacaaactattcctaattaatggataacttgccatgccgcattctctttgaactcggtctcttctggataagattcctttagtagatcaatttccttaaccgaatatagcaagaatccgacaactgacgacttgacaaatctcatcggctaatttcaggacttcaaagccgatgctgactctaagccgatgactactccgggcttaccaaatttcactgttaacagcgcgttagctgtccccctagatttctcctatcttataaaccgatttcagggtcagatcccaggcttctaattgggccacatggcatctcttgtggagctctcctcctgattcttggttgtagaaagtgccacgtatacgcacctatccacagccgttagatgacgtatcgatggtgaaaaaccgtcctgtggacctaaatgtaaattacaagttatgagaggggtttttgtacaaacgtgcgatctcatctagaaaagttcgaagtattggagaaaaaaatcccagaaaacaattgcaagaaaaaatagattaatatctccatctccctactcacagtgccgcaggctgccgccggcacggtgtcacctgttttgggcgatgaggagaaggagggggcgatggctgctcgatctacgcggccggatccacggacacactatacaggtacacaagaacatcaagaatgcattagcagcaccaaccagcacgtatcttcagcaacagaaggcaagcatcttcgggagtggatctgtggagggacaagagaatacagccgagtcgggagatgcacgggcgcagtcggcactcgtgcggggaagccggggatgcgccggcgacggtcacctcctcggtccaggtctccgtcgggggatcgagatgagggagcgccgtagcggtgctgcggtgggtgcgctagatgcatccgtgtatgccgctatggctgggagtgtggaagttgtcttcccaaacgagaggcgatgtagaaagcaatggtggtgagttggtgacttgggtagagaggataccaatagaaagagagtacgtaatgaaacgtggaatgcatgcaggatccatcgcactgagttagcactctttttttggaaaaaaaaatctggtgcaaaccagatgcaaacagcagtccgtgcagccccgatgcggatgcatgacgcgtggatgaggcgctcatccgacggccggcccacacaagcgagtccgcatcctgcacggctcgactcaggtcgttctccctcagctcgacttgcgcggctcaggattacattgggtagggcgtgattagaggcggacgattagagcaaaacagattcgctacatggcaggacgaggagtccagcagaagagcacaggcgccgccgggcttctggtgccgtcgtctgatctggtgcagcctttgcctgccgtagcgcacgacatggcaggacaatcttcacatgaacacgatgtaatcgttggggatcgtggagccgatggcaagcagagaacgcaggtacattgcctagctaattgactcatgctttttcatcagtacatgcatgcatgatcgtgagtgatcgtcttacatgccctcatcgcaaatactgatgtgtggcttatacgtaccgatgtgtgatcatatcgtgcatgatcatcttgcacagatctccgagtttatgaccatggaagaagatgttgccggcgctatcgatgccaacgctaatggtgatgacaacacactctgtcgcatagtacctgaagagatggcagataaagcaccaaatcaggtaacgataatttaatagcaaattcgatggaaaacagaatatctcatactgtggtaatataactcatttatcgtacaacaggccaatgataaagttgcacaaactttgatcttgcctcaagttggaatggcttttgattcaaagcagaaagcgtatgatatgtacaacacctatgccgggaagattgggttcagtattagaaagagccaagcaaagcaccgagtcgatggaactatatactagaaatatatagtttgtagtaaccaaggacaacgatagactaagtcatcactagacactactaggacgagttgtgatgcttgtgttcagtttagtacgagtccattggtatgtatgcacactttaaatcgcattataatttttttatacaaacatctgaaaaaatggcatccacatcttataggtatattgtgcaagcatgcccttagagtcttcaatatgaatgaagttttcactatgccatctcaatatctactcaacaggtggacaaaatatgcgaaaaaaggatttaatattgataaacaaggaagtgagaaggaaactttgaaaacacatgctgcacgtatctctcgaaaggcaacatccatcgctttgaaatgttcagtttcgaaagaacttcttgatgatttggagaaagccataaataatttggacttggaggcagatagttctctaagcaagatgaaagaaaaaacatgtgaggttcctctaaattcaaatgactgtgttatggacacattaaatggtgcaatatcaattagagttcctcgattggtcaaaggcccaaagagtagatgatcaaaagatgcagttgaaaagaagaaacggaagaaaacaaaaactgctaagaataaaggtgctgatcctacccattccggcatgtttattcccattgtatgcttgtataattaatttttttatactcagatattttgtatgtttgaactatataggagaagatctaaataatgcatcagaagatgaagatgaagatgttggtgatgtgtgtgggcaatcttcgaccatggatgcaaatgatgtgtgtgggcaatcctcgaccatggctgcatatgatgtgtatgggcaatcctcgacaatggctgcatatgatgggtttgggcaatcctcgaccatggatgctcctttaatccaaggcggatttacaagtcttttatttggagttcagcaagattcggccatggctgctagaaagttacatttcaattaatagcatttggctcaacctacaatgagtaggctttttttgaatagattttcattttgcatcgtgttacactaaactatcattgacgctgtcagttctatccatgaatttggtagctatgtatgagatatgaattatctacattgtttctgaaagaccagcttctagacatcacattctagatttgaacttcaggatttcagatcacacaatatttcattttatttttgaaaggaatcagatgaataatcaaaattttcaatgcatcaatcacattgcagatttcagaacatccaacatgccatatgtatttcaaataaaagaaatacattgtacagattacatagcgatctgagtttccttgcaatttgaccaaaaatgcggtccaaacttacagcatctggactacaatccttgcatactcctaagagtgtacagactacattgtatggattaacagcgaaggctacattcatcaaactacaatccttttagcaccatccacttctgcctgctgcatttacaatccttttaggcaatcaattttcctcttttgtattttgcacaaggttacaatagttctcaggataacttgacatctggcaaaactagttctcaggatacaaggtgttctgaatctttacaaactcctaatagtgtatatactacatagtaggaattacaaagaaaggctacattcattatcttgtcattgattgttctatgtcacttcttcagcatcctctcgttcatgctcttccaatcttcaattgccattcatgccgcaccccatatatctcacctgcaattctgcattggcctcaagttgccagctgccaagtgtgccaagaacaaatatctgatttttgcaactgattgtgctgccatgtagtgcatataaaagaaaaaagagagaaaccaaatgtggttcagttcagatttggctctgtcttgtagtgacagaaaaagagaagccaccaggtggttcagttcagatttgtcagggggaagccaaagccttatgtttctctagttgtttcaactattttcagtggaagtgtcacagctgaatatacaacatgcaacatatcttactcctccactatgcaatttattcagtgtgatactcaagtttcagatttttgcctgttttctggtgacctattcctagtcaattttgatgtgagcctactaccccactttgcaaaatgtccaacaattttactgatatgatgattggtcggccaggcaccgagcgagttgccaagacagaatgtatgttttgtttatgcaaaacaaaaaccgattgtctcaaactagtactaattaacactatcaagctgcaatgatagatgctaggcttactacctaatcacatgaaaaccaaaactgagcaatcaaaccagaatctagtgaccatgattaactaccgcaatgaaaaccaaaaccgagcaatcaaactatgaaactcccaatgcacgggagggtgccgcctggcccttccaccgtcgctaccctgctccaggcatgggagggcaccgccactgccctgctctaggcacgggagggcgccaccactgccctagctgtccgagggagccgccgccgcattccgtctccacgcgcccaacagcggatgagaaaggggcgacgggataagaaacaggcggaggggaacgatgactgcatctcggactagatcgacccgatcggagcgagcgcgagccgagttgtggtgtgttgagatcgctcttgagctgagctgagattgaggtgcgatgcggactcgcttgtgcgggccggccgtcggatgagcgccccatccacgcgtcatgcatccgcgtcggggctgcacggactgctgtttgcatccggtctgcaccagatttttttccctttttagccacttaacgatctgtttgttgctggaggttctatctagaacagtgtgcacagaaaacggagcgatctattagcacgtgattaattaaggtggtgttcttttctcatgaagatgaatattaagttttttacgtaaaacgaggtgatactagattgtgttttaattattacaaacttaaaaattagattaatatgatattttagagtatcttttatatagaaagtttttgcatgaaacgtatcatttagcaatttgaaaaccgtgccacgaaaatcttaatcttcatccaactcttgttggagaaaagaatgggacctagtattagctattatttttttcaaaaatagatcaatatgatttttttaagcaactctcgtatagaaactttttataaaaacacatcttttagcagtttagtaagcgtgcgagcaaaaaacgaggcgggggagctggagctagaacgaacacagtcgtcttgtcacgtccggaatttctatccaaaattccaaacacttacatgtgtgtaaaccctcgtccaggaatcagccgaggtacacaataacaaattgataatagagtacaatcattactctaattaataagcgaataaaatgtcattacagaggtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaataaacatttcagaatttaataaaatagttaagtagtaattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgttcataactgcgggcatggctattcgaatagttttactctggccagaggtataccactgtacccacaagatacagccccacaacatgtcaccatgcgcctcaataccaccacggtacctcagaaaggggctgtgacagtacccctcgcacaacacaatccaccacagtgcaccattcctggatcataatcacccccttataaacaaggcatgaactccccagcgacccccgtgggcttatcttcgccacttctcagtctggtgctccgcaatgaactatgctatacaaaaggtaaagccgttgcccacgctggcttgtggttggcacggttaatgtttcacaaccgaaactcgtgaaccagtccttaattgtcatgagcacgaccatcaaaaccatgtgctcacaacccaccattatcaagttttagttgacaaattaattaattaaccaatcacgattaactatcatgagctatcattaagccatcattaaacaatagtgagtcataagttatcccaatagtgtactaatgtttctaagcatggctaagcaatcgtatctaatatctagctgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggatgtttgggatctgtgtgacttgccttgctggccttggaactcttcaaattcttctcctgcaaaaacggactctccggaaacgtcggaatctaaacagaaaggatcaaaatcaccaaacagcacataaacaagcatgaacagtacatgtggatatttttaacatgtagatcccaattttagaaaaatttagagacttgaaccaactaaatccgagctaagatgaattagttatgaattttcaaagattaaatcggattaaatcacttatatgggttttaattgaattatgacgcaataatgaattatttttgaaaagggaaaaggggtttattgtgtcagcggctagggtttgcggtggaccgggtgcacggcggcggctcacagaaacgaacggccgagatccatccatccaaaactgacggccaagatccatcggtccacgaccgggccacgggggacgacgacgatgacgtcagcggtgacgtcaccaccggcggcggctcgggcgtgcaagctcaccggcgaacgacggcgcgacggcacgaacggagggcaccagcacgtagagagcgacgcggcgaactaccggtgaccaaaacggcggcggaagatcaacggacggcgacggcgtcgaggaagaagcggcggcaaccttcggcttgacgacgacggcggtgctccggcggtctacagcaacgatggaggggcggacgaggacggcgacgtgacggcgaccacgacggcggccttcccgagcgacggcgacgactggagcgacggcgacgcacggctggagcggcggcgacgacggcggcacgaggtcccacgggtctagggctctacgggcgaagagagacgaaggcgagggtggcgacgggtagcggaggacctgggggtgcttaaaaaggggctaggcacggcggcgaaggcccacggcgaccggcgacgcgaaggaaaagattagggttcgggagagagagacgaatccgattcgagatcgaatccgcgaatttccaaagcgatttagacgatgtttccaaaagggaaaaggtagagtggatcacagggatcctttcccctcaatcaatttcaccggaaatggaaaggggcggccggatttggaatggcggcggcggtgcggcgcggctagggtttcgtcgggaggaagacgatgaccctgacaggcgggcccctcctgtcagcggcgaacgcgcgcgcgggcgggcggctgcgggccggcttgggccggggagagagagagaaggttttcggccgactttcggcccaaagccaaaagagactattaaaacattttccaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaccagatcttctcttctaggcttttaaaataaattctaataattccaatttagacaacaatttatatatttgggatttttagggtgtgacacgtctttcgaactcatatacacaaatttctctctttaatatatatatatatatataagcaataaaaatatgcttattttgtagtattacttttgaaaccatcaattttaataaagttattgaaagtacaataaattgtcatcaacatgattagcataaattaattattttattcatttagttagataacgttgatatttaaatatatgtctgaccattcatcttatttaagatttttatgcaaatatgtaaaaatatagtcatattcaaaataacattagtaacaatattaatcaaaacaaaacaaatgataaccatatattttttaaacaagattaacgatcaaatgtagatttaaacgcaaacataaaaaatatagttaaatgtacaatataaacatatccagaaatacacaggttataaataaaacgtgccaaacggcgcgcttattttctagtatatatcccttgtaagccgaaaggggagagtgcgacagcccaatatatcccctgcgtttgtatccaactcctctatactgatcattgtcaatcggtgttcgtggttttttcccacgagggtttttcacgtaaaattcgtgtcttcgttgtgtgtccattttcataacatcgatgaccctatagagcatggagatctttaaccatagggatgaaatggatgagtgtttgctgggagaatcgcagaactatgcagcgatggcatccgactagaactttttgtttgactgggatttgcatgacatcccgtaccacaaacccagagatcctgcagtgagaatcatggatatcagcaaggatttgatgactccatacaggaatcttgattagtcttgtagaggcgtaatttccaaagagattagttgccatcgacgctgcacggagtgattttggggaaaaatcatggagaggactagacagtaggagagaaaaggaattaaggtgttatttgccaatttaccggtgtatgtgtttgtagttttatatgaaaacgtccatcttacattataaccgtccgattaagatagaagggcgtacatcgcctgagtgcatgagtgcaccagggttggtgggtgcataggacacatcgcccatatcggtagcaacatccgcatccatatccatatacacaatacattcaccattgacatatatctcccaaattcccaatgcccaaaattgaaaattggagagtgtgagagtgtgtgtgtgtgtttgcgtgtattttcttttcatccggttgatagaaagaactcagaatcaaaccggtgaagggagtcccgagcacacccttccatcccaagcgtccttcctttttttccccggttaaccacccactcattaaagtggctaagtccggcgggaacttatcgaccacatacccactattctttcccgacgcctcctttctcttgcttgatggaatagttcaatgcttgagctcctgctttgcttgcattcttcactggggcttgctagatgtatcactcatcctgaaaataaggcaaggagtctgaagtttcttatgatcattacgggaatgaatcacataagttgatttagaattgctcgggaattcattgatagtgattttttttcagttctaggggggctagtgtactcctcttttttatcaatcgagctcctcattctactcgtccagccctcttcataaatttgtacaatcaatgccacgaagatagcaaactcgattgtcgaatatataaggaaagtggcgacgatttggcaccagatatccggttgtgtggaaagaccagctgtgatatacacaaaaaccatcaaacaacaacgattgctcgtgaaggtttccatagaagattccctgttgtgaattcaataccaccttagactggaaaaactattcagaaaaacagaaaagtgaaggctatacactcacatatccgtctagaaagggaaaggcgtcggtacgtcagctatggatatagaataggctatggagcagagacttaaagtatttaccaagactatacaaaggaaaaagtcagcgaaagtgagcacgtaactaagaaagccggtatcagaaaagaagcccttccaaaataaaaggcaaagaagtcaatgattgaagcagcttctctaataaccccgttgaataagaggccgaaggctttttcaaacttatttatagagggggggacttcgacttttgttgtcatatgacaaaaacatctgccgaagggcaggcttcactcaagcaggtggaaaatgtaaatgggaaaatgtattaatctctcaaaaattggatcccctattacatatccttgggatctacttatttacagccttgggtttacaaccctagggttcttctatactaatgaatttacactgcccttgtggtagggacatttacaaggacaacagaaatcttttggcctgacctaccgacccgtgggccctgaaggcccactcctaggctgcttattgggcttccttgagcaggggtcacatgtcgccgaaccggcttcgccactcagtggatcggcttcgctttctactggctgagctacgccaactgcgatccggcttcattattccgtgttctgctttgctattcagtggatgttggttcagtcgaatgtcctcatgacatgcctccaacaagcccctcacaggcaacggtgattatggtgcctcaaccgagaccgtgttcgacacctggcaggatatgaggtgccacctttaggcctatgttctagtcgaaacatgttaagaaaagaaaaggtgtgaggacccaaaataggacctcccgtgtataagtgttaatctaggatcaagctagcacacacagacacaaagataatatcacagccaacataacgaaggaaacctaatatttattaataaagtgactacgataagccttatggatagattttaccactacaagataattaagctattgccaccaaattattacaacaaaaaataatttgtagcaatatattacactattgcaatgataatttttctatggcaaataattattttttattgcaacgatctacaatcgttgttttatttagtacttttgttgcaatagaaaatgagatatcgccacaattttaatttttgtggcaatttatatagtacatggtacttttcactattttttgttgccacgatcaacaaattcgttgcaataaaaaatttatcgtctcataatttaacttaattttttcatatggacacggattaagacaaatttaatatggaaattatagctctcgacgatatctacaattttataggtgataaatttttcatttgaaatcttttagatattcaaatctcagttagctaggctcaaatggaacgatatgcattttccaacagaattgatgcgtaggtgagttggtaaaggagagcatgcgtgaaggataggtcttgagttcgaatcctagccaagacacaaaatcaaaaaaaataagtagataaatagataggatgatagattaatatttgaacttttaatttggtacgtaaaactaatgccacatatggagtggtggcaataatttttattgcaacaatgtgaagtgttgcaatatgaatttttgccacatccattccgtggcaacatttaaatttattaccacaaaataaaaatcgttgcaataacctattaccatgctgtttattaccacggctagcaacgattttacaattgtggcaacatgtatctattgccacaattttagtattgatgccatgatttttttcgtggcaacaaatgatttttctagtagtgtatacatttattttgctacgaagggcctaagaaaataataaagtagcagtagaaataagataaacgaatagaggttctattcaacttgccacaggcggccaactgggacacatgtcctactcatcttcagcaacaaactccttgggaaacagcggaaacatttcttctggaattaggggaattgcaaggtgagtatatggaataaaaaaagtacatggaaatatgcatatgcatggctgacaaagaaggcaatgactattttataaacaatttataaacaaatgtttaaaacaacatttataaatagtgtgtaaccaaccatccatccacacaagacatgtccacatcggaccacatagctatattcattaacctgcacaaagctcattcccagttttcacaaactacccctcatgagaaatcaccaagtacatccatgaccgcggatgtggctatttgaatagattaatttaaccatacagaggttgtacagcttaacccaaacgatacatcgttcttttaacggtcatgcgcaagtgtcacacttcaggttatgtgcggccaaggagtctgtaacaaggctctttagaaacttcgcctcaacatttcctttcgccataagatacatttctctcacacaaacaagaaagtacttttcgctaaccttaacacctatcatctagccacctgggccaacaatgccaagacttggaatcctattaggccaggttcttcccatgagaacatgtggttgcacgttacgctcagatcaatcgcttatgaaataaagtctttaattgatcaggacaacatgccaaaactacaatagcatagggtagcagcttaaggacacttagttggccctttgagcaactaaataacacacagcttgacagtagactcacacagagaccataccaggtaacaatcacacacatacattactacctaaccaggttcacacagaaccacccatcaccccaatccaatacgtttgtccacctgttgtttacaaaaagatagcacacagccacacaattcatataaaagtaattataagtatatgattaatacaaattatattttgcttgtaaaacaaccttcagaaaggctaagcataactactttactttgagttgagcccaatattcaactcataaagactaaggtgacaaagtatcgtaggtaatcaataattatcaaatgcaggataacaatttggacacgctacccattgatagtttataaacaaaaataatatatgtattaaaaacattttataaattgggttcaatatgttcaaagaatatatgttcaaagaatgcactgcatcttctgtagcgaactgctcctttgctccaacatctagacgatcacaaacgagaaacaaataaacaaaataaaatactaactaaataacatcaaatgaaatatcaaactgaaccagaaggtacagcatgttttagatgaatttaggaagaagaacaggtcaaatcggagttcaaacagaaaagttataacctttggagttggaaattcagaaaaaatcctaggataaaagaaaaggaatatttaattttgggaattaaattacttttaacaagaaatatttgtggggcccagtggacagtggctcggagtacggtggattgggtatatgaggaatcggctaacgtggacaaacacgtggcgacacatatctacacgttgcgtctatggatgacagggcgatgatgcggatagaaacgtggaaaaacacgtggcgacacatgtcgacatgtggcatctatggatgatagggagatgatgcggatggatctaggccgagctgacgtggcaaggaaaaggattttggaaatccaacggtggagattggatctaggggatcgagcagctgagattgcttgcggtttttttaactgcttgacccaccacgccatggcatgctccagcgcggcatggtcgtcggcagtgcggtggcattcggcagctgaagcatctaggcccccgtcattgattttggtaattaatgacaagcgctaattgtggactaactatttccttgagttatacattttgatttaggaccacgtaatgtgtatgcatagaggatcaccgaggactaaattcgatggcgcaaagtaaaaagaaggaagacggtaaaactagaggtttatttttaattgatcgaggagttgggcgatcaaaaatttgctagttttatttaggaaaaagtacgaattaccccccccccccgcgaactatcgcggtcgtccgaattacccccctgaaccacaaaaccggacattcttcaacccccaactatgcaaaccggacgaattaccccccctcgacccaatctgcggtgattttggactacgtggcgtacacgtggcagtccagtcagcattctatttataaaaaaaatgtgggacccatatgtcatacactactctctcttttctctcacaatctatctctctcctcccggcgacggcggaggcagcgagcgcggcggagaaggcggcggcggcgacgaggcgagggggcggcggaggcagcgagcgcggggaggcgagcacggcggcgaggcgagcggtggggcaaggcagtggaggaggcgacggcggcggggtacggcggaggaggagagtgcagcggcagaggaggcgaacggcggcagggtgcggcggaggaagcgagcgcgg

SEQ ID NO: 1048 - DNA, 10138 bp, Oryza sativa
  unsure (1)..(10138): unsure at all n locations
ttggcctccctcctccgacgtcgccgggaggagagagagtgtgtgagaaagataattcatccggtttgcatagttcggggtgaagaatgtccagttttgtggttcaggggggtaattcggatgaccgtgatagttctagggagggggtaattcgtactttttccttttatttgtagctttgccatactatcaagaggggtaatgacataaacaaagagatgatcaaaatgccacattaggtcatttgcatttagacttggtttgcttctatattcgtttgcattattctgaccagggtcggtctgaccgaggctgctataccggtcaggccggagtgtatcagccggtctgaccgatggatcggtgccggtctgaccggccccctggaagctggctgtgtgctggtggttgcactctagggtgaaaaatccgagccgctagagccgcagccagtcattccgagccggtggcggtctgagcaagcctaggccggtctgaccggccgctatattgcggtctgacaagccccctggggttagctcaatgatttccctttaatggctagttctctagcgaatacaaagtagttttgtctgaatgcccacactatggcaatttgatcggcagtgcactgagttggggattttgacccccaacggctactttttgtgggtgggagtataaatactcccccaccagtagcaaggggactctcttggcacttgcttcacttgcatacaccccttgcacactctctcacacactcgagtgcttgtgttcatccatttggagtgattgagggatgattagccaagagtcaagtgcatttgtttctttgtagagctagtatggtacttgattatctctgagccgggtcatcgcttgttactcttgaaggttgccgcctcctagatggcttgtggaggtgttgcccagtgacctctccaaggagattgtggagaaggcccggcaccgtttgtaagtggtttggagttcacgaccttcagagtgaaggaagaactacccctggtgaacgattcttgtgtagtccacttcgtgggccggctcccaccttgcccaccccttgacgaaaggggcttgtggtggcttcgtggttttgagcagagaagttgggcttgccacaacggggagtaggaaactggcgagtttccgaacctcaggtaaaaaactccttgtctcttgtctcatttacttatagcatttacatttgtgcaatttactttcaaagagacatatttgagcccatatcaccctaggattgcaaaacttaacttaggtatgcaatttaatttcatagagacatatttgagcccatatcaccctaggtttgtaaaacataacttagtttcttagttaactttgtacctcaccaagcctagcaacttatgttagtattgattaggtgtcatttagttttaaatcgcctattcacccccccctctagtagacatctcgatcctacagcaacgtcgacaagaagaggtggaggcggaccaggtggcgtagcacaagacttcaaggcgacgtgaaggcggtgctcggcgagggatagcggacgctggagctggggaagagaaagggacggtggcagcggtagcgacgggacgtctcccgacggcataacgaagcaacgacaatggcagctactcgcagcggcgatggtggcggcggcttcgggaaaggagggaaaaggggtggcggccggcggctatttacagaggaggggagagctaagattagggcggtgcatgacatgaatttttgaaggtggtgccggttcttatgggaggcggcggcggcgttagttgggctcgggtcgatggcggtgtaggccaggggcgacgtggaggggaggaaggtcgggctgagggcgatgatgagggctcgggcttggcctccctgggcctgtagctagagaggaggtggccgaccggatgtagaagaagaagggaaaaaaggaaaaagaaagaacaaggagggggctacaaggaaaatgggcaattagagaaatgaaaggaaggaaaaagggaaatggatagtgacatttctggaaaattccaaatgtgaaatatttggaattttcaggagatttatgaattaaggaattgaataggaatatattggatttgggcagaatttgattaggaattttagctccacttctgaaatacaaattaaatccaaataactccaactaagaacaacaaactgtaacatcccgaaaatttacaattttctaatcttgcatcatgctgattcttatgttcttaataactttttaaacctaggaaaatataattagagagacctcctgtcacaccctgaaaatttaaaatatataaattgttgtttaaatggaatttttagaatttattttaaaagcctagaagagaagatctatttttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacccttctctctctcttcggcccagtccggcccagtctgtagccgcccgcgctcgctgacaggtggggcccacctgtcaggcctgtcgtctacctccggccgccgccgcccgaaaccctagtttcgcgccgccgccgttcctttccaaattcggccgttcctttccgtttccggtgaaattgatagaggggaaatgatcctcgggatctcctctaccttttcccctttggaaacatcggctaattcgttttggaagttcgtggaatcgagttcgattcggatcggcctctttccttcgaaccccgatctttccatctcgtcgccggccgccgtgggcctttgccgccgtctcctagcccctttaaaaggttccccggtgtctcctctacccgtcgccaccctcgccttcgcctctcgtcgtccgtagcgccctagcgccgtgtaacctcgagccgccgtcgctccagccgtgcgccgccgccgttccggtcgtcgtcgtcgctcgggaagatcgccatcgtggtcgccaagtcgtcgccgtcctcgttcgctccttcgccgccgccgaagaccgccggagcaccgccgccgtcgtcaagccgaaggtcgccgccgcttcttcctcgtcgccgtcgccgtccgttgctcctccgccgtttctttggtcaccggtgggttcgccgtgccgtccgctacccgttggtgcccttcgttcgtgccgaagcgccgccgttcgccggcgagtttgcgcgcccgagccgccgagccgccgccggtggtgacgtcaccgctgacgtcatcgtggccgtctgccgtgagccggtcgtggaccgttcgatctcggccgtccgttttggatcaagtcgatctcggccgtccgttcgcgtgaaccgtcgcccgtgcgcccggtccaccgaaaccctagccgctgacgcaataaaccttcttttccttttcaaaaataattcattattgcgtcataattcaattaaaatctatataagtgttttaatccgattaaatcttcaaaaattcataactaattcatcttagctccgatttagttggttcaagtctctaaatttttctaaaattgagatctacatgttaaaaatatccacatgtactgttcatgcttgcttatgtgttgttttggtgattttgcttctttctgtttcagattccgtcgtttccggagagtccgttttcgccggagaagagtttgaagagttccaaggccaacaaggcaagtcacacagatcccaaataaccctttgagcatgttgatcctatttaaagctattgtttctattcaactattgcatttattttcgaatgtcattgggtggaattaacctattctttgttatagcctttttgttcttgattactttattccttgataccttgggttattataacttgatctagttgagctttatatattggttcagctagatattagatgtgattgcttagccatgcttagaaacattagcacactattgggataacttatgactcactattatttcatgatggcttactgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaaacatttaccgtgccaaccacaagccagcgtgggcaacggctttaccttttgtatagcatggttcattgcggagcaccagactgagaagtggcagagataagcccacgggggtcgctggggagtccatgccttgtttataagggggtgattatgatccaggaatggtgcgctgtggtggattgtgttgtgcgaggggtactgtcacagcccctttccgaggtaccgtggtggtattgaggcacatggtgacatgttgtggggctgtatcttgtgggtacagtggtatacctctggccagagtaaaactattcgaatagccatgcccgcagttatggacgggtctaacaatgtctttcgtgattagtctcacacttctcattatagtaaaagatgctataactgataataatttgattagctcctggtttggaatggtacattcctggttggagatagaactgtgcagccggggtggctgttcagaatggttgggcctatacaacagggtatgttgtatagcgttggattaatattgtttaattattactaactgttttattaaattctcaaatgtttgctaaatgctgcttttgcaaatgaaaacctattatgccatcctttgttatcttgagcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgactttttattcgcttcttaattagagtaataattgtactctattatcaatttgttattgtgtgcctcggctgattcctggacgagggttcacacacatgtaagcgtttggaattttggatagaaattccgggcgtgacacctcctaaaactaacttgcataaaaccacttattttatttaatctcttttatgacttttatttaaaacctatcttgaggtatttcttgattcgatttcgatttaaaactttctttcgctaaaacttcctttatttaaatttagtttgaaaaccctttttacctttatgaattatggtccaagcaaccttcccattttgtgctagaatttaaaccgaagcaattccaattttattggaattaattgttaaacccatcctttgatcttaaacctatccttcgattccaagcatatccttagttccctttccaaatttcaaatatctaaattcctccctttgatctagccatcattaatctctatggcttgatttcctattcggcacaagaatagcaatattgcaaatattgtgaatgattgctcttgtgctaagaagaatagatttttattttatcctcctcttccaaattgattccctattagccaaaaataattcttcaaatatttctgctatcaaatctaggattcaaaccctttttatctttacctccaaccattttcctccgaatatatatattgaggaattatattgttaattcccctctcatttgagtgctttgatatttagtccattatattctatctccaaaaacattgcactcaaataaattggaaaatccctcctttgctaaatttccttccaaaacttcctgttcaaattatttgcagccatccaaacctctataaaaattagacttcttcctttttgacattgggccgaattccccttttccctcctctctttcatgcggcccaagtcggcccagcctcagctgagccgcctcctctctcctcccttccttctgtgggcgccgccgtgcgccatcggagcgcgtgcgcgccgccgccaccttgccgtcgtcgccaaggaatcatccatgacgtcagtcgccgtgccgtgctcctccttctccgccgccaattcctctgcggccgccacgtgcacgcgccgccgttgccgaccaatcaggagacgaggccggcgccgttttctttttccctacgcagcggcgccgtgccttcctcgtcctccaccggcgaaccgaccttcatgaaccgacgtccaccggctataaatagccggcaaacccctgctcttttccccatccgagccttgagctcttcttcttctctctctcctaagtccggccgacgccgccatcggtcgatctcctcctctatagttcccctagctaaatccttgcaccactgactccccctccctccggcgaacccatttttcccgtttttcccttctcccccaccccatagcaaccaccacaaccacctcctttgcagccgaagagaagctcttctacttgccgttccggccaactcctcatctccctctgccggaaaccatcctccccagatgcgcgtcgtccgggaacacaagttgccgccgacgtcgctgatccccggccactggagccccagcgccccttctctctctctgttgttacacgggaagaaggagaggaggaagatgacgggaggaagaagaagaagaaagaagagaaaaagaaaaagaaagactgacatgtgggcccctgcacagtaacattttgtattttccctatttaattcaaatcctattatttagaagcccatatctcctaaaccgtagatccgattccagtgaaacttggacctaaatttatctaaattcaaacccaatcttttgaccccaaatttgctcttttaatattttatttgaatttattcaaatactgtttgaatttatgtttgccttttcaaatatttctttttaatccaaaataccctttagccactaaaaagccgccggttggaactttacgccttccatagcgacgttctcggtttactatccccgacatcggaccgttggttgtaaagccaggcaaaacccaaacccaaggtcgaagtgctgctcctggcaccccacgcctcgatgcgtatagtggtcggagcttcactattccctcgacctccacagcacaccacacagttagctcttgggctctgtgtgatcctagccgctccgccgccactcacggttgtcggagtaacacttcctccccactaaacccacacaaacctcctatccctctagccgttatactctatgttgacaccggctagagaagataccaattctagtcattatactgcccaactctagcaacgaccagcaaacacctaaaccctagctgatatttatcctacctcaatcagcttgctatccagaccccacgccagctagaatatcatcacaaccatttaccctccaactacctataacctatacatgaaatacgagccgatatgctatcctatttcagcatcgactcgagaacaagtaaatcctggccattcttctaccaaagcccaacttcagccaatactagcccaataatcccaagaccctataaaaaagataggctataccctaaaccctagcccttctaaccgtttcttgctttcttgctattttatggcttttattgaatttggttcttcttcttcttcagtagagtctattatatttggatggtaacctgtggtatttcgagcattggataatcaggttgcctatcttgaatttatttgcgttggagcaaggcaagttattattcctctcctttgagcattattatcctatattctatatctcgaatatctcatgcattagtcattcatgattttgaatgcataacctgaacatatagcaaaccagatatatgctagcttttgcttagccatgcctagttagactgcataaaaatataatgaacttagattggaacagtacggtagaaatggttgatttccgggtggctagtactgttccaaccgatataagacagccaagtacatgtgaagaacatatgagtacgaccgcaattctcgtatgggcatagacctagctgattaagttatctagcaaaggtggtacctctgtatagtggttcttcttaagtcctcgcgcaggaggcaaatttatgccgcgaagggcaattgtgatatttaccgaggcacaggtaaatatatgagatttattgacgtcaacttgtttgtgaaccctgattgcgatgacatggtgtcatacaatcagttctctttaaagacctcgggaacgccagaactcctctcgctgctaataacgttacgttcagagcgtatggggactagagttcatggaacaattaccactgatgttagtaaccgaaaagctttgccatgacaaggctaatgtgtttggcacgtcatggattgcgggtaaagcgtacatctactgcagtatgaatattcttaaaaactattcgaatagtcgtgctcacgggtatcgggcattgggactcacaatggcatcttggttagaaacataattccatattttattaaatactattgcattacaaacatcatagactttatacttctacattctcagcctttctgcaagtaaacctagctctacacagatgttaccatttcatgcattcattgttgattaatataatagcttgctgagtacgttgtactcacccttgcttcaacccctctttttcagagtctatttggagtttttgccgaagctgggaattcaatcacataagttagtttcattctaacttaattcgcaaatatagattagacagatggtttaagtctatagccaaacattggagttaagtcattctatagcttttgctgtaatagttagccacaaccttgtaaataccctattattttatataaagaaatctcctttggagccttgatcaaatgtatgcgataaagatccagattgtttaacctatatcaatctactgatttagggcttgatacagttaaacatgtcggtttccgaatcattagttctgggacccaacacaaacccaacagcataattcatcactttgaattgttttgatttaatgaaagttttattaagctaattttaggcaagcaaaccaaaggtgaattttcgcaaataggcgaaaagaaaggaaagtgaaaaaatcaggatgtgacaaaccttcctcccttaaatagaatctcgactccgagattcggactagcttgggaacaacttcggaaactctgccttcaaatcatcctcacgctcccatatggcttcagcttcagtatgatttcactgaactttgtagaaacaaatgctcttactcctcgtagttccctctacaatctctagaatcttgattgaaacctcacgatatgtcaaatctggttgtaactccactaactgcaacggtgtttcctcttttcgcacgcgaagacatttcttcaactaagataggtagaacacatcatgaataccagacatcgaaggcagcagttccaactgatatgcaacttctccttgatgagcaatgatctggaatggtccaatatatttgggggntagctttcctttcacctgaaacctcttggttcctctcactggagtcaccttcagatacacataatcttcctttttaaaggttaaatcccttcggcgattaaataaaccctattgaaataaaccctattgaaatgttaataaggcctacctttaatctatcccttattagagcaactctctttggcctcacagattacatttggtccaaaaaccactatttctccaatcctatagtagatttaatatgcctaaaattactctataaaccctatcgaaaggtgggcgagtctaacatgcacgtgtgaccacgacagattccaacaagccagcccacgtgctagtcggcccacctccttatttcgccc

SEQ ID NO: 1049 - DNA, 892 bp, Oryza sativa
atgttcgaagctgaaggaagaacctacatccatgcatgtcagaaagtggcaaggatcgccatagaagaactccgcgatcgctccagtgatcagttggccgacactgagtatcgctaccatcctcgtcaaccacagggaagtgatcgtgcaagctaccttgagactgaaggaattgagaatgatgctaccacaaagcatttggtggagatgctgtgggctatggatgaaagtcgtgcggagactgtgttagcagctcaagatcgtgaagactggaatcgtggtaagatttgcaaattagaggacaaggtggatcgtttggagaaggaactagccgcgttaaagggagaagcaccaccgcagaaggccaggattcgtcttacagcaaggaagagagctctttttgtccctcgctaccaattggcgccaaaggtccgtgtggtgaagaaagaagttaccctagccctagcggatcctccggtcatcatcataagtgatgatgaagaagaagaatccaagcgcacccattccaaggtcgagtggggagcaactcaagatgatgaagacgagccgaacgagccttcaatcaactccgatgcccggaagaactagagtgacatgtctacccgttgtcttagatcgttgtgttagtttgcttgttttaagtttggttgtgtgtgtttcgcatgtaatttacatcagtggtgggatgtaagtgcatgcgtttgtttgcttttgagtgttaggaagttggtgagtttagtggtgtgagagtcttcagttttgtaataatgaaactcagttaagatcaataaaagttaaagtaattttctgtcctaagtagtttcccccggtttctcttcttgtgccctgtccatgccagatggtgaacact

SEQ ID NO: 1050 - DNA, 938 bp, Oryza sativa
caatccactactccttggaattgagccaaccaattcatcccggggatcacatccaagttcttggtgtctagaagaattagatccgagggaaaaggaatcccctggatttctataggaacggcagagctataatactttgctgtcataacccctccaggggtggtgataagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcatgtcctcggccgtcacgtggttcacacgacaccgaatgacgtccttaccaccgttgttggagcggggaggcgcttggccttgctgtcgcctcggcttcgggcatttatccgcaaagtgcccgggctcgaagcaattgaagcacagacgctgcggacctgaagcgtccctgcggccttgaccaggttgtacagttggcgtaggaggacggggcgcacgagtcccttgctgactctgctgttgctgcggctgtgggacgcgcaccacgaattgaggtcggggcgcggagcgaggttgctgctgctgttgttgctgctgcgaggaggatccccctggatagggattggtgtagcggaccctttggttagcaccctgctgattgcggaaattcgccaagcgacgcttgtgcgactccagttccttgtgtttggctccaagcggatgctcttgtccaccagacgttgaaaatccggatagtccccggagactagacggacggacagctcagggtccattcctgccaggaacttctcttgcttcttctcatcttcccgcacattctccagagcgtaacgggccaggttgttgaactcgtgcaaatactccatcacggagcgg

SEQ ID NO: 1051 - DNA, 1705 bp, Oryza sativa
agaattgacgatttgtgtgagcaacttaaaggtgctaccggtttctctaaatagatcttcgatcagggatcaacagttaaggattaaagaggaagatatacctaagacagcttttaccactaggtatgggttgtttgaatatactgttatgtctttaggacttaccaatgcccctacaatcttcatgaacttgatgaacaaggtgttcatggaatacctggataagttcgtggttgtctttattgatgacattctcatatattcccgaactaaagaagagcatgaagaacatcttcgtcttgcattagagaagctgcgagaacatcaactgtatgccaagtttagcaagtgtgaattttggttgtctgaagtgaagttccttggacacgtcatctcagcaggaggagttgccgtcgatcctagtaacgtggaattcataaccaactggaaacaaccgaagacagtttctgagattcgcagtttcctaggtctcacaggatattaccggcgattcatagagaatttctccaagattgccaagcccatgacacgactgcttcaaaaagatgtaaagtataagtggtcagaagaatgtgagcagagttttcaagagttgaagaatcgcttaatatcagctcctattttgattttacctgatccaaagaagggtttccaagtgtattgcgatgcatccaaacttgggttaggttgtgttctgatgcaagatgggaaggtggttgcctatgcatctcatcagttacgtccgcatgagaagaactaccctgctcatgatcttgagttagccgcagtggttcatgtgtgaagattggcgtcattatcttttcggtactcgtacagaggtatataccgatcataagagtttaaagtatatctttactcagccagatctgaacatgagacaacggagatggttggaattaattaaggattatgacatgggaattcattatcacccaggaaaggctaatgttgtagcagacgctcttagcaggaaaggctattgcaatactacggaaggacgacagttgccattggagttatgcaaggaatttgaaaggttgaatttaggaattgtcagtagaggtttcgtcgcagccttagaagcaaagcccactctaattgatcaagttagagaggcccaaattaatgaccctgatattcaagaaatcaagaagaatatgagaagaggaaaagctatcggtttcttggaggatgagcaaggaactgtatggttgggtgagagaatctgtgtcccagacaacaaagatttaaatgatgcaattctgaaagaagctcatgatactttatactccattcaccctggtagtactaagatgtacaaggatctcaaggaaagattttggtgggcaagtatgaagcgtgaaatcgcagagtacgtagcagtatgtgatgtttgtcagcgagttaaggcagaacatcagaaacccgccggtttgttgcaacctttgaagattcctgaatggaaatgggaagaaatcggtatggattttatcactggtttacccagaacgtcatcaggccatgattctatttgggtgatagtcacagacttaccaaaagggctcatttcatcccaataaagacaacctatttccgaaagtcggtaaccgaattgtatatggcaaggattgtgtgtttgcatggggtccctaaaaaaatagtg

SEQ ID NO: 1052 - DNA, 714 bp, Oryza sativa
tgtggaattggattcacccctccccctctattcaaaaccctcaaaatggttttatgttgggctcggggtgcatggttttgatagtagccccccggccatataaggaccggtcttcgggcttctgttgcaaagcactaccgtacttccacatgtctagtgggtaaggcttagtttgtggctcagtctggttataaacaaaagtacacggatggagatggacgaagtcgggggtcgatggacattctctagggcaaatgaaggctacacgagctgcggctcggtagtcgagatgtcatggcacagggccggtgtcctgctgctaggggctcagtcctgcctgcctgtcccgggggttccgcccgtaggtggggttgggtcggtactcttgtttatggctaggatgggttggaaactatatcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcaggttgccagttcggtctgaatcatcgtaggccttgggttaaggcaggttc

SEQ ID NO: 1053 - DNA, 1312 bp, Oryza sativa
gaagaaaaattcaaaaagatcaaccacgtatacacttacatgtatggttccgatgaagaggatgaatccaaagtagcagcagccgagtgggtcaggagcaagaaggttgtgccatgtcaatgggtgagaagttctgggaaaagaggaaaatttgattttgatatcaccaaggttgataagattttcgatttgtgcttcgggaaaaacaaattcaacttcctgctggtcatgtaattccatcggctgaggaactaggcaagaggaggtattgcaagtggcataattttggttctcataataccaatgattgcaaagttttcagacagcagatctaggtgtccattgaaggggggaagattaagtttgatgattcaaagaagccgatgaaggttgatagtaatcctttccctgttaatatggtgcatacagctagaagatcagtcgatgaaaggaaaactcgaggttgtcagttgaattcaaccaggattatcaacaaatatcaaagaaggtatgccaaccagcaggagaggtattgcgaagaagatgatggtggatttgatcctcattgggactgtgggttctttagattttgctggaatgaggagatgaggttgccatccatcaatgattgcctgggtgcagtaataacgcagggagtttaagccgaccttacaatagaggcaatcggctgaatcaggaaaggatgtctgttcgttagagattgggcccggttaatcaagattgctaccaggatggatatgagggcaggaagactcaatgggtccttctggtatttttcacaaaaaatcagaagagaagggttcagagaataaggaatagagaacgctttcaagaagtagagcaggaaatcaaccatcggggttagaccataccagcagccgccaaggagatgcaaagtcgatatgctcgatgttgtcaaggctgaggttacacgtttatatgatgctggtttcatccgaccaaaccgatatgctgagggggtttccaatataattccagttattaagaaaaatggcaaggtgagagtgtgcattgattttcgggatctaaacaaagcttcccgaaaggacgagtacccaacgccggtcgccgatcaattggttgatgctgcttcagggcataagatattaagttttatggatggcaatgcaggttacaatcatatctttatggcagaagaagacattcataagactgctttcaggtgtcctggtgcatcgacttgtttgagtggattgtgatgacctttggcttaaagagcgctggagctacatataagagggctatgaac

SEQ ID NO: 1054 - DNA, 733 bp, Oryza sativa
ctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgttcataactgcgggcatggctattcgaatagttttactctggccagaggtataccactgtacccacaagatacagccccacaacatgtcaccatgcgcctcaataccaccacggtacctcagaaaggggctgtgacagtacccctcgcacaacacaatccaccacagcgcaccattcctggatcataatcacccccttataaacaaggcatggactccccagcgacccccgtgggcttatctctgccacttctcagtctggtgccccgcaatgaaccatgttatacaaaaggtaaagccgttgcccacgctggcttgtggttggcacggttaatgtttcacaaccgaaactcgtgaaccagtccttaattgtcatgagcacgaccatcaaaaccatgtgctcacaacccaccattatcaagttttagttgacaaattaattaattaaccaatcacgattaactatcatgagctatcattaagccatcattaaacaatagtgagtcataagttatcccaatagtgtgctaatgtttctaagcatggctaagcaatcgtatctaa

SEQ ID NO: 1055 - DNA, 849 bp, Oryza sativa
tgtcatgcccggaatttctatccaaaattccaaacgcttacatgtgtgtgaaccctcgtccaggaatcagccgagggacacaataacaaattgataatagagtacaattattactctaattaagaagcgaataaaaagtcattacagaggtagatagttcctctcaatcaataaagatctaagcagcggaaaataaaataaacggcgcagacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgctcaagataacaaaggatggcataataggttttcatttgcaaaagtagcatttagcaaacatttgagaatttaataaaaccgttgagtaataattaaacaatattaatccaacactatacaacgtaccctgttgtataggcccaaccattctgaacaaccaaacccagctgtacagatctatcttcaaaccaggaatatatcattccaaaccaggagctaatcaaattattaccagttatagcatcttctaatatggtgagaagggtgagactaatcacgaaagacattgtaggacccgcccataaccgcgggcacggctattcgaatagttttactctgatcagaggtgtaccactgtacccacaagacacaaccccacatcatgtcaccatgtgcctcaataccaccacggtacctcggaaaagagttctgacattacctctcgtacaacacaatccaacacagtgcaccactcccggatcatagtcaccccc

SEQ ID NO: 1056 - DNA, 6866 bp, Oryza sativa
ttttatttgagccgcaggctcttggatgcagagacaaggtattctcttgtggaaaagttgtgtttgtgcttatatttctcttgcacaaagttaaggcattatctattgtccaatgaatacactgtgatatgtaaagccgatgtggttaagtacatgctattggctcctattttgaatggaagggttggaaagtggatatttgctttaacggaatttgatcttcggtatgagtcaccaaaggcaattaaggggcaggctatagccgattttattgtggatcatcgtgatgactccatcggctcagttgacattgtgccttagactttattttttgatggatcactgtgcactcatggttgtggtatcggcttggttataatttcccctcgggggacaagttttgagtttacctatactattaagccctatgcaactaacaatcagtctgaatatgaagtggttctcaaggggttgcaattgcttaaggagttgaagccgatgctatcgaaattatgggtgattctttgttggtgatcagtcaattggcgggagaatatgaatgcaagaatgatacattgatgatgttgacgctttttcgtgtccaacacaaaatcaccgaatgatttgtggtgtaaacaatagagtcgccaaaatcgatagaccaaaatcggctagtgaaaccgatttcgagattaattcactttcgcggaatcacacgactaatttacaagcaaattagcaaagaggataaatatcgtacttcagtcaattggcgggagtatatgaatgcaagaatgacacattgacagaaaggctatgtgctctcggggggtgacagatactttgcccatgtatgcagctatgtagccagaccagccacctatggtttttgttttaaattcaaactggttcttggaattcatggtcatcggattggctgaagaggtgacatctaaaccagtgatcatgatgacatcaagcagagtgagggtcatcggcccttgattgaacaggaaggtgttgagcgtgttgaaccagaaatatgttgcagaagccatcaggggttcatccttagccgaatttgctaaagtaagtgcaagggcttggttaattccgagttcatcccagagaacttgcttgctttccgacacacgtttgtaccatacgggccaacttttctcaggagaacttttctcaagggaaggccaagacttgaatgtatttttccagtgacctagatttgggttggccaatctaaagggtatcctattggtttcttcgctaatgaacttagtagggtcggaatcgccgattggaccaaggaaatactaatgctcatgagataggctgggaatcgcaaccagattggaaagatgctacaaatgcaaaaaaaaaaagaacagagaagaagaaaacaagatgacacaaggaaaaaccgatctattgcataaagaagaagatctagccgatgggcacgtacctctgcatactcggctgatggcgcggcggacgggctagcggaagtcgacatcgctgcgggcagaagcttggccggagggagaatcgccttaagatcgccttgcgcaccgaggggatcgccagagaaagagaagacaaagtttgcttaagcggtgaaaacggaggtaactgtgtgaaatttctcgggggtgacggttagtatttaaagcgctgcggtaacggtcggaaaaacggcaatgagcaatattctaggagaagcagatatggcaaatccgaaatattaccaaatataccggacttggggggcatgtgttaacgaccaaatttggtaattcaggtatcggagatggagataaaatcgaagcgaaatccaagatagaacaagaatcggctaaagtccaaatcggctatgatcaggatcggaagagttcgagtcggactaagtagccgattgagccgattccgacaatgtgactcgatacacgttgtcgggttgagttaatgtgtttcatatggattgcaacgcacggattgagtcctgaaaaggcaattgtatctattaattaggatatttatgtaatttccttagagataagattgggcaaaaatctgtcgcaaagacttatggtatcttagagtttgttagagataagagtgatgtccgacaaggacgtattttgtatctcgggtataaatatgacccgaacccatgtaatcaaacaacacacgttcaataacaatctaggcacatcgccacccttttactttcgtttactttcgacaagttcttgctttcgggttgagctgcatcggcttcgatcttcaactagaggtaaaacttgttatggtggcttgcgttcacgggattagtgcttccatctttatgatactctaatcttgtttatgtaattcattgagttatcatatatcctatataatctctgacaatatcattatttaaccttcaatcggctaacatctatcattggaaggcagccgattaggttaaataccaatgttgacttaaattatatagggtattcaccatcctatgaaacatccaacagcttgattgtctagatattgtccttcttttcatacttatagctgcatcagttgagtttgaccttataagtcgtgattagaatctcaatctctagcctgcttttggttgccgattagggtttcatcggggtttcagccgatcttaccttatttaactacattatatcttatatgcatgattgacatgttaaatccgccctttatgtaagatcttgttgcatttaggtatattaagcttcctgtttgatatattttgcttgctttaatatcttaatatagagtagtatcggagtattagccgatacatgctgctatgaatgcctataatctccttgttaatatatatttcgatctaagtgatttatactatctcggcatggcgaccgatcaatcccaatcacttgatttaagtatatatcgacggaagtattatataccattagtatcttcagccgatcgaatagatttagttctttcttgcctatttacgactgccgatcgactcaaatatgacatcggctcaaagattaatgatacgtcatcggcgactggccgatcgggtatcatttatagatttaaccgctattttcctgtctttatttcttgttaattgcaggatcaaatcaactggcacgctcacgaacctaaaggcaagatttttggacctgcactgaagttaagcagatattccaggccagtgtgtgttttttgcatcaacaagggcagagccttcggcctccgagggcgaagccggagcggtgccgcccctgatggcaccactatctctcccgccctcggcttcgactgatgtagaaacggcgaaagcggcagcagcggcgaaggccatccaggtcagagtcacgtcttgtcatcccaagcaccaggggcgccttcgaccgccgtcttcgcccaaccagcttcgacgtcagcaacgatcaccacctcacaagccaacgccaacctcgaagcacaagccgaagctgatatggggctatgcgtcagaatatggctaagcttcaagacacgcttcgccagatgcaagagcagcagcaagcgtacgaagccgcaagacaagccaaggcccactcccagcaattctatgctcagccccaagttctacttccacacgctgtgcaagcaccggtgtacttcgccagcccacccaagccaacgccgcgcgtccgacacggcagatggtcccggcaccggtccgcccggcagcacatcatgcccagtacccgaagcccactcacaacccgcaagcaatgatgaaagaagcttcgaccttgcaagcacagttccaagcttttccgcaataactcaatcaacaccacaacaacataccaagagcttcgcctccggctcaggccgagggaagcccaagtcagggtgtatcggcgggccagctgttgggacagttcgccttgctaagtcaaattcaagggccctcgcctcaaggtccaccttcattgttcgacccaagtacaatggcccaagcaccaacgactttcgcacaagccgtacctccagagtacagaatggccccaccatcgattcaagtctggaatcaacccatgtccgacccagccacggtgatgcaagtcacttcgattgaccagcaaaaccaggcaatgatattcggcacagcacactagtcaacacccgcagctcaaccacctgttaaagctgtggcttcgccgttcgcacttccataccaacaattgagctggcctgctcaacaaggggatatggtcaagccgggggctgaaaagggtttgcccctcagctgaggaatcaagaatcatcccatcccaccctagtttaagtctctccagtcccacggtattcgggagagatggatccgaaagagttccagtccatctacaaatctgcaattgaagctgctcatggcgatgagaataccaaggcgaaggtaattcacctcgcgctcgatggcatagcgagatcttggtatttcaatttgcctgttgatagcatttactcatggaagcaattgcatgatgtctttgtccttaactttcgaggtacctatgaggagctgaaaactcaaccagaccttatgggcatacaccaaaggccaggggaatcgacaagggagtacgtacgccggtttttgcaggcacggtgccaggtgcaagatataactgaagcatctatcatccatgcagcttcggccaacctgcttgaaggcgaactcacaagaaagcttgcgcgcaaggagcccagaacaatcaaacacctctttcgcgtaattgatggatatgctcgaggtgaagaagataccaagcaaaggcaagagatattagctgaatatgaaaaggcaggtgcggccgtagcaaccaccatacaagccaacgcccaagctcaggtccaagcttaaattgtaagttcagcacctgtctaggttcacccaacacccatggctaaccaaggaccgtatccaaggccgaaccaagcacccatggaagaaattcaggaccgagcgagctagcaaggtggtgatggtggtagaagaggtacaggctctccacaaagagttcaagacccagcaggcaggcggacaacaacaacccttttgcaagaagatcaagaaggacctatactgcgcctttcatggacgctcttcgcacacgactaagcagtgtcgaaacattcggcagcaaggcaatgctgaagtgccaaggcagcagtagccaaggatggtaccttcacagtaccctttgggcaaagtgcttcgaggaaaagaaattacagggcgcctaagcaaatgggttgctgagctgtcacctttcgacctgcactttgtcgcccacacggcaatcatgtcccaagtcctcacggactttgtggccaaatggacacccacgtccgtcctagagcccaaacctgtcgaacaaccatgggtcatgcactccgacggttcgtggtctcacaagggggcatgcatcactgcaatcctgacttcgccagggggtgtaccaattcggtacgtagcaagactgcagttcgacacaaccaacaacacagcagaatatgaagcagcgttaatgggcctgaggaaagcaaaagctttgagaattcggcgtttgctagtccgaactgactcaaagcttgtcacaagctaagttgacaaatcctttgttgttcaacaatcgatcggctgagtcctggcatttcataatactctcaagcgaagcaatctctatattcttctaaaagctctataacttggttatgaattctgcagatagattcttactgatgaatgtcgacctaggtctatctcctggacctataccaatttcttccaaatcatcagccgacatgaaaccctgtccttgcttgtcatcgagatcatctactgtatccttggtgtagacgtttgaagcctccacgacgccctcaaaataataatttgggctctccgtcttcaattggctgtatatcacaatcgaaaacttttagaaaatctccatcccaaacttttccagacaggcaatcaatatcatccatctcccaaagagctaaatcggcactggcaacgttaactgacctgtcggctggcacgatctcaatcttgtcgccttgccattgaatcaagcactgatgcatggtcgaaggaatacaacaattagcatgaatccaatcccttcctagcaacaggctataagaacccttcccatctatgacaaaaaacgttgtaggaacggtcttgctgccgactgtcagctccacattcaaaactcccttagtctccgatgggttgccaccaaaatctttgagaaccatatttgtctttatgagatcatatgaatttctgcccaactttctgaatgtagcatacggcatcaaattcacagcagccccaccatcgaccatcatcttagacatcggcttcccattgacataaccattaatgtacaatggcttgagatgccaattttctgtcccttctggtttctcaaaaactgcctgctctggcgacaaaaccaatctagcagaggtttcctcaacttcatcaacatcggcttgcctggcttcaaattctgccggtagcataaaaaccatgtttaccgatgcagttgcaacacttttccctttcatttcacattatcggaggcttttcagaccttccattatatttgaaagatgaagtgaataattcaagtcatcaaacaagcataatgaaacatacgacgcctcgagagaggaatattggagacattgttaagcccttagcctgccaatcaacttcaggccgagatgtgcccgtcaaaccactccaaggcggtgaccagatg

SEQ ID NO: 1057 - DNA, 2227 bp, Oryza sativa
gaagtcgggggtcgatggacattctccagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatatcatgtcttccgtccgtataccgtggtggtatgtggcacgtggtcacacgtgaggaagatgtgtcttgtgggtaaagatgtacacctctgatcagagtataatctattcgaatagccgcgccctcggttatgggcaagccgagcaatgtacccaagttagtgtttttaattcttaaaacttgcttaacaactaaaatgtggaatggttggcctgggttggcttgggacgagctgggacccagggtcaggttgccagttcggtctgaatcatcgtaggccttgggttaaggcaggttcgtgtgggttcacggccttggttaataatattgtattgctctaggaccgtgtttacaaagtagctttgagcaactaagtgacttttaatgctggttactgcaaaccctaaccccctatattataacccccttgtactcccttgcatttattctgcacttatgggtgtgtcttgttaagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaactatttacgcttccgcttgataaactctgaaatgtatcaacttttggtgtaccttgccgcctgggataaggaataatacacgcacgtaaggaacgcccgttgggttatttccggtcgtgacaagttggtatcagagcccccttgaccctaggacgagctttagatcccaagccttagcaatattttcgaaataaaaatcctttcttatttgtgaaaatcctctagtctctctctgtcctgctgcttcatttatcgtcaaaatctgatctttaaaatgttgcttttctcttttgtttttgtttgtagatggccggcagcatcaaccgtcgtggtctggacctgactggtttcgttttggagctgcggggcatgtgcgttgtcttggggtatccgcatggagtggactaccagggcaagcaactcccggagcaggagggtgacgatgcagagccccacgctgcttggaaggtcaccgcagcgatcctcactggctcacccgagaggacttcgttggcagtcactgcgggtggagattccttctccgccgcttgccagaacgccgcactcctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggcccgtatcgacttccaccagatggtgcgccgcgggttggtcgagaacaacatgaagatcctggagctgcgtcaggagaatctgcagctgaagaaggacctagacgcagtggaggcgcagctgtgtcagctcaagatctcccagggagaggtctgtcgccccaagcgccgtcgcgtctgccgcagcctgaagatcacctcccgcaagagtacctccaggcccgagcttgtccgtcagtccttggcatggacctgtttcgtcgagacccctcgtgccgagcctgcgcccgtggttcctcaggaggagggagcctctggcgttggcagcacagaggatgcgctgctgctcaccttccgccctggcccgtcgcagaagtagacgagcagttagtaggcttgcgcgtgtgttcttctcgtttgtttttctgctagagtcgtgtggggcatggttataccggtgtgtggtataactgtgtcggagcctgtctttattttattggcttaagcaacctgaaccttaacgaacccattttatatcagtaataaattcaagaattatggtagtcgtgggtggttagttttaatagtctgttctctcccttggctggttctgtatgggatatttcagatggtg

SEQ ID NO: 1058 - DNA, 457 bp, Oryza sativa
ttgccgtttattaacatttcgcggtaatcaggccaaaaaaggacaggcaagcccttcaccgccacgaacttctcgtttttatttcgccaatacaggcaagcccttgtagttgcatacctttcagccacaaccctgctacaaggcacaaaggaacagtgcaaaaaggagacatgctagcgaaatcaatcccacattccagtaaaaacatacgatcggcgaaacattaactcttatatatatatatatatatatatatatatacacatatatatgtactttcacataccacgactttgggtgtatggaaaacatggaaatggtggaagaagtaaaataaataaaacttttatgctcacttgtttgcgcattttgtggtgtatgcatatacattataagatcatattcatacttaactaaaaccaatggatcaaagaaaaaattcttggaacaactcaaa

SEQ ID NO: 1059 - DNA, 1100 bp, Oryza sativa
tctgaccgtcgccttgtaaggtgtttagaacttttagtatgagtttggttcgtgactttaggctgcctacctcgggtataaatagagggggagcatgaggcttcccggtatcgctttggagagcaattgagttgagttttaagttagggtttcgagtttagtcgaaatttttgtaaggagtgttgttggtgcactttgtaaacacagagagaatcaataaagtcgtcatctactactctaagagttcttcgatttatgttttaccgggctttagcggtctaaccaacgactcaccgatggtaagaccggcggcaagctaggaaaccctctagtacaagaaacaaactttacataaccaatcatactaaatttggactccttccaaattcgacttcgcatcccatacgcacacaatacctccatcgtatgccatatggaatctccatcaaccacgtgcatcaactctagcctaagtatcccgcatgatctagaacgtgtattttaagtgtgcattgacacatctagaacaagtggttcaagtggtaagacacattcctactcctagctaagtgtgggttcaaatcccatatgctgcagataaaaacccatgctcaccgtatttttttagtttgccatattctgcatcatatacatgtaacatattaacaaaattattttattcaaattgaacaaatcgtcttttgggtttgattcttcttgcaatcacattttttatttttctttgcactaaatatgtttattttttattgtttttaacatattaacaaaattattttgttcaaatttaacaaattgtcttatgggtttgattcttgttgcaatcacatttttcatttttctttgcactaaatatgttttatttttttattgttttgggcaaactagcgtatgatgaatttaaaatcatacattgtgacagtcgtgataaaaatgtcacgagttagcgggctgtgaatatccactgggctcatctgtgacgaaaaacaaaatatcgtcacggtgtatgtttgtcagtgatgatatgtaaatccgtcaccgagaatccgtcacggattaacaagtttcttgtagttaggaaa

SEQ ID NO: 1060 - DNA, 7625 bp, Oryza sativa
  unsure (1)..(7625): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgtgcatattgatgaaaattctgcattgaaatttcgtaagatttgcatggtttttgacttggttttgatccggatcatgtcacatcatgtgcggtggcgacgcgccggcgcctgcatcaagtgtatctagctgaatgttaccagatctgtgcagctagctagctttggagactggtttacctttcagagtgcataatatatctccaagataagagtcagagaacatcaaagcaaaataaaagggataatatgtaatgtggtacaactgaattgtcgccctgtacttatcctggttgagtacccatttaacaaggataaacatctgactgttttatcatgtctgtcgcctggtgattgattagatcatctttaactccaaatacgtctgagtttttaacaggtccttcggcacagaatcaataattggttttctaccgtctaagtcaggtttgatttgttcatatgtcattatattaattgatcccttcgatcataaaaacatatcattttggacattgatatggtcttcggaatataactttatccacaaatttatacggcggaacattaaaaaacccaataaaattatagcattacggaagtcaaatgtcacatgtagttttcattcatccaatccaaatatttaatcaaaattttaaagtttgacttaaaacatatccaaaacaacatgccttcaagaccgaagggagtatgaaacttagaattacctagctaaactagcaccttgaaccgctgtccatggatgcagatgcaggttatacactttgagtcagaaaccatcggagcagaggaaaggcctgagataagcatttgacgtggaggtttattttaggtttgacaaattgacgtactacaaacaatcatgaatatcatatttgttgtttcattcaaaccatcagatgtgtaacacttaattatagtgtaatttttatcgcctcttttgaggaccttttggttatgtacgagagaaaaggtcgcctaaaagaaaaaggaaaactatacacagagtgaacagctgatagattcggctgtatgattttctttttctcccctccaaatatgaagaaaaggtcttctataaaagaaacaaaactacgcaaagtgaacggctgatagattcggctgtgtaatttttttcgctccaaattaaatatgaagaaaaggtcatggccggttgagccaaatgtgactaactacacactcttaactttattttagtttgttctctctgattcagtaactccaatttccgattaacaatattttttacttggctgcttcaagtgatctagaagcaatcaatcaagaatggtggagagaaaaattcagatgcagaaaaggtatctgctaatttcttccggtggcattacggtcatgaagcaaaagtaaccagcacaccaaattattctaaaatccaatatagtactatcagtctaattaattgatagaaggtgatgccactgttcaattaatataatgcacaattcaatgaaattattccatgcatattgaataagaaaataaatgaaggacaagggatcagtgtctttgtacatgttatgagtcactaacttaattatgggagatgcctatcaaatcccaagttaagagcaaaatgttggatttttcatatttgagctatatatacaaaagaaaggctgggcaagattatgcataaacaggtagtctaaaacaaaatggcatgtaacaaagcacaacttaacagctttatatcatgttagtttttttccaaacaaaatcataattacgtcatattagtcagtgaatagttagacaggaccaaataaaagtaaaaatacatttcaagtctctaacttagctagatgaattaaggatccaaaactaacgcaagaatgcagcatccttccctatgcacagtgactctgtagtcctatctgaaactccacatcatgacacatgaatatcattttggtacgaatccacatgatcaacccaataatgtatcaagctctctatctaataggctttcgcatgaatgctatgggcctcaaaatagtgtctttaattagatgctttctcctcttatacagctttctacatgcattattcttgcttggtgtaagaaggttatactgtatcttaagcaacatgcaaactctcatattcaattttcccctccaaataacctagaatcatataattagatggagtaactataagattgttgataatgcccatatgaagcacatccctaaatttgaagtttaatgaataattatctttttgcgaccatctatatactggtattgttctgtctagcatagctgtacacaatccttttgtattcacagagggaagctgtgaccgacataacatcaaattaattaaacacttcatttgagcaggaacagcgtgacctattacaaataaatcaacaattattttttccctttggtgagcacattaatttgatacatgtaatctaggcaatgaaagatttatagtgtatttttgtacagaattaatgaaagatttacagtgtattttgtacattcagatcataaacaaattaaagaactaaaagtaatcacaaaatctaattaactactaagaggagtgcaaattaaagcatgtgctcctcttagcaattaataataattaatagatcggtggatggatgtgatggtgatgaaatgatcaggaggggtaagaagccttaaggtgagcttgcaagcatggcgagtccttccaaaccctagcgttcgccctgagcatctccctcgccctcgccctggcgcgctcgccgccgtccgcctgcagcaccagcagcagcttcgccaccacgccgacggcgagcatctcctgcagcacggccggcgtcgccgcgttcctcgcgacggcgtggagcgcgcgcacggcgctctcggtggccgccggcgacacccgcatcgccctcttggacaccacggcgagccccgccgggtgcgccaccagctccgacctcccctccgcgcacccgcacaggtggtcgatcgccaccaccgccagctccgccgcgcgccgccgcccgccgccgccctcctcgtcgaggaggagctccaccagcgccgccaccgcgccggcctccaccgccttcacgcggttccgcccccacgggcacagccggcacagcacgtgcagcgccgccttcaccgccttcgacgacacgccgtcggacaccacccggaccacctcctccaccagctcggggctcaccgccatcagccgctccggcggcatcgccgacgtcaccgccttcaggaggaggatggcatacgcgcgcgaacggtagctcgggcggcggagcacggaggcgagggtgtcgaggaagccgacgccattgtccttgccgaggacgcggcgcagggtgggctcggacggcttgagggagtagagcacgcccagggcctcctcctccggcgagctcgtcgacatgggggaatcgatcaccgagtcgaacaggtcgtcgtcgtccgagctggctgaggtggaggcggcggcatggctctggacgacgacggagacgaggaactcgacggcgccgggcgtggcctcgacgcagcgcttgttgcggtcgctctcggcggcgatggccttgatctcccggagcgcggcgagctgccgctgcctgccgccgccgccgagcatcgtcgtcgtcccctcgtcgacgagcgcggcgacgcggcaggagtcgacgggcgggcgcggggtggggaacctctcgacggcgtgcgcggcgcaccacgcctggatgagccgccgcagcgtgtggttgggcgtcgcctcccgctccgccggcgccagctgccgccgcgtcaccgggcacgtccccttccccccgtcgccgccgccgccgccgaacatccaccgctcgatgctgctccggtcgtaggtgatccccgtcgccagcgtcaccgggtccctcatgatctccagcgagatcgggcacaggaagtaggacggcacctccgccgccgcctcctccatgctcgctactaccacgagacgagttcgagctcgagttgatcgcgaaggagagagatcgatgggaggaagaagaagaagaggagtttgagttgaagggaatgaattggcgggagaggggagaagcgcgttggttttatagggcgaagagacggaggcgcgaaaaagtccacgcgcgcgggtaaaaaaggagggagacgaccagggttggtattaatcaatttaatttaatttaattacggcgatgaacagtgagcgttaatttaaattaattaatgtcgtgccggtttttttttccccgtcgcttcaccatgccgtgttggtgtgaaatgtgccgacacgtacgaacgcgtatgtgccgtgggaaattggataggtggcgcgagtaattaattgtacctgtttaaactaaattagtaattactatagctgtttaaattaaattagtttcggtaaattgggtggtaaaaacgggtggttgtgtcgggtcggcgtcggacggctcgtccgcgctgaccgagtgaccggacagcggctcaacggtttggcttttaatggatcccttcctctcttcttcttcttcttcttgttttttttttaactactattctgcttcttcttctttgtctttttgcttggtcttttcttttcttctaatcgcttacccttgaaagattccgttcctagccgatcgaattggctctaatttgaaaattctgccctgtttaatggtattcatttctttcacacattttttaattccccctgtggctatttcggttacttttgtgtggtggagagaacaaccactactgccactacgaatataatttcatgcttatggttgatcacaactgactaagcttgagaaacgcgtattaccacttttagcccgaggaggtgttgtacgtagaaaatatttttacactatatattatggtataataagtagtaaaatgtttttataaaacaaattgacaaccatatcatgacactgctggagaaacggtttttactcccggttatagcaaccgggatgagccaatcgtagtcctagttgagagaaccggtacttaaagttacatagcaaatgaaaaatacatgtgggatgtgggtttaaattcaagatctctcacctcagtcctcacgcacgtaaccatctcatcagtcctcacgtacgtaaccatctcacctactacacacatctaacttgaatagagatgttgtccttttgaactaactctagagacatctttagtctgagttggtgttaatttttagttcgggttggtgttaccaaccgggactaaagatcattcatctttatctttagtctaggttagtgttaccatcctagactacaaatcaatttttagtcccggtaacatcaacctagactaaaatgttttgagggacttgaaacacttttagtactggttcttaatctaaccaggacaattgtgattttgggtaacatgggaaaatatcagttcgccactagtgtgatgatatctataacaataaattattttttttgagagggtgcaactcaggacgccacgaacacaaacgcacacatacgcgtgcgcgttcttaacacacgctagaattgagattggaggcacaaggctaccgggataaccgaaattgatcccggggaaacggggaaaaaatcccctagtgagacacgcgagttacgattccagggatcgaactcgcgtggctgcttgctcacctagcgacgctagccatccgagcgacgctcggttccctaataataaattattttaaatagaaagagttacatattgggatatgatatgatgttttacatattctgatgatatctagtgatatgtgcgttgtgtggtataaaatttaattattcttttttatttaagtgcagatcaaatttagacttgtatatttatgtgtaaacttatagcatcactgaatctatccactatctctcttttttaaaagaaaatgtctataactatttaaaccgcatgtaagtaatagtaggtgtaattacattcctctactattttaaaagtggagtaaactttcttttatctcctactattgtcactgcgaagcacatccataagctccgtgtgagtaaccactagatccaatgtttgttttgcacagtaagcatgacaaatctaagtccgtattattgttagtaacaaaaactaattgaaaccgctcgtgtacgtgggacagtgtaaaaacatacgcacacttacgtgaacaaattagcgggatgaatagaacagtattacggtccgtatatatcttcttgccatgaccaagagccgtaataccaaacagccgtactccatgtgtaacacgtgcggttatatatggaacagtacacccaataacttgcacgtgtcactgtcacaaaacaacgcatagcggcttttagcctgcttgtcctgacctgcaccaaattaaggcgcacacgttggatttggatagtagtaattgcgatgaatgtgcaagcatatcagcatatatacataggccctgcttagttcaaaataataaaagttttattattttagaacacatttttttctaaaatggatctaaatgctagtaacaaaagttagcaatttagcatttgtcatttgggagtctacaatagcaaattttgttaaaaagtgcgttgggagtcgtgctctccctctactaacaccaactagaaaaacttcaatgccaaatcttttgtcaaaaaaatttaccacatcaaatctatctattatatactaaaagtacatgaaacatcgtacaaacgcttctaataaacatgtggcattcctacaaacattactaggccgccacattttcctttaaaaattagcaccaattaaatttatatatcttttataaaaaaaggcccccatcgtaacatgcaatacgtacgtacgtcccgtgcaattcttgcacgctcgtaggtacggaaggtccgattcccctgcccggcctttctttttttttatttcatggatttattcttttaattgttaatatttatgtatttatgtctactatatactttttaaaaaaggtccattaaattttcttaaaatactcttaaatcataaatggcgctctaataaattagagataaatcctaaaaattcaacatctaagcatcgttttttacttaaaccgataaacccttaattttagaaattagattatattgatcataaaataaattagaaaaagtgctcttaagtctcaactctcctgatctctatatacatacgtgcatgcatatttgatcgatcccaaca

SEQ ID NO: 1061 - DNA, 4256 bp, Oryza sativa
ataagtaacatgctcatatgttgacgctttacatggcattcgagaattatgacaaatcatgaaattttatttaatgatatggattataaatttgattatcacgtaggatccagtctattcggcccatgtcagttcataattatacatgactgaattagatttacatgctcgcatcttggcactctacatggcatgggagaattataagaaatcatgaaattgttttttaaggttttaatgatatggattatatcatcatataaatatgcctaaaatatagtttccagtctattcgacgtatacgggaataacctaaaatatcaatcttatttaccaccatgtataagttatatgttttggcgattatattatgccctaaataataactaaaagaacagagagagtacacattatttttttcttctttgatttctaatgaatatgcatgatgtgtgggaactttatactaactttagttaattaggaaacacaaataatacaaaacttatatatgagaattcatgcaataaaaagaaactttataataagaattgccctaatacaagcatacgttagtctttgacacttaaacatttaaaaatactctacacatactaattaaaaatacactagcatataattgcgctcttatttcaagtagaattcatttcaatgaaaataagaaagcgtgtgaaaaaggacaagtaaacagaattttatctttaattagattaaacaattctatttgccattttttatagaaatatcctcaattaatatatctaaaatccataaatacatttataagagaaaaaaattgttacttaaagtatatgaacccaaaaacaagatatgctaaatattccaaaagtaatcacacatattacaaataagtttcattggaacaaactccatgttgcgacaatatcttctcatatacaacggtccaagtaattttagttgagaaatgtggcaaggataactatgagaatatataagaaacattcaaagcaatctcaaatacattattgacaaaaacaagtttagagttgaatcaaagccacacataaattaaagcgataacaaataaggtgcccgcgcatatgcgcgggctaccttcctacactggtggagaagtgctttttagtcccggttcataaccccccctttagtcccggttgtccaatccggactacgaatccgggactaaatatcgctatctttagtcccgggtgaaataaccggcactaaagatcaatctttagtcccggttgataacaccaaccgggactaaatatagggatcttaccaaccgggactaaagagggaataacagcagtacagatggtcctctttctttttttttcttttttattttctcctgaatcaagtggcatgcatattcccaaatcccaaatcaaagtaacatcccaaatccacatcacaaatctttaagttacttatacacataaatcaaatacatcgcaaatcctaaaaaaaattacacaaatcaaattacatcacaagttctacaaaattcatcgcaaatacgtcacaagttcacatcgtatacaaatcaaatacatcacaggatcatatgcaataaatcacgaattcttaaagaaaaaggaaccacagaggtgccgctcggccggccgctgccgcctcctctccgcgccagccggccaccgccgcgcggcgcgccgcccgccaccgcgcaggccgccgccacgtcggccgcgccgcccgccacccgaccggtccgctcgatctcgctcgatccaaaaagaagagaggaaggaagaaagagataaggcagaagttagagaggaagaaagaaagagatagagtttgttgtgtggacgagagaagaggataaataatagggattatatagtacgtgttgatttttattcccggttagtaacaccaaccaggactaaagttagatctttagtcccggttggtgttacaaaccaggactaaagatcctaggcgcctaatatagtctgacatggtaccaaccgggactaaaaatcatatttagtctcggttggtatgatttttagcacaaaccgggaataaagatcatctaggactaaaaaatcatttttagtcctgatttttaatggaaccgggactattatagatttgggttgaccgatcaaatatggtttctacaccagtgcaaattgatctaaacaggcccatagccacattcatatactctctctctccgtgtcttaatgcatgataatattgttaacatttgaacaaatgtttaatcatttgacttatttaaaaaatatatatattttttaaaaatatgataaagtaactaacaataaagtaaataataattatatttttagtgagatgtgttttacaaattaattaacagcgtcatctactttaaaagaacagaagagagggagaagaatatactagttcgttaatttctcgccatcacgagatgagcttaattaagctatagtacccgtaccagcatttgcatgcatcgtccaatgaatcagccgcttccaaaccaaatccaaagcgaaggtgccaagcaaagcgcacgcacgcacgtttcgttaaacaaggccagtggattaggacgcgagtgacggcagaagtgcgggcggtggggcccgcatgtcggcgtcatttgaccggaccgaaaggggccggagttttttcaacgcacgcgcgcccgcatgcatgttggtgcgaagtgcgtctcctactattaattcgtcacgtgccgtcgctgaccgtttaccaattaattaatgctgatcgatcagttaattactccttccgttccatgatataagagattttgagtttttccttgcactgtttgatcactcgtcttattcaaaaaattttgaaattattatttattttttatgacttactttattattcaaagtactttaagcacaacttttattttttatatttgcataaattttttaaataacacgagtggtcaaacaatacaaacaaaaactacggagagagtagtttggaggtacataggatcataggagtatgtcatcgcttcctcccgctgatgtatccggatcctctgcatactttgttcatactcctcttaacgggtcacttatcaatgctgcataataaaagagcatctccaacatactccctctgtttcatattacaagattttctagcattgccaatatttatatatatattaatgaatctagacacatatttattagcatatgtatgaatataaataatgctagaaagtgttataacgtttcagatataacagatataggctcccatcggttgccattttacccaaaatggcttatttggcttattagaaaattaaaattaatttataagtaaaacttttgtagatttgttcgtagcgacttaaaagctaacattaacaaaaattacgttaaaagcattttaaaatcaacttcaaaatcaagtttaaaaattcaaattttggcttattctttggctgtttaggccaaacgatggggactgatagtagttatcttcgccgtccctgcgccgcccctttgttgtggcctcgtccgctacagcagttgcttgttgtcccttcgttgtggcccctgtccactgcggcgatcaccgccgtacctccgctgcggctcctatccgctatttgccgtgcattcgactgcgacggtcgcccatgtattaaattctatttgcaaaacaatgttcttttaactgtttgatttaactaaatgaaagtgacagggaattatgactaacgctaaacaagtactccggtacgttgtcaacattgaactattatgacctagctttgccgaccaggccagctctcgaatcttgatcggcttttgttatatattaactgttaaatgctaaatcattcgaggatgtaacgaaccattctaaactagactgctgaagacggaatctagttcttgtacacggtacacctgaacttttatacgtacgcaacctcgttacgccatacactaccacataatagggattcggtgccggttttcctaaccggcactacaaagacggcacaaatcacaacagattaaaggtggtggtttcaaaatcgacaccttcaaggcgcacacaagccaagaaaaatcggcttgatgcattgagccgatgcatcaagccatcaaactgatcccaaataatactcaatcccaaaattttgcatcaaatccatgaacacatctagatcacattcaaca

SEQ ID NO: 1062 - DNA, 3658 bp, Oryza sativa
acaaacacaaggagggaaggacaagaagggaggggaagaaatcgatccgtgggcctccagccacctgccgccgccgcatcccccttccttccgccacctccctccctcccccccagttggcccgcccctccatgggatctggcagagggaggagaggggaggtcgtggccgccgcctccgccgaccagacgcccgccgtggcggaggggagggcgtggccgccgctgctgcctccgccggccagccaccgggcgagagagaagggagggagagagagggaagggatggatagaagacgctcacgtgagtggatggatcgaagtcatcgaaccttatctcctcgttctggtggggcccgtcgactcatcgatttgccggctcggctcaattcgtaggtgtcggttttttataaaaattcagcatattataggtgtcagcttttaattaatcgacacttctaatatattaaaggtgccggtcttttttaagaaaaccgacacctgtagaatagatgtcgatacttatttagaactggcacctataattgcttaaaggtgcctttttttggatttcaacccgcggaagttggaaaatggttataggtgatggttttagcacttccggcacctatagtgccgagatctatttgatgttttgtagtagtgatagctaatttagccaaaaaaatttccaaaagtaagacacgcatgctggtgtagaggaaagtattattggtaattaaacccagaaaaaaatgcaaataatctaattactagataatattataagtaacatatatagacaactagaaatgcatatcgtcttgactcctgtgatgctgtgcagtttgggcaggtgtattaggtgcccccaattacagggccataaacatctctgttgatcctcaaattctatcatttgattgtattttgtctaatctctttctatatacttataatatggtagagacttaagaatacccatggccgacagagaacgatgttggttacaagaactaaaggtgaaaatggtgtcggtaattcctgacctaacggtttttatattttacccatttttttaggaacggaacaaaaacagaaacggaaatgataagaaaaaaatgaaaatagaaaccaaaatgatctcgctattctacaaactgttacattgttttatgatattttcttggaatttatcattttattactccaacacgtggtcctcgtctttagtcggcccatatatcatagtagagactcatcaattgtattactccctccatcccataatataaggcatggtcaaacttgacacagtcttcaaaactaatctttgacttataatttctcatatattataaggtttattgcaacaaaattataacatgataaagtaaatttaaatgtcaatctaatgatattaattttagcaaataaaatttaatttatattataataattattggtcaaatatttttaaagctgaatcttgaaatatgtgtacgccttatattatgggatagagggagtactaaactttgagcacgtaggaaaacataggcatatctcggatgaccactcaaaattaatgtagccaaagctcatgtatataaataaaaagaaaaaaaatgtaggggggagaacaattatttttcttttgcacgagtgacatttagcaattcgcttattaaacttttgatcaattatatatttctgttgtatgttatattatgtttacagtattttaaaaaatatgtaagtggaccacccatatctaaatttctagacatgttaccgtagttaaagggaagccaatttagataatgcaagtatgaattaatgtggtcatattatatagtcatgtaaagctatatctgtgattttatacttcagaatttatgacatgagtatatgcttttatctatgcctgtctgaaaagttatgttttacgaaaattgcaaaaaccacatttagttcaaatttggcatttcattccatgtcattatgttacaaatgctcatcctcctacttaattttgttgcaaaggaacaccccattacgcacgtgtttagttgaatccaccgtagactaagctagttgagctaatcttgtccaagtgcttgattagacttacttttcatctttcattatttttttatgcatataacggaactcaatgagataacgttttagctctcattagtaattttatttatggaatatccaagaaaagtgtcaaggctatactccgtatttaattttggaagagaccacattaacggctcacaattaaaaaaaacatgttgattcggttaagccgtgcgcacgggggtacgtggtttctactttctacacaaaattgagtagggttgagtatttacaacaaaataacttatatgctaaaatgtcaaacttcaaatgacttataggatggtttttcaaattttcgaaatgttttttccttagtttctagatattgttttctgtttccggctctactctttccaatttcagaggggaaaaaatatgctaatggaattggtggaccgtttgttcaaataccgattttatattcctgatccgaactgttgttcgaagtgggtgtgcgaggggaaacataatgtgcaattaagcacgtggaaagtgtgtgcgatggttggacaagtactgacacatatggatgcattcgcctttttgggggaattgggatttctggtgtagtgttgtaggcgtagattgtacactctacgtgggaagtaacgtcgtatacgtaccagccggggtacgcacatcggggcctctcacctcacatgtgcatgggccggcccagccggactcccgcgagcatgggcctaatgctgatggactctaccagtttgccactagcccactactccatctactactattcacgtatggaaaaagtccactctgactcccttaaaagtcggccgaatctaattcgtgccctttaaccacaaaaccgaatagaacgactctctgaaatattgaaaccggtgtaatttgactctcttaatggttttcgagggtggtttcgcgcagacgtggcgcttacgtgacggtgttgacttgtcttcgtcccacgtggcgttaacattgcgcttatgtaatattagaattaaaaatagatatgtgggactcatttgtcatttacacacaataaatacaatggacccactgactgtggggcccacatggtcatcttatctccaacccttcttctttctccctctctccccccttatttctctctctctctctctctcttcccgtcggccgtctgcaaggaatgggattggagcggcggtggcgggcggtggagcagcggacgggagccggagtggtggcgtcgggagggagggtgggtagcgtttggggtggtgctggcgcggatggaggcgaaaggggaggcggcagcggcagggaagacggctgtgatggtagcggcggcgggcaggagggtggacgagagaggatggggcggcgaccatccatgcaacggagacggctcgatgacgaccccgcgacgaccggggacgcccccgcgatagaaacaactcggcaatgaccttgcgacgctaacgggcggagggagagcggtggcggcgtggcactctagatccggcctccacgtgccg

SEQ ID NO: 1063 - DNA, 7602 bp, Oryza sativa
tcaaattacaccggtttcaatattttggcgagttgttctatccggttttgtggttaaggggcacgaattagattcggccgacttttaagggagtcgaagtggaccttttccttcatgtatcttttcaaattcaccgtactaaggtgcatcgtacctgtaataggttggaaggagtatggtagtagcactagcagccccatcgttttgcttattcgtggaataagccaaacgacatatttgcaaacaggatgtaatttgtgagtaaaatgtttatatatattcttagcaatctaaaagcaaatgctgaaaaataaatttcgatgaaaaaccccaaaatcaattccaaattttaggtggataattcaaattttggctgatgcggcataagcataagcgaaaagacgagccctcctaataacgatccggctcagaccccaacagttcttaggcacacccactcggggaaaggtctaatctccctaaaaaactagtccaataggagaagggtggctctcccttttaaggtggcttcctcctcccaagctaagcaagtgggattattcagaggctcactcggtcgccgcctgacttttgcgtctttgtcagcgggtaatagtggagaatgttctcatcacctgctccatctgttttagcactaacatttctatcactccgggatgtgtatagcccgccatccgagtagagtactaagagcttattcagttccttatcattctcaaccatttcaaatactatctccttctccgtaatatgtttgacgttgactagttcaattttgtgctaaccaacatcaaagaaaaaaaaataaaggcagtaatttggtaagttagcaaattaaatatatcattaacaacacgaccttatctattttagctaattccatagctttctgctcacaaaactactgccaacatttgacaacactaccatcttcattttaccttatcaaaatttactaatgccaaaatttaggattatcaaagattaataaagttttgttcatcaataaagtgaaaaagccctatgaaagctaagagtatatcaggtttgagacgatttgtttggccaatcgatccagataatgttttccatatcttagtgcggatctcagtagttttcctctttttttttccttttgaaaaggcaagaaatttgccttgtcgatctatattgagcagatctcaataatgtcactgtggaatttgtgatcgtaacaagaggagaaaataattgcgactacaaattaatgtaattaactgtgagaaaaattaacgcaaggagaaggcgtcttgttgactttagcttaaacagtgtttagtccccattgaaccgccagtagtatattcgacgcgccaccatcgtggtgattttagcagataaaaaaaagaacacgataaaattaatttccatgctcctgcggctggtctattgcagggagcatcattcctcggatacagttgctgttgccttgttgggtacagttgttgtaccacctgagttttttttcagtttgtctcgtacagtactgtgatcatattcttgtgctagacagctagagcatgactctgctgccattcattgaattctaaatagaatttgaggtcgcctgagtcactttaattggttgactctttttcataattgctaaaattataagtacaagaatctatataaatttattaaaagccaaaagttaaaattcaatactattttggattaaaatctgaaacaaattcaagccatgcaaattcatatatctttgcttccgtgcaaaaaaaaagtataaacatcatttgagaatgtaaaaatttccaaaagttttactcacttttctccattttctggctgtgttttccccccttctttccaactctccttcatcttttttcgcgctcatacttttcaaactgctaaatggttacactatttacaaaattttttttatagaaaagttgttttaaaaaatcatattaatcaatttttaagtttttaggctaatacttaattaatcatgtgttaatggaaaacaccgttttccgtgtggggagttggagactcagcctttgatggcaatccaatgattcttgtcccttgtcccttttttttcttattatataaaaggtcgaacaacatatttaaatattcaaaaattacaaaattacataaaataaataaaatttacaaaaccacatgaaaaatattcaaacttagataaaaataaagtaaagacatatataacaacaaagctatagctaaaaagaagtaaaattgtgcattgcatactactgcgattttagcctcaggaatatgcaatttcaagtgactaggaatttacaaatttcgagacacttaaaatctagcaatacctttaaaatctatctatatctatcgatcaatctatgtacacgtcttagattttggaaaagaacatgagaggtagtagtggcctttaattattcataattgctatatatatattctctccttttagtaacagggcgcgggacctgattaaccaacattagcaatttcagatgaatagtactccatccgtttcacacggtaagttattttaacattttccacattcatattgatgctaatgaagataagtcattttaccatttttcacatttatattgatgctaataaagatttattagcatcaatataaatatgaaaaatgttagaatgacttacgttgtgaaacggatgaagtagcaatgaaaccgtgatagcagcacgcgtgcttgctgtcacggagcagcgacggcgcacggggtggttgggaaggtggttagaatttttatacatgaatcggatcggatggtcctggcctgctggattttgcatggagcagccacggatgcacagaccgattcgctgtaggttagtactactatagtactacgtgcttaaaggagaaacagaaaagatacataggatcacttttaaaagcgactgtttttgtcctatttgcccgttaatcctgctcgacagagctgttgcttattttgttaattttattggatttattgttaggattagttggaactagattcttttttatgttttggtagagaaaaagcctacaaagattgaattacggttgacacggtagcatgttctacgctaaaacatgccgagcacaccgtgtgcgctccactttggtgcataaggacgtgattctacaaatatattggaaacttgtcatcaacaaaccagaacttttggtatagataggtttcgtcgaacgctcatcttggaggaacatcatcaaggcaagtgtgtgctggtgtaccctaagggcagtagcagtgcagcgcacgtatagcgtgtctctgcccacctgaagcagcgaaaacagattcagagtcacgagcttcacaacgcaagcgcgaggaaatcacgtctccgctgtgatgcgagggaaccgcgactccggagcaacgaactccacagcacacgcgcccctcaagtttctgcgttgcgtgccctcgatgcgacgaaagaactcgcggtttagataagatgcgagtggctacgcaaaggcgcgagtgaaggtgacacgtccgcatgagtctgacctggtgcggtaaggcaactcgccaggtcaacgcattgtgaagggccttaggggttgtttggttggttgccacactttagttatgccacaattttttaggtatatgtttattttactaccgtaattgtgtcgtgccatactttcttagtcatgggacccacatgccatattcttaaatttggagctaagcatgccacacttgtggacaactatttccaagccacacttgtgccaacatacctcaactaggctaaacttagttatgtcaatgttaggcatcaaccaaacatcccatcacccaataaaacttagggcatatttgggagggggtggttctcgttgttgcattttttttccaaaatactcaaaacgatctagggtgaaaaaggttataataaactagaagccaggagttatgtatcaaccaactatttattaaaatcttaactttcctaaacaagaccttaaattgttatctttcatcgtagaactgaaaacaatttaggattagaaaaaaaaaagatgagagagaaataaataggtagaagtgatatattattatgatgattgggtatgaacggtttcaatcaggtttgacccccccccaaatatttgtatgaaggatgatcttgtttctatatatttttggtgggtctaaggataaagcagactactggttgcatgagccttggcgcccgtgcatcaccatcaattatttacgtagtactcgacaacttccttctctctcctccaccttagacttttctaccgtctataggttaatagatggctttggtaactttattgcacttgtcctaactgaaaccaaatttagttttttctatataagggtattattttactcggcatgtaaatccaattgaatatatgcatttttttaaatcaacttgaaatcaacttcagttgaagagctgaagatattagatacccaaacaggatgcttgtggaatggcatatagtagttagatgagccgtgagcggtaacaaaaattggaaaaatttggaaaccagccgacgcagcggcagcttacacgttgtctttcgctgacgatgatgtgttagtagtagcactgtagcagccaagcaggagcaggcaggagtagtagtgatcacggtgactcggaaacgcgccgcacaagccatcccaaaatctcctccaatttgcttggctttggaaaaaaacccaattaaattataccattattccataatcagcagcggtgacggcttggcttagcttaactttggctttagtactcatctcctactaagctcgtggacttttccttctctcgtcaacagcagcgcacctcacctccgccgctcgcctcgcctcgcctcgcctcgccttcctcctcccatcctcaccccgttgaatttctcccacctccgatttcttcttcctcgttgaaccattccccacccttcttctcctcctcatcctcctctccgcgccccgcctctgcggcgaggtaggtgttcgatcggtcggatggacgcgtcggatggccgcccgtcgccgcggagccggcagctgcagggcccgcgcccgccgcggctggccgtcagcaaggactcccacaaggtcaggaagccgcccgtcgtgccgcagccgcgcgggggcggcggggtggtggctgggccgtcgcggccgcagcagtcagcagcagccgcgggcgccggtcatcatctacgacgcctctcctaaggttattcacaccaggcccagcgagttcatggcgctcgtccagcgcctcactggccctggctccgccgccgtggcggcggtggctgctcccgtggccgctggcttccacaccgaggcgtcgtcgtcgtcgtccgcctccgcctccgcgctgccgccgcagttccagctgccgcaggagttcatgctctccccgaccgccgcgctctcccccgccgcgaggtacgccgccatcgagaggtccgaacggccgcttccccccaccaccgcgcactactacaccgccgacgccgacgaccccatcctgctcgacgtcgacggcgacgccgccgcctttgcggcggccctcggccccgcccgcccgagcatcctctccccggtgccctccgcgctgccgcccgcggcgtcgtcggggctcttctccccgctcgaccaggcctccctctcctggctcagcgacctcagccccttcctccactccgccggcgccgccgccgcacccccgccgccgttcgcgccgagcccccgcagcctgctgctgtccacgcccaccatgccgtcgccggcgaccttctccgtcatggaattcttcagcagcaacttcccggacctgtaaactaatcccagctcacctcatttgattactccctctcgcgtccgtgtcacccccggggttaattactttaatccttaattaatcttttaccgcgtgcgccggcgaggttaaaaagtaaaaaatcacattgccgcgccggtgaggtaacttccagcgaggcgggcgggttggcgagatggcacggtcgttcgattttttaatggaggaaaaagaaaacaatattctcagatattttctcctgtgggtgaggggaagttggcttggctaagctagcattaattgttggagtaggtgaatttctcttctcatacttgcttcctctcctactgttaatgtattgataatttgatattataatcagctttaggtaggctaacctctcgttggctttatttttcttcctctttttcttcttttcgttctgctgattgtgtaacttgtaaacgaaggagatgattgattggttgatttaatgctagtttcatttgttcattctttattaccctgagcccttcagacttggtcatgtatggttgagatgatttaattgccgatgattttacgtctcggtttaccgccggtgtctacctggctttttgtctggagaattctttggtacataaacatgtgtctgatcgatgcttaaatgttgaaagccttgttttgatggtaacaggaaaaaaataagcatcatgttttagaactagattagtataagagaaaataagctagacagatttcgattactacttgcgattctctagttttgaggcaactaaaatatttgaagatatatcaatcccttcaaaggtgatgtaccacaaaactattgatttaaaaataaatttatcataaaactatgtatttaaggtggagtatcgaaaaactatagatttattaacaaaattatcacaaaactatgaattttggagtttaaatccttagcgctagtgttatatttgagttataaatatctaagttttggtattaaattgatactaaacctatacttttgtgataactttgttactaaatttataattttacgatactctactttaaatctataggtctccgagaaatttattgttaaatttataattttgtgatacatcacatcaccttaaatatatagttttgtgataatttagtcaaagtatctgtagttttctgaaatttagtcttatttgttttatagaggggaaagttcattttatattcatgaactttcataaaagtctaaaaatcattccttaccttttaaatcagacaatatttatccccgaaatttcagtacattcacttttcattctatcaccagattcaaagtgattttggatgacatgtaatacatattatcttttgcgagctatataaaaaataattggctggtggaaaaataattctatagtactccctccgtttcataatgtaagccattctagcatttcccatattcatattgatgttaatgaatctagatagatatatatgtctagattcattaatatcaatatgaatgtggaaaatgttagaatgacttacattgtgacaacggatgaaagtactgttgttagccccttttttctaaaggaaaaaaaaccatactacctctattttttaatagatgacaccattgacttttggtacacg

SEQ ID NO: 1064 - DNA, 3298 bp, Oryza sativa
aagatggagcagttttatgaaggattggatggtccacctctccgagtccttccaataggtggccttggagaaatcggcatgaattgcatgctcgtagggaactatgaccgttacatattgatagatgcaggggtcatgtttccagagtatgtattctgtttctgttgcttgctgctgcttacattactgtttgattcacatcttttttgtctgtaattttcatgtgtctatttgcaactttgcattttgtgaatagcgtttattttggcaaaacatgtatacaagtgaggactttgatagataactgctcacttattcttctacactgtggcatgatcatgatcgcttggcatttatagactttgatagagttcctgcacacattttcctgtctacgtgtatgctaatttgtttttcctgtctactgctatattttgactgaagtgaattcaatttaaacttgtgtcagctttgatgagttcggtgtgcaaaagattatcccagacacaacattcatcaagaaatggagtcacaaaatcgaagctgttattataacgcatggccatgaagatcacatcggtgcgttgccctgggtaaatgattcttctgttactcatacatcattcatcgttactgcttggctatgactgcacaacaaatgccaaaaaggcttcggtcacatgcaactaacaacctctacagctatttgagacacaaatgattgtgcagaagatggtagcagagtgccatactgtaaattttaacaacatgagtcaactgctgcaaaaaagtcagaaaaaagataactgatttgaaggatataaccttgttcttgtgtcaaagctaacattctctaaaactcaaagctctcagcatatctaagtcagtaacaagaaactttcttcatttaaacttattggggctcatgaaagatgcattcatttctctctaacaagatacgcgttcattcttatgttttccattgtatttgctgtccacaggtaatcccagcgctggattcaagcacaccgattttcgcatcatcttttaccatggaggtaacagtcagttcttttgactatgcatgttctgcattgttggccgttattattacatataatttgtttcgttaatcttcagcagtactaagatgtagtttttcatatttggcagctaataaagaggcgtttgaaggagtttggaatttttctctcgtccaggcttaaggtttttagagtaaggaagagatttcaggctgggccatttgaggtggagcccctccgtgtaactcattcaattccggactgctgtggcttagtgcttcgttgtgctgatggcataattttccatactggtgactggaaagtaagttatataaggaatgattgcatactcaatttctttaattttggtgccccttttaactaatttttcaataaaagattgacgaatcaccagtggatggaaaaatatttgatcggcaagcattggaagagctctccaaagaaggcgttacacttgtaagtttatacaatatcagccatgcatccggaccagtacttttcaatggtttaagttattgtcctacgttgcaccttatactccccccatccatgaatgttgtcactcacttttgttcacaaaatacttgatatttcatgtttcccagtgcatgtttttccgttttctatttttttttctctctttttcgttgtcctttatcacatatttggtgggtccataatttattggttagtttggaagggcattatgggcatatcatataaattcaaatggtttcctatgtgtgccatggtcagaagtgacaaataaacgtggacgaagagagtaccatgtaggacggaaagaaatgatgatgcagtgtcacatattaaaagaaactattgtcagatcacttctgtactggcacgccgagctatttgttgatatgttgctaacattatttctcttctctttctggttatttttgatgcaagatgatgagtgattctacaaatgttctatcccctggaaggtccatcagcgaatctgttgttgctggttcattgttgcgacatatttcagaagcaaaaggaagagtaattaccacacagtttgcttccaatatacatcgtattgggagcatcaaagctgctgcagacttaactggtcgaaagctggtagaaattgcttcaacatatagtgcaactctaccttgtcttgtttgacttggatgatgtttttaatagtttgtacttttgataaactggaacaggtatttgttggaatgtcactcaggacttaccttgatgctgctttcagggatggaaagtcaccgattgatccatcaaccttggtatgcaataatattattagagttattcaatagtctttgtgtggaattgctacactattttgttgtaattggaacttaatgatgcaatatatggaacaatgtcttttactgtcctggtgatctatgcaattggcatcgagataagcacatccttaacaatttgtttccattaccatttttatagctatcgacattgcatctcaacatctttatagcttctaaatattaacttgtttggctctcctgggtgctacttgcagcagttctgacaaaccgtagagtaatttgatgcttgattgtattcttcccggttaattgccacatgtatgccttgacctatactttttcgtatctcttaataaatttatctggtggttctgatatatttgtcttggacaaggtgcacttaatagaatctaggttcttgctgaaggtacttgagcttatggaaacagtaatatatggtgaaacagctataatatcagaaaatgctctgagtcttctttagatgtcttaactcttaatgattgtgagtagtgctgtaatgcactagtttgagagttgagttatttttccgtatcactctgttggtatgacgtgtgatgatatcacggaatgtagtcctccttatttcatagtagtcgttctgcaggttaaggtagaggacatggatgcctatgccccaaatgatcttctagttgttactacaggttcacaagtaagtcttacagcctaagagatctacaattttcagtagcccatgcaccaccttataattctttcaaatattttcaggcagagccacgtgcagctctaaatcttgcatcttttggaggaagtcatgcccttaactatccaaagaggatgtccttctgtattctgctaaggtacttcatcattgtcattgtcatcatctcttcacttctattgaccttgatacat

SEQ ID NO: 1065 - DNA, 38247 bp, Oryza sativa
cttctactatcctgaatctccttgttaaatactctctagctctcgcctgacatgagctgacatggcatgccattttttcactatttccaggaggaagtcctacagattgtcaaaccacagcatttcttgcctgttcatggagaactcctgtttcttaaagaacatgaattacttggaagatctactggcataaggcacaccactgtaagtactctcttagcgatggtttagatatcatgggcaatggatttctgtaataagggggagactacttatcagtttaagtctttgaaggttatggtattttgaacaaacaaaatttatgtagtgtttgcttttcctccatgccccttgtaatcttaaattacttgcgtaaacaaaaggatttaattattattcactttaaactgtaaactggttggagctccgtttctctactctttgagcttcttacaatatttgttcatgcatctatctgcaaatgaattagcacttaactactgaagtatctatctgcaaatgaatttgttttttccttagttatttgtaaacatttgtgctcgggtcaggattccaagtatcagcattccatcatatgtattttttagccaaatgtaaaaactatttggtacttgttattgttcttagattgcttgcttcaatctcaggtaattaaaaatggagagatgcttggcgtgtcacatttaagaaacagaagagttttgtctaatgggtttgttgcattagggaaggaagatttgcgggtgaggatctattttgtccattccctttttcttttcttttttttggcttcacctactctaaatctaacatgatgcactgtatattgtagctaatgtatagtgatggcgataaagcttttggaacatccactgatctctgcattgatgagagattaaggattgcatctgatggcgttatttttgtcaggtaatattaaacaattttggtgcatttgctatggtgtttatcttcagtaaaaatctcctctgggatcaaatgagagaacaaattatattaacatgctgctcttgtgaaaacggcaaaatcatatatggtgattgttaacacttatcttgtttcttgcagcatggaaatcttccgacctcagaaggaacttgcttcatcacagtcaggattgaaagggaagttcaaaataacaacaagatgcctatggcttgataatggaagactattagatgcactttacaaagctgcatatgctgcattatcaagttgtccagtgaattgtccacttagtcacatggagaggatggtatctgaaatcttgaggaaaatggtaaggaagtatagtgggaagaggcctgatgtcattgcggttgctacagagaacacaacagtgagttttgtagaagactcagaaactaaatcatctggaaagtttggatctttctcagctcctaggcattcgagcaggagttcaggtaggagtcttgaagaaagtgataaatcatgcccagagaatacagagggagaggctaaaggtactattcgcaaagtatcttaatcttacctttgaaaatgtggcggtctaaccctatattattatctgtattaagtgtcccatcatactgattttcttgttcactgttcagattcatgaaattctgtgcatttgattccatgccttttgtgctgtctaagatgtatcgacactgtcgttactttgttacacagaaaatcttcctgatgtcctgagaacaacacgtgatgatgcaaccacaagctccaatggcgaagcatttttctcctcagatttgcataagcctaaaacactagagcatttttgggactcattcaaatcccctacagctgtaaaaattgcaagaattgtcaatggttcagctcaagggagtaaatcaaagattggcaagatcagcatagtgggtaaggactctagcgatccttcttctgctccagttaaatcttcaaaaaagaacaagtggaagcctgaggaaattaagagcttaattcagatgcgtggcgaaatgaatgagcaatttcagactgtgaaagggagaatggttctgtgggaagagatatcttctagcatgttgagccaggggataagtcgtacaccagcacagtgcaagtctctatggacatcattggttcagaaatatgaggtagatcattgacgtccttacagttttggcataaattcagtttatcttttttattgcgaggaaataattaagtttgacttgttttcccatcttgtggtatagcttcccaaatgcagatataataccacatatataagctatatgatgcataaggaaaaatagtcaaattatgtaatttctatagcttatctggttatatgtgcatcatatagcttatatatgtggtattatatctgcatcatgtactgcacaaacgtagcagctgacattgcatttgttagtcagaagcagcataataggataagcttaacccttcagtttttatttgtttggcaggagagcaagaaagatgaggaaagcgtaaagacgtggccgtatttcttggacatggacagggttttatcaagccaaggggaaatggcaacccaatgatcccaaggccgtagtttagtggttgtaattttggagagtgatggcataatcaatcaagtggcaggatgagatggctgcagcgtgttcttctccagagaatatacatgccataattcattccacgaaaagggaggcaggcacttggaatgactaagctgctacgtattcaccatgagtgtgctacagggctagggatagctgatattatttgatcaactatactagattaagtaattgaatagctaagttttgttgtgctattatttttggtgtaagaagacaccaaatgctaatccgaaggctttcaattgagctacccacatgcctatgcgtgtaaattaacatgtttgattgtgggacgtgatagggtggttagagcgaacgcatttatcaggtgttgtagtttgagggtaagtgggatgagattattctttaaaaaggaatattcatttaagatctaggttagctctataccttaaaaattaaggcccttttgattcaaagaaaaatcatagcaatttttaagaatttcattcctatagtatttttttttctatatagccctttgaataaaaaaatgaatcatatgaaatttctatggaatatcttattctatgcaagttttggaggaaatttaatacgaggtagaacatcatgggaagtttcctttgagtttttatctccttaatttttgtgtttttctcgtggtccaatcaaacagtcgtttctatgtttttcttatgttttgcaattctatattttagacttgcattcatattagaatcctatattttttttctatttcttcgtatttctattcctatgatttaaagggagcccaatggactaatccaatcgctccgatattgatatgtgggctatgtcatcctctaaaaaagcatatcatctctcacgtcaaatctatctttctaaagttggttcgtctcaagctatcttattgggtcatatggtaatgttaaatttttagataaatctaaggaaattatgcataaggaaaaatagtcaaattatgtaatttctatagacttctcaattatctgtcttcagacaaatctagagaatatccataaaaaaaataccgagaagcaaacaaaatgcacatcatccagattctggaggcttcccaatatccctttgcaatctatctatctatctcatgttgttggttggttttatgctagatgattagttgccctcaccatcctttagttgaccttgtcttcagataaatctagagaatatccataaaaaaagaaataccgagaagcaaacaaaatacacatcatccagattctagaggcttcccaatatccctttgcaatctatctatctatctcatgttggttggctcccaatatccctttgcaatctatctatctatctcatgttggttgggtttatgctagatgattagttgccctcgccatcctttagttgaccgacacatggtaagatataagcggcagaaagagcgttgggtaagaaaccatcactataaaactggcaagcacacaagttatgatggtgaattaaaaaaaagaagagtcactccatgtgcgtagctaggccacgcaacaccacaatccaacagtgcgtgatcgaactaagtgcaaacacgtaaaagaggggaaaaaggaaaaaaagatgaagcaaaacttttttgtaaaattatttgtaaattattcggggcaagtatcatgaccacatatcctatatttcgagaaattaaaaagataaatagaaaaataaatgacagaaactttttaatcccgataacctaaccattttctaaatatatatattttctgcttatactataaaataaataatatgcaaatcttttaacttttagaaaaagttataattccaataaaacaaacaatatcggtgttgatccatatctagagtcttaaaagtcatacacataggttaattagcggaagcgccaggcgttgcgttgattttcagttattcaaaaccacgcacattttactgcatctcacttcaaaatttttcgaaaaaaatccactcggcctgttataagcgtctgcattagccatatgtgtctctaaatcaaaaagaaaaataatttataccaatatattaagaagctcctccaataaataagaaatgactaaatcgatttctgataatcccaatattctttcctcttcatgggcatcctgcgaagaaaaatgtttagttttagacataattagttttatgggactagatgtcaaagttttgtagttagaattggaagaagcattgttaaggtaaactgaaccgacttatgctaaataacatttagctagctaattaactaagcaaaaatacttaaataatttaacaagcaaatttgagatgtacacttactcgtgaacccgtggactcatgctgctttatatgccttgaaaaaaaattagcaatcacggtttggttcaaaaggaagtccctcaccagtgttgatagctccaccctcattactcattataagaatccacatcattgttcacccaaacaacttatttaagaccgggaggtcggacataacattcacccaaacaacttatttaagaacaagaggtcggacaaagcatgcatcgcatgttcatcacaatttgcatgcttaacctctgcagtaatggaataagtgttgcactgttggtcttcttatgctgcagatggaataagtgttgcactgttggtcttcttgtgctgattggtctttgtatttttttccttttcagcttctaggacaggactattttgggatgattatgggacatcatctcctttcagtttgggatacttacatgacaacatctcctttcagtttgggataggacatcatctccttttattgtaggatgcgctaggacatccttgggaagaagggatgggttgcaaggggtagtgctggagatgctgtgaagttagaggatggggaaacagatgttaaggtctatggttgggttgcccgagaaggggactataatgccgggaatgtggtgggcaggtacttgaggaagcataccaacctgacaaccatatatgaggtctccaagagtcaatcagagaagtcggggaagatggtagcgaaacatctcctttttcactttttggactagcaacacacctataaatatgtatcctatcccgggtttgggatatttgtaggacatcatctccttttagttctaagatgtgctaggacagcatctccatttttactttttggactagcaacacagctataaatatgtatcctatccctcgggatggtatgatattcgtgagaaaataaatagaaaatgccgcaacactcccaatgtcatcctctcgataagagtaaggattctgctactaacaagtggtatttgagccgttctatactgtagcctgatatctcctgctcatatccttcccaagctcccctctattctcagccggcagtaggaacaccagctgttcctgctcatccctctttccctgcgttgacgagttgtgctcgtcagaggcagtctcttccccacgcagtagccccccagtggcgtgccatgtccgcaggacagtctcagcgctcggttgtctcgagcgcgcggctccggcaggatgccgagctcaccgcggcagaggaacgcgagcgagtggcggcaaagaccgctgcgatgacagcgagggcatcaaggctggcggcggcggaattggcagtggcaagggcggaagtggaagcagcagcggcaacggatgcagcgcgtgcagcggcggcggagctcaaggctctacgcggcagtagcaccagcagctctgtctccgcctacggcagcaccgatgatgagctgatgagggaggcagctcgtgagcaggcagagcagtgggctgccgcgcaaccccacgcgcgtggcggcagcagcccagataggcgcggacacgccggcggcgctcctggcggggggcacgcggcagcggcagcctcttcccagtcttagcgctcggtcacctcgagcgcgcggtttcggcaggaggccgagcttgccatggcagaggaacgcgagcgagcggcggcagagaccgctgcgacggcagcgagggcgccaaggctggtggcggcggaattggcagtggcaagggcggaagtggaagcaacaacggcgatggatgcaacacgtgtagcggcggcagagctcaaggctctacgtgacagtagcaccagcagctctatcaccgtctaaagcaacaccgatgatgagctgacaagggaggcagctcgtgagcgggcggagcgtgcaaccccatgcgcgcggtggcgacagcatagacaggcatggacgcgccaacggaccccctggcgggggcgcgcataatggcgacgctcctggtggcaacggctgggtcgatggagatcgtggctgttgcaggcggcgcgactctctctcacgggatccaggccgtcaacagggacgtcagtcccggcagtgggtggcctactctcaccaagaccaactacgtcaagtgggctgcggtgatgaggataaggatccaggtgcggcacacgtgggaggcagttcggtacaacgacatcgactacgacgaggattggcgagcgctggatgccctcatcgctgcagtcccgctcgagatgtagttctcgctttccaggaagcggactgccaaggaggcctgggacgccatcgctgcggcacacatcggcagcgaccgcgctcgcaagtccacactacaggcgcttcgcaaggagtgggagaacctggccttcaagccaggtgaggacgctgatgacttttccctccgtctcaatactctgctgcagaagatggtgcagtacgacggcgacaactacgacgaggagagagtagtcgagaatattttccgttgcgtcctagagaagtacaagtagatcgctcgctcgatcgagtctttgctggacctctccacgatgtcgatcgaggaggcgataggtcgcctcaagttcgtcgacagcgatgagccacaacctttctcggggcataccaccattggcgggaagctccatctcactcaggagcagtgggaggcctgtcaggatgacgagaggaagggggagtcctcttcctcgacaggcggccgtaagcagcgcaaggcgcacggaggtgtccagctgcagtgggcgcgaagacgcgtcgagggtggcgcttgcagaggcgcccagggcggcgccgctggcaaccacaagctggcacgagacgacgcctgccgcaactgtggcaagcttggccattgggccaaatactgtcgacagccgacgcggccaggcccacgttgcacaggtggaagaggaagagccggctctactcttggcacacgcaagcatcgagctacctccagcggcatcggccgcagcggctctcctccaccttgatgagccgaaggcacatgccttcctcggagatggctctagcaacgacaagactgatgggtggtacctcgacaccggcgccacccatcacatgactggcctacaagagttcttcaccaagtttgactccagcgtccgaggctccgtcaagtttagggatgcctctggcgtggagatcaagggtgtcggttccgtcaccttcaccgccaagtccggtgagcacaggctgctcactggagtctactacttccccccattaaagaactcaatcatcagcgtgggacagctggatgagaatggttcacgcgtgttggtcgagcatggagtcatgagtatttgggatcgccgccgttgtcttcttgccaaggtaatcagaggcaccaatagattctacatcctcagcgtgtaggtggcacaaccggtttgccaagccacccattgggacgacgaggagtggcagtggcacgagcgcttcgggcagctccacttcgaggctctgaagcagctcagtgccaaggagatggtacacgcatggacgacgacgttactacctgctgctcgtcgacgacctctcccactacatgtggttgatggttctcgtggcagcaagggagaggctgcggacgccatcaggcgcgcacaggctgctacggaggcggagtgcggccgcaagttgcgcgtgttgcgcatcgacaatggcagtgaattcacggcggctgaattcgcgtcgtactgcgctgatgagggcattcaacgccactactccgcgccgtacagcctgcagtagaacggcgtcgtcgagcggcacaaccagacggttgtggggatggctcgggctctcctcaagcagagagagatgctggccgtcttctggaagaggtggtggtgatggctgtctacatcctcaaccgctcgcataccaaggccctcaacgacaggacacgtacgaggcttcgcattgtcgcaagccggcagtctcccacctgcgggtcttcggctgcctcatgtttgccaaggagcacgaccacatcggcaagctcgatgacaggagcaccccaggggtgttcatcggctatgcggagggctcgaaggcctaccgcattctcgacccggagacacagcgtgtgcgcacggcgtagtgttcgactaagggcgagggtgggcatgggacaaggcggtggacgatggctcgactctgacgtacgacgatttcactgtcgagtacgtccacttcgagggagctggggagtaggcagctgttcctcctcaccaagcatacctaccccagtccccgagtttccaccgactccggcagcaacacactctcaagctacgacttcagttgcgacgagttcttcaccgacaccaccacaatcagctaccccacgcactccagcaccaacaaccaccctaatgggcacgtccactcccatgccagctcgtgttgagcatagcccggtagagttcactacttcgctcttccacaacaaggagcaaatcgacacgtaccacgatggcgagccgctgcggtaccgtacgatggaggaccttctcggcgaccagccggtgccgggactggtgcctcgtgacctagaggcgcaattgcaccttgtgtgcaatgatagtgagcctcggtcattcgtagaggccttgagacacgcggcatggtgtgccgcgatgcagtcggagatggacgcgattgaggagaaccgcacctgggagctttctgacctctctcgtggtcaccgcgcgatcacccttaattgggtgttcaagctgaagagggatgaagccggagccattgtcaagcacaaggctcacttggtggcacgcggtttcgtgtagcgggaggggatcgacttcgacaatgccttcgcccttgtggcacggatggaatccgtgtgactcctccttgcgctggctgctcaggaaggccggtgtgttcatcacatggacgtcaagtcggcgtttctaaatggcgatttgaaggaggaggtctacgtgcaccagccgctgggatttgcgatccccagcaaggagggcaaggtgctacgcctgcacaaggccctctatggcttgcggcaggcaccgagggtgtggaatgccaagctggattccatgctcaaggggatgggcttcgagcaaagcccgcacgaggcggccatctaccgatggggcaatggtggaaatgccctgctggtgggtgtctatgtcgacgacgtggtgatcaccggcaccaaggatgcgtaggtggcgttgttcaaggaagagatcaaggccaccttccagatgagtgacctagggcctctctccttctacctagggatcgaggtgcaccaggacgactccgggatcatgcttcgacagaccgtctacgccaagcgcgtcgttgagctggctgggctcaccgattgcaacccagctctcactctgatggaggagagactgtagctgagccgcgacagcacgacggaggaggtggacgctacgaagtaccgacgtcttgtgtggatccttcgttacctcacccacatacggccagacttggcattctccgtcggctatgttagtcagttcatgcaacgaccgacaacgaagcaccagcaggctatgaaaaggatcatctgctacgttgtggggactctcgaccacagtctctactacccgaaatgtcctggaaaggcacacttcgtcgggtacagcgacaatgaccacgccggcgatatcgacactagcaagagcacgaataggatgctctttttcctcagcgagtgcctcgttagttggcagtcagtcaagcagcaggtggtggccttgtccagctgcgaagccgagtacatagaggcctccaccgcttcaacctaggtgctctagcttgcttgactgcttggtgatctccttggcagagagactagagcggtggagctcagggtggacagcaagtctgctctggccctggcaaggaaccccgtttttcacgaacggagcaagcacatctgggtgaggtaccacttcatccgaggctgcttggaggaagggagcatcaaggcgagctacatcaacaccaaagaccagcttgcggacctgcgcaccaagccccttgggaggatcaagttcctcgagctttgctccaggattaggatggcccaactttcctacaagacgatgcataagacttagggggagaatggtagaataagtcttgtgcggttggtcttcttgtgctgattggtctttgtgttcttttggtttttagcttttaggataggactagcatatttcagtttgggatgcttgtaggacaatatctcctttcagtttaggatgtttttaggatagcatctcctttcagttttaggatgcctaggacaacatctcctttttcaccttttaactagcaagaaatatgtatcatatccccttgggatagtatagcattcgtgaaaaaataaacagaaaattgctccagctcttccagtgccatcctctcgatgagagttctcttccagcgccatcctctcgatgagagtaaggattctgctactaacatgcatgaacattggtctgccccatgtcaccagtactggtttccttactttttcccttggtcaattttatccttgatgtttttcctaccattttttgtatcgttttgccttctcttttttctccgttgtgcttgctgttgcaagtacatgattgtcctgtctagattgcaagatacaacgtaaaatgaaagccgcatatttccccaaggttttcaggatttgatggagattatctaaaactgcagagcggatcaacggatgttttaaagcaaagtaagcaatcaacaacttctgaaacttctttactgttaaatattatatcccaacaatcagcgtcccatgagagaatcgccctgatgcttaaagaaggctgggaacatcccatcacacttaaacattggtagaatattcttcgagaccactacaagatccttcaacaaaatcttgacgctgcattttggataaaatggccttattatttcaacaatataatttttagaacataccgtaacatgtacgctagtatatgatgaaatgggataaatcttctttgcagtactgccctccgacttggtcaaacagtagtgtagtgtgtagaggatttgtttatgatggaaccatcttatactaaaaaaattaggatgagccttaaccaatctcacctcatctccaaatcacagccaattgatattgcctaaacgaagaaaacgattaaacccgataaccttacgagcgaaacattttgactttatcatatatatctatctacctattatattattaaaacaactttgaaaggagacaccacgttcgctgcgggaactataaattctcacattaatcagaaaaaagaaaaaatattaaccgttagatcctaataagtctagattttaatggttgagattcaatatgagtccgtacaaaagttctgaaaaattgcagtccgtttagctaaagcacaaggaaaaagttgcagtccttcaaccatcggtgcattacagctggactatgcatcagatatggattgaagtatgtatggcatcaacaacaccatgaatgagatcctatttgcaaactgacacaaatcaaaatcagaatagcaccatgggagacaccaataaatactacccacatatgattctgtcactcggttggtgactaataataattcaattcggaatacaatattcaaaataaaaataaggccagctgaaaaaaaaatacaccatgtagaatataacacgaggttaattaaaacttagaataaaaataaaataaattctaaaattaaatttcaatactaattccaaagaaacttaaaaaatcattaaaatacgaaataaaattataataaaaactcaatctagatgctataaattcccatactcatcggagaaaaaaataaaaagaattcatgtaggtatacaattatcaataattaaaatccaaaataaaataataataataataatttgaaagaagagaccatctagaatataaacgatgttacttaaaatttagaataaaaaataaagtaaattccaaagttatttctcaatatgattttcagataaacttaaaaatatcattaaaatttgaaacaaaaatagactataaaattaaataagtaaaaaccacatgcaagaagagtccatagaaaaatacagcctataaatatccaaaagtaagagtaattaaaattcagaaaaaaatataataaattcctaaattaattttcaatactaaatcggtataaactttaaaaatatcatgaaaaatcggataaagtaggaatataatttcgaagtaaccaaagttggcaatacaatgttgttgcaatatgatatatgtgccctaaatgaaaccaccaaattttattttggatatctagaaaataccacatttacttatcgtaccattcaagccttttttcatgcttttcccgaaggtctggagaaagtagtaatcaataggacttcccttatcctcccttcctaaaaggaagaacttgaaattcttttttcctttccgcagggaccgggaggttggatctatccataagaggaatgcttggtataaataagacacttcttggtctttgacccccctaagtcactacgagcgccctagatgagtgcaatgggatgtggctatttatctatctcttgagtcaaaatggaagcagggcaggattaaaaaggatcttagagtgtctagggttgggccaggagggtctcttaacgcctggtaactttaaaaatatcatgaaaagtcggataaagtaggaatataatctcgaagtaaccaaagttggaaatacaatgttgttgcaatatgatatatgggtcctaaatgaaaccaccaatttttattttggatatatagaaaataccacatttattgaaggaaaaaaatgaaaaggctacaccatctgactgtagattaagaaaagaaaacaaatgaagaattatagaagaacttctagatgtatatatgttcaatttttattacaaaataaaaaaatataggattgacatttaaaaagggcatctcgactttagaaacgttttctgtaaggctgctggatggcaagctgctcaagtgaccaataatgagagctacgagagccagagagctacgagtaaggcaagggatacggtggtggcaatagttgtgggacttctaacgtaatcacatcgacgataagttccaatcttctttggcgccgacgacaaggaagaagagagattgcatgtgctaacgagtggataggcgataaagggacagtgaggtggttattgctatgggagagcgagccgagaggcaacaaataagtaaaatggtagtggtggcatctaaaaagaataaaaatgagcccgatgatgataaaattcaatgttataaagtgttgatgacaacaaagttgacggggcaaaatggcgggccacaatggaacaaggaaacaacggttgttgtgggagagcgaaccaaggggtgacagatgacaataaagaagggggcaacaggcaggccgtaaagaagtagggtggcagcagctgataagacatctaaaaagtataaaatagaaactcaaagatagatatgtttgatttttagaatcccaataataataaagagttggggcagcggacataccataaagtagtagggtcgcagcgattgataggaattctagaaagtgaaaaagagcacaacaatagtcaagttcgatttttaaaatcctaatgacaataaagagtagagacgacaacggataggttggaaaggagggtggcggcatttcacggaacttctaaaacttattaaaatggaatccggcgagacaacaaaatctaaaaagaataagatccaatttttaaaggcatcaaggatgatgaatagaaattatgacgggtcgagcaagtaagtaaaagcgtggcaaatgactaaagagggtgacagttggtatgacttttaaaaactataaaattgaaaacatgagaataataaggtttaattttaattttaagaatcccaatgtcgataaagagtaagtgtggtgggtaggtcataaaggtataggttcatagtggttgactagactactatgataataaagaggggaggggcaataagcggacagtaaaggagcatggtgacgacatttaattggacttttaaaaattataaatacaaaacctggcaagacaacaaaaactcgttgattatggggttcaacttttataaagtcctcagacaatgatattattatttaatagttcttaaagaaaattatgtgtaaaaagattaaaaaattttatctagatactagccgcgtaattgcgcgggccaccctcctgctagttcctttaacaagaaacaaccattctccctttctttcttccctcactttggcgaaatatttctaactttatggagtaccatattcctttccttcttacagttcatactagtctcttcttccctgctaccaatctacctattccgctttggcactttgccaaaattactattctccacgcacgcatgcatgcagctcgatagctcatcactagccaagcaagcttgccagctgccagcagcagctgagagtcaatggcgacatctcgccggcttacaggctacagcctgaccggcaggccgtagttgtggaaggccctgatggcgccgccgcggctgccggtcaccaccaccatgttccacgccgccggaacctgggaccggcagtcgtccatcccggcgcagttcacgtacctcagcgacggcagcagcctctcctccggccacgtcgtagccgccgccgccgccgccccgtcgggcacgacgaaccacgtgccgaacgagcaccgctcccggtcgtagcacagcgtcggcgcgtccgctccgccgccgccgccgcccatcgccctcgcccacggcgccaccgccgtgacgccctcggagaagaagagctcgcgcgagctcaccaccctccgccgcctgccgccgccgtcgaagttccagatgcggatcttggagtccctccccgccgatatcaggtacctgccgtcgggcgtcagcgacggaggcaccaacaccttggacctccattgtcctggaaatataataaatgcttgattttttgaatattccaaaacatgatgacatatactctccctgttctagattataagtcactttgattttgctcaaggttaaactgccccaagtttgattaagtttgtagaaaaaatagtaatactttcaaccaaacgtaaaaatatattatgaaaatatattcaattatagatttagtgaaactaatttggtgttgtaaatattattattatatttgtctctaaactaggacaaacttaaagtaatttgactttgaccaaaatcaaaacgacttataatctgaaactcaaacggatggagtactatggccctgtttgggggagcttctcccagctgcttctgctataagctgccctaaacagtccacagcttctgagaatttgtagttacagattctaaaaaatgaactaagaagccagaagctggagaagctgggtttcagagcttttccagattctcataagctggctaccaaacagctgcttctcaaaatttaaagctccctcaaacagggcctatatatatcaagtgaaaaccgcttatgaaattttgaggagatttgttttcatacaatagaatggtgaaagagactgaaatgaagtcttttataccttgaaacttttgggtgatcttatgaccttcagagactcggattttgtgatctttcgatgtgattatcatcctagatggatggccctgagagaactgcatgagagatgacaataataatcaattggccggtattcgtgtagcaggctaaaatcataaactatatatatatgcatgggatgaaaaaaaaatttaagcaactaacctgaatattggtaatcttgttggcagcacaccgtctccgctttatgcgcatcagtttgttcctttcaatgtttcgacctaatgggaaaagacctattgggaaagaaaaataataatgtacaatgcttagttaataacaacattattccctccttgtccttaaaatgagaaatatctgaaggatcagaaaaataaaaataaaatgcagtcatatataccagattgatcatagaagcggcatctccctttgacagaaccgacaacgaaaccctgacaagggtaaaatgcaagaatcagcagctagttactgggaaataaaattcaatgacattttgataatcaatttttgaaaaaaatagcattttgataaagcatgaacctttccatctggtcggtgacttatagctgttatgatgtattttgtgtcatcccaatcaactactcgcttgtctgaaacatcccaaacacgaactttgccatctattgagccactgatgaagtacctttcatcaactggattgaattgaacacatgtaactgttgacaagaaaagaatatcaggtcaacatcattaagttgaatctactacataaggaaagaaaaattaggaaaaaatattttgtgggcaattaacttttttaggaaaaggaatatatttattccggcctcttcataagccatggactaaaccattcattattacaaagaagtatttccagtttaaaataaagaatgctagcaaaataacacgttcccagaatttgagctttgaataaaaacgcttaagcacaaagcctgtttgatatttccatcaccatagttaactgctatgggatgtttgcacataccataatctccatgtctgaatactgcaaggcagtcataacagccaactttccacatgcgtattgtcgtgtctttcgatgaactcaagagaaactgcaggaggtatatactactagatcagttcataccaaatttaacattacacttctcacaaaaaaaatacacttcaatcatttaaatatccaaactacatgagacagaagacttacatctgactttgaccatgccaaatccaggacatcacttgtatggccttgaaactcatgcagaggtgtctctgtgatactgaaaaccttctttggtatgatcgcgaggggcttaattttcacgtccttcttcttgttcatgtcttcaggaacatctctgccgtacaaatcaggcgaagattcaacctctgtgatctgccaaacgcgcacgacgcaatcctcgccgccactggctagatgccacccggatgaactgaacttcatcaccctgatcaatccctcgtgtgcctggatctcctggcacatgtagacggcagtgaagtccatccacttcttgttctgctgatgaacttttgtcctgtacaatgtgcctgagttcaatcctcttggttggacatgtacatcatccatggaaagtactctatctgaaaccttcttcctcatgaagatttcccacaagctcttgaattcgtttctcttagggccgtgaccgaagcgaatgcgcagtagttttcgcattagtttagagaatccaggcacaatctcaggcgcatttggagtcaccatttcatcagatgatgttccagcctcctcaacaatctccgagaggacatcgtgctggccttgatcatgagatgttgtgcttctccttccactactgttataatccacatcccttgtgcagttatcagcactatcattagtattgtctgttgctgccaaaatactgtcagagaagcaagaacggaaggaagagcagatgctactgatcctctcctcgaaatcgtgaaatgagcagcaatccgttgttgcgatttctgccagccactgggggaaggccgtcccggtaggaccgggctcaagaaaccccattcctttcaggaatctgtgtctcctttctctgacactcatcggctcacctgcccacagctcgtacccagcttcacttgtactaatctccgttgagcttctgttcttatcgtcgtcgtcgtcgtcgtcatcgtcaaacgcgtcgaagaagacgtcgtcttctccatcatcggaatagtctgatcttggcatgttcatcagctactttcaaaccaagcagaactgccaaacaaggccgtagatcgtaggatggacgtccttaattactcagtcagtaggaacaagtacattttggtatcttcaagaattcccaactgatgatccgacgtaagtgccaacaaagtattagacaaggaaaaacattagaacatgatcgacgggaaactattttaacagctcgagtggatgtctacccgtttattgcatgtcatctaaatggttatgaaaaaaattaaaaaaatatgaataagatagatcaatatctaatgtatcaatccacaaacatgcaagttaaaattcaacttctacagattgtaacaaaaataacaaataaaactcaaattactatatgtatatttacagttaaatttgttagttttgttacaacttgtagaagttgaattttaatttgcatgtttgtggagtgatatattacatattgatctatcttgttaatttttttgaaaatttttcgtaatcatctaattgacatgcaataaacgggtggacatccactcgagctattagaatccatcccccatgatcgactgaactactacaaatgaaatacatatacacgcacagactagagtaagtagtgaaggaaaataacgaagaacggaataggcgaatagcccatcaacacttcgaacatgtatcgaattatacatagagatcgttatgtcttgaaccaaatggagaacactttgattaaagagaagagaaaattccaatccagatgagacgagaaaagctagcacagagtgatgccagtttctgaagcccggagttgctgctgcactgcactgcacagatcgtgccgtgctgtactgctcatctccagccgttgtcagcctcacgctggcagtagcaggattcatcaagggaagcaaaacaagagtttcacaatgtgcagccgctgctaactgacaaaaaaaaagatacaagagaaacaaaacacaaaaagattgcactagaattcttccttttcattgtgatggtatactactgtatttcactagaagcgcagatacgtactgtgccatctccagcaataaagcgcgtgaatccaatcatcccatatcatggatggttgacagtgagagttagatgatcagaggacaaaagaaaaaaaaaagaaaagaaaaagaaaggaacaaaagcaaccctgccaacaagacaacaccaataaataatcccaaccactaaccactgcaaagaaaaatcttttttttgagaatgtgcagagacaaactaaaagcactaaagcagcaatgtactcggatccttttcttggacctcatcagtttccgatgatggattgatcgatcgatggcatccgatccttctgcaaacatgcaacttttctttctttgcagttcttgccggcaaccagggcgtcacgtcgggaaaccgggaatccgacgacaggaacacacacgcccatgccacgcgcgggtcccaagaaattacgacagctgcagaggccagcaggtgatcatccatggtagtacaagaagacgagagagagacggctgcacggtgcagagctcgtcggcggctgacgcgtgtgccgccgccgccgcaagatctcattattctcaccgcgacggttaccgttgatgtggcgtgcaggtacagcggccgtactggcagtaaaaacaaaaagacgcgatcttttttttttatctgttggtacggcgctggagggaggaaattaaattaacctccattaatgcaagcgacagagaatcaagcatagataagcttgaggaattcacttagttttctaccgcaagatagagagtcgcagacagcaagcataagaagcagaaattcttatcaaagagactgaattgttcagagagtactactactgttccattcgaacgaccaaaaatgcaacgatcatctcacaactctatccatcgctaagcacatcaagaagcgagaggagaaccaaaaaaaaaaaaagaaagaaagaaaacaaaacaaattcagacagaaatgatgcagaagaagaactaacaccacagcttattagctcaaagtctcaaaccaacagcagatcgctcacctgaggcattcatgatcgttctcttccggagccaagaaacagcagctagaagaagaagaagaattctcaggtcggtttcccggtggtcgggagggttcttggcgtcgatcagcgaactgaactgaactctgaactctgaaatggtgtggactctgaagaagaagaaggagaccgacgaatccgacgcttaaatacgtcgtgtccggtgcccctctcgccccccacgcacgcccggtattgcatatcctgtgggccaattccgccatggttttgccgccgctgacaggtggcactcgcctcctccctccacgtggacgtgcacgccccggtatcccccttccaccaggtggtctttttctggactttcccatgcataagcatgcaaactgaccgtatgctttgctgctgtacatgtgatgtgatgggggatgttgtttgcaatttttttttttgcactgttcgccgctggcatgtgggcccggcttttcgtatggctggagccctccacacgcgatgcacaataatcatcggcaaagcaaagaatttcgtaaacgatccaaaaagctagctagctagccactatatttcttgttccaggaagcaaaccaatctatcaaaacgtacctgtacgtagtgattccgaggaataatggtcgttctcgatcgtcggttcaccaaaaatttgccttcaaaatgtgtattggaatttcaaatctaattaagcatcagatttggagatgtggaacgggaaaaaccggttggaaaattttcagagcaaacacattgaaataggttgacaccgatatatgcagaaactaaagaatagacaatgaaattattcatcgaaatttcttaccgtacaatcacgttgtagtcgtagcattcaattctaaattgatagtctgaggatgatcaccatacttctagtttcattgttttgcaataattttggtgcaaaaacagttctctgtgtactagccatataaagttgccatttcaaaaaagcgcgggagcaaattaataggtgtctagaaagggctgagcgaagcattgcggatatatgccacaaaatttaaaaaagctaatttgagtaggtctaagcttagcacgatgacggatgcacaattaaatagaagcttcgatagaagcgagcaaagcataacggatactagaaaattaaataggagcatggctatagttgagcgaaggacaagacttgtacgacatcttgatactaaagattggtgggccataatttaccaatacatctggacggacaacaaattaaggcaacctgggctatcgttttaagaattgtttaattgggccataatatgattacggcatataatatttatttttatatatgtccgttttgttttttaatctgaaacggatagatctataaagtttcactcaacatcatggttagtaacctcgaaatatttaaggcttagtttagaaagtctgaaattcccacaacttcaaaaaagaaccgccaacaaaccaaacaaaaagtggcaaaaattaagaaagaagctaggatctattttgtttccaacacaaatatttttctccacctcttgttcttctaacttttattcctatttatcaatacaattgttagatatcattccatatcttataaataaaggacaataaaaggaaacagccaaatatgatttcactctacgtaccaccaagagtgcaagacaatattcttaccatctccaatagatataacaataaattttcatgttataacgggaaacaagcgagttaaccgctaacataataatgtttttcgttaaataattagtatatattccctctattcttttatatgtgacattggtttggttcaaaatattgtactaaccaacactatatagaaaaatggagggggcacacacaatagcatatataatgtgaagctcagatcatttgatggcctaaaacataggacgatggtcagagttatatttttcatgtatacagtactccctccgtcccgttatatttgacgtttccgaccagatcgtgaaaattaaggaacgtgtgaaattacatatttgccctgggccttctcctctcaacgcgtgagtcgccgccgcgagcccgcgacggaagaaagaggcggaaacgccgccacccccaacgccggaaacgccggccgctacgcccagccgccggggctcacctccaagatgccgccgccacccgtactcgctggaaccgtcgccgccacccctctttgccggagccgccggcgctctctcccgacgccgctactcataattgggcaccccaggcctgagacccagcagaatctttggacaaaattttacaacacttgtagtaagatctcatgccctccttttcacctacaacggcatcgatcgatcacctgagccatttgccatttgccactgatctatgaacactgtaaaaccttatcatttatcaggttcaggcacgctgcaactgctgcatctgccaaattgtgcttatcctgtgcaagaaatagctatagattgactcggccgggcaggtgagcagtagaacattcaaatctccttttctaaagatgaataaggaagaatgaatcagttgtgtttacaatattcagattttactttaaaagtttgtgtttttacagtattttcagagctgctcttggattgccagtttttcggctgaaatttcatagcagttctgatgatttactcccttcattgcccactcagaaaaactctcttttgcagtagtacactagtttatcaaatttcaacgtccaatcttctgggaaaagaagattcagaccatcatctgccagaagaagtgcattcatcatctaatgcaacaggacagtaactcctgagctatgcaaacaagtgagttatataatgctcagacagacaaagatcatcttatgttgaatttggctcagtaattttcagtgggcagatatgctcggacagacaaagaaaggctgacagtgtcttcagacttgttcagttgcagttcaactggaagagtatgtattgagtgtactcagttcttgagtttcattttatttacaaaatctgaattaatccttcagtagaaaccatgtttgccgctgggctgcttgaaccttcctggcttcatctcctagtagagcaatattttgtgcgtcattgctgtgaggtgataataggactaaaaagtgacaatatggtcagattttgtgaggtgataataggcctgaaaagtgacaatatggtcagattttgtgcatgttgaaattcagattttgtgataatgttggagaggaagaatccaagagcaattaggatgtgactttcagacctacattcagattttgtaatagtactgttcatttttaaatcttgaatttacttcagtttttttgtccccttagcagaatttatgacagttcttatgaattcagcatttcactgtgaattcgcaggacagtagtagcactccttgctgaaaccttaggttacagcttcatcaaagcagacaactaccattctcaggcaaacaaaggtctgaagaactcatcatctcacaaccaacctacatttccctttttcatttctgaacttctcagttcctccctgtccctgacaacagcaaagatgagcaagggcatccactgtgtgctggatgaatcatgccaaaaaccttatttataagccacagacaagtgcagcagctaagctagctcaccttcctcttcaccaccaagaacgcaagaacgcagcgagagaggaggagattcaagaaccggaggaattgatgtcgtcttcggctgtgattccgccgccgtcgccggagaggagggtgccgatggtggccgacgacggaggtggaggacatgggacgagatggtggcgtccgtctccatccactacttcatctgccacatgtgccgccacgccgccgcccggggctcgtcggccttctccgccgcgtcgtcggcgtcttcctctgctgcgccggtgcttcccgtcgtggtgcgtcccgcgttggtggagcacgcggcggacatggagcggctcatctcgcagctgccactcttcacgctagcgtcgtcgttggcggcgctcccgaagtcgtcccgcgcctgctgccgccatcccctgcttctccacgccgtctccggcgaggaaggtgactgtcgccgtcgaacagaggggtaaagatggaaacggtttttctgattgtactgcagcgtcaaacatttagactccttttaaaatgaactacaacgtcaaacaaaacgggacggagggagtaacggatttaaagtgtataaaagaattggaatggacgacatgtacgacaccaacagtgacctcctcatatctgcatggacggttacttgttgactccaataataaaagaagcccagtccaaataataataataataataataataataataataataataataatctttacctattataaaaattgaggatgattccatactcaccttagctttcgtccgtcatccgagttaaacacatataaaacccggatcggactaaaaaaaccatatagtagcgatacgactgttggaccggaaaaaaactgtctaccggcaagaaaaagactgggaaaaccatctaccggtgacgtggactatatactatgcaaaaatcagggatacatgcatgtgtgtgtgggattcaaactccggtctcctagggtacatactacatgctgcgctcatctagccaccagagcaatgtggttattgttttcttaagaaacttttctctatttggccggtttttaactcatcaatctccatcctcaatcttgttcacaggtccatgttacatcgcttctatgtcatctcagcttctcatgtgttattgcgaattctcacatgcttatcaagggtctaattggggaaaatttatacatcttttgggaacgcagtggaaaaattccatgcccgtattagggtagaatatggctcgagcagagggggctgccgcaagcgctttactggcatatcaaggcaaagcgtcgtccgagtccgagtcgtctgactcaataaagcgacgtgtcgttcgtgcatgataatgtagccatccgattctgactcggtaatacgtcgtgcatgcatgagaacgcagctggtgcgcttaggacatgtttttttctcatctgcatcgcttccccatgcagaagcaccatattcaatcaatatgtatcaatataattatgatttgagccagatatatatgatctaacaatctaacattgaaacttgaaagtcattataattggagtatgtaaattatttttatccgttgcaacgcactggtatttttgctatttattataaaatttaaagatgcatgcatgtttcataagcaagaaaacttctggctggcatgacatacggagcgtatacgtacgtgatggcgaccaaagtgatcgaggtttattttcccagaaaaaataataaaaaagtgagtcatatattttgtttcatgtctgccacggtgacagcctctggcctaagctagatcactccaaaacgccatctccagtgacgcacgctgtatactatagctactagcaaagagttatgccgtgtaaagtcgtacatacatacgatgtaccgttgattgatctgagaatttattatggtaatagttgacagttgttatacagtttcagggtcgtgttggacgtacggttaattcgcacggtaaatttgaagtgcacaatggatggatgcacaggatcttgcaaatgccaaattcttttccttatttgaggctacttcgtctcgatctctcttttcattttgtcaaacaagattatgtgtgcatgcaacaaaagaacgactagcttggaatattaacttgtacaaacacatgtttcgttccggcaacaaatataactaattaattgcaatagttaatatagagtacctccaaccttatcacaaacctatatcaagagaaatatgtgttccatgctccatctaatatgcagccttatctttttcttatacttatcagccaaaatttaaatttttcaaccttaaatttgaagctgattttgagtttttttttcatcgaaatttatgtttcagcctttgcttttagatcgctaagaacacatatataaaaattttattcacaaattacttttcatttgcaaatatgcctttctcttattccgcgaaatataccttaaacgatggctctgatgctaagtgcaccatgcatgtcggaattatcaacctaggatcttacatgaagaactaaaacgtcataataaatccaccttataagttagttaagatgcgaaagcgtgccaaaatctgtagccataatcatgagttgaataacaccaaaacattaggcacacctaatttcttaaactattgacgaggcatagtggattggtgcgtgtgccccaataagttgctggatttctattctaacacatcacataataggaaaccaatatccggtctctacacatatataaaagtacgcttccatataattaattagatgcttagatctcaatacaactctagttgatcgctttgtttttaggtcaactagtcataatagccataatatgttaatgccccccatagaaatttattctaacaataaatgcattaagcatctacttcagtgaatggaccaattaatagtagccaaacaacatggattgcagaagaagtacaattaaatagtagggaatacattctgcacacagttttggaaaaagaattttctgaagacactcttgattccatatatatatgtacacgtttgtttccttgaaaaacagatcaattgttctggcttcacttttctaaccacaaggggtagtaacatatttaaatcagattttgctaattggcatttgataaaaaaaattagagcaatattgtaatttatggagcatgggatcttctccatccactcattagcttccggggttagggttggggttggggccaagggggaaagatcccaatgatagtggtgaatacgggttggggggagggggtgtcgttagcaagccagcggtggtgccgccaaagcagcatagtcggtggaggatggtgcaagcagtagaggcatcttggccaactggttagatggtagtaagagagctgctggaggtaggagagatcgacgatgttggggaaccttactagagagctgcttcatgaccgtggttgtggagaagggtggttgattacagagaagaggataccggcaccagggagcgacaaaaggttttggtgggtggcggtagtgacggtttggggagcccggcatcgccggcgttggctatcggtgttgaggaaggaggcgcatagaaggggctgggcagcggggattggggtgatgtgactggaatgtgggaaaacaagaggattaggttttctctctttatatatgtgtatcagtgtttgagagttgatctagcccgttgaataatctttatttgagggatgataaaatagattgagatgggagaggattttcttgctaaagttgtataggccgtccccatttaattgtcacagttaaattgtacataattggctatttatggaaaatgcttggttgccacatcgtcgcatgcagtatattttcagcaccatggcctacaaaatcgttattttaccaagatgttctttattatttgcataacaaccccccccccccccacacacacacaaaatgaagatgccagtgcttgaatgcttattgtgacacaaaatttaaataacaaaaattcttatattttagaacgaagtgagtaattgacaaagaataaacttaattaattagttagttaaatatccgtaatctttatgcctttagcccttttgttagtttgtcttcacatcacagcagagaagatgggtggcagcagctagcagacacacttcatcccttccattccagccattccaaaagcatatgcccccaaaatctcagcatccctaccactccagggagaaaaacgaacaatctaggaccaatttaacatgtactagtacaattgttcctatctactactactctacacactgcaatttcttctcccctatctaaatgcagcactagctagcaatctgaaaccctatcaagcttccaaaaagccaattcggtcagcctaaaaacgaaaacggccgtctttgtggttgtggcaaaggcaaaaaggagtacagaagctttgtttcttcttggtctactagtaattcagttggtcccatgcatggcatgctactacttaggtcccttctagaacaaaacagaaaaacataaaagttgtagaggatttaaatcctatatatgggaaataattatgaagcattttaaaacaaaggattgattgtgtcaatgttctagatatgagataccttatacttatgtattatggctaggcgggctcaccatatacaaagtcctatatagaatattgatggttgttcatgtattcatctttatttcagggatctgaggcatcattttgggggatatgatatcttaaggacatgagggttcaacgaatcgactcaattcgagctggttgagagtcggccttttttaaggctcctggaacataaaggtgctgattctaaatttatcattggtgccagtacgcattgttgaattagtgttgcatgaaaaaccggcacctatgaccctttacaagctggcaccaaaggcgttcatttctcagccctcgtttctcattctcttctatttcaacatacaatctatatttatacctaatttaacaccataataattcaaatgtaagaatttaaccatatccgaatatacaattactcaaatataagaatttaaccatatccaaatatacaattacattgtacttctgcttagaatgtgtagttacagtgtaactacgatgttacatcctagttacatcgacagttttttagcgttttttagttaacaatttatagaacgacacccatataggtagtcccttaatttaatttaaaccgtgtgggtcgacggaaaacatggaaggtgtgagctggtcaattggaactgaagcccaaaattttttttcttttaaggaataagttcacctgcggttcctaaactttacatcgagtttgtttgtcatcccttatttccaataccataaatcttcatcgtaaactatacaaaaccgtacaatctaggtgctatagcaatatatatgtctggtttcgttgatgtggcatcctagttagcaaaagaaattaaaacaatgtgaggctcacatgtcagcgcccttttctttattctcttttcttccaaagcctcgagggagagggcggtagccggcgggagaggggcagccggcaagcctaccttggacttaggtcgggctccaaggtcagcaccggcgcgaccagacccttgctgcggctggttttggtactcttccaaccagcagcatggtggaggacaggtttgcgcaggatgaggggcactacatcgacaacagccaccgccacatccccagcagcggccaagaggagggatcctgcagccacgacgtcgtcgtccccaacaaccacgatggtgaggaggactatcacgatgacctcgacctcgacattctcttcgattgcgtagtcgtacctgtcccaggtggccacctcaactcaaatgccgccgtcttcatccccatcaccggtgggagccaggacctctactttgccaacaccaccgcttatcgccacctacatcaccttgtatgtgctcgtagcagccggtcacggtggaagaggtggaggtggaggcggccttggggcggacagatccagctcccccgccctcgcgagcggcagcggcttagggggcgggtgctgccggtgtgcggattcagcgacccccgctcttgggagtagaggaggcgccgccggccgtagatccagcacaccgcctgcagcagtagcccatgcgatggcccatcgccaatgtcacgccgaccgcctctcccctcgcccatctcccgtcggttgcctctcccaccctctccggctggccgtgtggcttgggaagaaaagagaagaaagaagagggccgctgtcatgtgggcacacatatttttttctattctttttgttgactagaatgccacgtcagcgaaaccagacatctataataccatgggacataaatttcacggttttatatagtttaggggtgaagatttctgatactgaggattagggatgtcacacaaactcaacgtaaagttgagggatgctggtgaacttattcctccttttaacaatgatgcactagctcggcccgactagttaaaggccatcaaggtacaaaatgggcttaaaacgcaacaacatggcgacgaaacccatgaacttgtgcatgtgggcctcaaaaggcaacacttgctagtacctgccctatctgccgctgatcggcttatttctgcgtgtgtgtcggtgtgtgtgtttatccggaataagttcacttcgtaaccctcaaatgtgatcgaaatccatgaccctaaactacaaaaccagatatctcgacccccaaactcctaagaccggtgcaatttgactccctcgatggttttggagggtggttttgctgacgtggcgatattgaccgagtcttcgttccacgtgacgttgacgtggcatttacgtggcagcagaattaaaaaaatatttatgggacccattagtcattcataaaaaagaaatatggggtccacatgtcaatcatcttccttcttcctcctccctctctcccttctctctctccccttcttcccctttggcctgcggcgggcgatgagaacgagcagcggcggcctccgcgcgtccgcgcgtgccgctcctccccccgcgcggatggccgacgtctacctccctagcatgcagacggccggcaacctcctcctcgcgcgcggcgctgccgtccggctggcgagctcctcatctgggatgggaccccaacgccgcctggccgcacatctcctgcaaccgcaccaaccacatcaacaacaccgacctccccggcgtacgttgccgccgcgcaacagatgcagagcctcagcctccaggacgaggcaacgtttgatggcaatgaggtagacatgtagagctcgtctccaagggtctgcaaggccaccatgatggcttcagcttgatgtatcagccatcgacccatcatggccgccgacgcaggccgccgtcgatgttgtctggttgatggtgacagctgcggtggcagaggaggaggagctgaccggatgcggcttgggcagtagttgctggtcgcctgcgctgaggcagtggcgtgtcgcgaccgtgcgcaagcggtggcgccgttgtgtgagctacagggcggagcgcctatgcatagcatgggagagaaggggagagaaagagagagaagggagagaaggaggaagaaggaagaggactgctatgtggcccccacatgtcagtgggcccacattttttttttttgtgtgaatgactaatgggtcccacacatattttttaattctgctgccacgtaagtgccacgtggaacgaagactcggtcaatatcgccatgtaagcgccacgtggcgccatgtcagcaaaaccatcctccaaaaccactgagggagtcaaattgcaccggttttagaagtttggaggtcgagatatccggttttgtagtttagggtcatggattagatttcgatcacatttaaggatcacgaagcgaacttattccgtgtttatcctctccctctttggtgcttccgatatatagtagcactctcatgattttaagagaaaaaatataatagtactctctacgtttccatttacgaagttttagcatataaaaattagaattattattaaaatattcattgtgatattcaaaatatttttagagacgtctttcctttcttcattgagtactattcctttgaaggaattgtactactacctccatttcaggtttcaggttataagattttttaacattgtccacatttatatagatgttaataaatctagacgcacatatatatttatattcattaacataatatgaaacagaggaagtacctgttttgagaacgattattatgatgcaattgataagagtagcaatgtaatttatgagttatatgacactttcttgtgagatttgatagagccatatatccgtatgtgttatggtgtctggatgtgaatttctctctgttattctatatgtcatattggttatttcgaacctcatatattaaaaatggcggtagtagtttgatgaattttaaattttcacatgcgcctccgtctcctctcaggttctgagattcagaagcttcagcgtgcatgtatggtgattaatttttcttagaaatattgtagtacaaacacactcactcataatataaatatatgtatgctcatcttttttaatacacacgtatattctacctttattatttccagtaaatcgaaccattattttaattagtctcgtgcatgatgcagagaccctggaaagggcgatcgagaattctctatcaagtgtcaactcactggcactgcacgtacatccatcgtagacaacagtttcacaaggctctcgcaaatgcacgagcatatatatacgtatgatttgtccctcgtccatcgatttaattagctagcttttggtttgtgttgtcgcacacaagagaatgatcaatcatgttgtccacagctgccaatcgatcgatcgagctttatttcgcctttaagcaacatagtagcatcgattgatggcaatatagaccactcccttcctcctcctgctagctatagccccgttcgacaataacataacggatgaagattaagtgttgacatacacaaaacgagaaaaaacacatggttaataatgtaaaatcaaatgtgtttttgattattattctgtgatgaacaattggcatcggagattattggttttgatatttggaatttattcacgaagtggttttggagatgattggatttcacaggtgaatctacaggtactgctggaattgggtctggtcagaccgagcaggtgttgccggtcagaccggcgtgtatcgcgcggtcagaccggcgcagcccgcggtctgaccggccgacgctgtgtcggtttcggtttcgggttgtttgtttggatatccgtgattatttcatgattatggcttttagatggatactatacgtatgtaatactgttgtttgctactaatgagtcaagttggagatagcttggtctcggaatatggtttctttgtttatttcatgtgtaggtgactcgatgcctcgggagagtatttgcggtgatggaccgggagtcggctcggggataagacgacgtccgtggtggtcagagatcatgcgggatacttaggctagagttgatgcacgtggttgatggagattccatatggcatacgatggaggtattgtgtgcgtatgggatgcgaagtcgaatttgcaaggagtccaaatttagtatgattggttatgtaaagtttgtttcttgtactagagggtttcctagcttgccgccggtcttaccatcggtgagtcgttggttagaccgctaaagcccggtaaaacataaatcgaagaactcttagagtagtagatgacgactttattgattctctctgtgtttacaaagtgcaccaacaacactccttacaaaaatttcgactaaactcgaaaccctaacttaaaactcaactcaattgctctccaaagcgataccgggaagcctcatgctccccctctatttatacccgaggtaggcagcctaaagtcacgaaccaaactcatactaaaagttctaaacaccttacaaggcgacggtcagaccggcgggagcgaggcggtcagaccggcgacggcaacaggcgcggcaggagacttcggcgatcggaccgattgatctatatcggtcagaccgacggcatccacacggtcagaccggcagatcaatctcggtcagaccgatctccgtcgaatttgagggtaagttttatttccgctaaaagtttttggtttttgggtataccaaccattcacccctctctggttggcttagttattgtgattcgatcctacaaataagacgtgaatgttaggaaaaaacctaatatcaataattagaaggggtgaggcttcgaacccaggtcgcctagcctaccactttgtggagttagccggaacacccctggtgtttctccatggtttattaaactttaattatttcaaactctaaaaattagatttacttcatattttagagtaaacttcacaaaactacagatactttgaccaaattatcacaaactacagatttagggtgatatatcacaaaactacagatttaacactaaatttctcacaaaactacaaatttaaggtagaatatcgtaaaactatatacttagtaataaaattatcacaaaactataggtttagtgataatttaatcacaaaacttgcacgtttataactcaaacataacactaatgctaaggatttaaactctaaaatctgtaattttgttattaaatttgtagttttgcgatactccatcttaaatctgtagttttgtgataaatttagtgctaaatctgtagttttatgatacatcactttacatctgtagttttgtgataatttgatcagaatatatgtagttttgtgaaatttactctatattttataacatcttctatattaaaatatatgtacgaaatataccggttagctgtttaaaaaatgtgataataaaaatgaggtaaaaatttatatcttaattaatcagaaaagaattaggtcctcgacctagctagctctcttattctgcatatagtagagtagttcatgttgaaacgttattcctgctcggttttctgtagagaggaggacgatgcctaatcatggagctcatgaatgttcatggaagctaattaatcagtgcacatatcgatatataatatcagaccgtaaatcttggctgtcaccgcggtgctggtcgtcggacaaactgatcgtgatagatgccggtgaagatgtcgctaatttgctggcacaaacgtttgaaatgttccgacaacgacatggaagtggaatgtcaccaagttgcctccttgccggcataacgagttgatgggggtggattttcagttatacacccttattgtttgggatgccctaactctcttaaaattcataacactacgccggattagatcacctttgacggactcgcgcaccatcatctttgatgggtttgaccctgattagagatgaattgttactgatgactacactcaccccgttaatggcgacagacacctctaatgggcccgtatatttttggctcgtcaaaagtgaggatctccacaaatcaatatgtggttgtaacccgttagagctgagacacctgtgatgggtgcaaaattcacggcccgttagagatgaccccatctctgacgaatctactttggcgcctgtcacaagttacccacctctaacggagtgatataccaaaaccgtcacaaccgaggttacttgtgacggtctttatttacgacctttagtgatgaggtaatttcggaaaaaaaataatttctaaatatttgctagcctcagtatttggtaggcatgctctctaaaaaacagtacattacagatattccaaccacacccaatatcacatatttttacaatttatcacagatgcatcccaaaattaacattctacacatgcattctaaaatcccataaaaattacatagacagtcacatattcccaatgcacattcttacctcacatttcttttgagcttgtgaagccacaaacttacccaatttcttgcattgcacatgaagctgtaaacttacccaaattacttgtagcatatgccttttaaagaagaacgatgagctgccatttaaaaaagggataaaacaattgaaagatacaaagtagcaattattgagtagatgcaaggcgtagtaaccaatttttatgatatgttgttcaaaactgccttaagttataaaaaaacgatagaatacgagatgctaggggtcccaaagtgttttaaacgggccgcggccggtggcctcacctgatacggtctcccgatgaacctatcaaaggtaaggctatccttgatgagtactttggcccatcactgctgggctgtcagaggtgaatagttctgacgtagtgtaaacatgtacattaattttgaaatcaggtttttgaagctccagaaatgggcatggacggaatagcacaaagcacataattaggtttcaagtggaagaaatgatttatgtaaattgcactgtcaatgaatgaactttgtgcaatttaggacatcaacttataaatcttgtgggaacagatgttgtccacgagcccatgttgccctagcagcagttcattatcaggatagatgtcgtatactccaaagagagacaccccagtataggagacaccccagttcggtgtcacccgttggataggtgacaccccagtagtttattccgacaaaatgctagaaaaggaggttaattacgagatgacaaagctttctgtagtgttttattcttacatttattagtggaagtcgccaagctgccggcctaactagcggtggtggaggtgatggattttcagttatcaaatcatatgcattgcgtgggatggctaattacctatcaaaatattcataaacatgtaggtatagttttgaaatactcactccgtttcacaatgtaagtcattctagcatttctcatattcatattgatgttaatgaatctaaacatatatatctatctagatttattagcattaatataaatatgggaaatgctagaatgacttacattg

SEQ ID NO: 1066 - DNA, 3662 bp, Oryza sativa
atagtcagctttgtcggagtaaaataattgccaaattaccactgcgataacaatataatgagttacccgtagtgattattactcactccgtctcaaattataatgcctatatatttttttacacggtgttattgattttgactttaatttatttcatattatgttcttaaaaatttaaaattagcatcatacttagtatatatatagtatgaatcaagggatataatatgcataatacttagtatatatacatagttagtatgattattagttaaaagttaccaagtttaattttttttaaaaaagagatgccctataacttgagacagagggagtagtacatagtacaatactaggctactgcagccacgatgtgctgttttattctgggttgtaggaacattgtagcacatttatttagaccattcattttagatcaagcgatagaaaacgctactagctaatgcgcaatatttttttttgaaactaactacaccagatgatgtgagattttatattaatatagaaaaaactataaaattacagcctagaaaactataatcaggaaaagtgaaaaaatcgcacctccacaccctgacgactcctacacacctattagaggacataaactaacatcgagccaaccgttatacatgactgttcgccatcaactctataacggggttaaggcactccacactataaatttagttaaacttagaaaaatttaagtagaaaaaaaatcaaaacatcttataatataaaaagaaggaactactagctaatacacaatgacgttcaacgctactgtataacgagcagcaacggtagaggatcacaatcttcattggatatatatggtttgagaatagagctgagatagattcgaggcagaaaattaacgaagagaaacagctgaaccgggaaaggaaggtagaattgggagagagtaaatttgtttagtttattgtttttctcctcttttttgtttttctttttatgcacgtgcggccgtcctcatttcgtaccgatcgtgtggaaggcccaactgcagtgttcgtgcttggtaggcagcctttcatttttgacaggaactgacggctcctttgcaacacatgatttcaaaaaacataagcacaagaaacgtaggtttaatatatcatatcttgtgaatttctcgggaaattagaaacatgggaatgttcttaaaaatagtcatttgggtgatacacagggaaaacgaagtaattgtagacacgagaatagaataccaccaagaggtaggagtaggacctcatgtatgttttccttcaaatctctatataaattagttcatttcgtaggattttcatgcatcagtcctctcttccaaatgatttcagaggaatttcatcctaagaattcaaatccttttcctttgttagtcgagcgatgctcctaacaatttgttaaacgatggaaaaaacatttgttgctactaactaaaactctatttctttttatatactgacgttcaatcagggttggatatacagtgtaacggctggaatcaggtgacactgacgagttttggcaaaacctatagttaaactacttattcatatattatagcaccatgatctaagcataattagcatactatgacactagtagatacattatgacaccaacgaatcaattttctagatacgccactgcgttcaatctttatgtgtgttcgtgaaaaaacattcgctgctggtaacagatggagtccttgctagattttggcagcaggcaggcagggtgctgcaattacgatctgtcggattcgatcgagcagggatcgatcgtactcgtgtgtcggccttttcgcctgcatcttgtcgccttcttgctcatagctgcttactcctactacttgtactatttacaagtgcgtatatacagtaccagaatttctgcaacggtttggctaggtagaaaaaatagacctgaacatttttttttaataatgaaaatggattacatctctggctttctgtcataagacacacagccataagtacagccataagtttaatagtaataaaaaggtaaggtaaaagtaaatcaaaatgagaaataaggtgatgggacaaatctccaactcccctttattattgactagcgttaaaccacataaaatttttttagctagcaattctaatagaactacgccacccatagtggaacaagagacccttagctaccgattccaagagtatagcaccattgcgcatagtatcctgctcttcctgtggtagcatcgtaaaccaaaagtggagctagtaggaagatatgaagataacctgtataaggttagataattgtttaccattaaaaactttatcattacgacaacaccaaattaaccaacatatagcactagctccaattagaatcatctttttaatggacctagatatccctctaagccaattaccgaaaatgtttttggcgttacggggtgggggatattaaaagcaaaaaacacacatctccaaacaaactgagtgacatgacactcaaagaaaagatgttggattgtctcttgtgcatagcagaaagaacaatgtttgtccccctccccctctccccaaattttcttttagccaggttattatctttcgttagaattactttcttatgaagaaaccacataaagaccttgatctttagtggaattttcaagtcccacagaattctctttttgatccgaacattacagttcatgatcgtggcatacatagatttgatggaaaattgaccattcttatggagcgaccatacaaagctattcttttcatttgacagagttatattagcccgaggatcaaatcgttccactcgattagcttttggccaacaatagctctcctaaaagatatatttagcggcgttgtgtgtaaaatcaaaggtgctttttattattattctgtgatgaacaattggcatcggagattattggttttgatatttggaatttattcacgaagtggttttggagatgattggatttacaggtaaattacaggtgctgttattttatgtgaccggtcagaccgggcagtcgttgccggtcagaccggcgtgtatcgcgcggttagaccggtgcagcccacggtctgactggccgactctgtgtcggttttggtttcgggttgtttgtttggatatccgtgattgtttcatgattatggcttctagatggatactatacgtatgtaatattgttgtttgctactaatgagtcaagttggagatagcttggtctcggaatatggtttccttgtttatttcatgtgtaggtgactcgatgcctcgggagagtatttacggtgatggaccgggagtcggcttggggataagacgacgtccgtggtggtcagagatcatgcgggatacttaggctagagttgatgcatgtggttggtgaagattccatatatggcatacgatggaggtattgtgtgcgtatgggatgcggagtcgaatttggaaggagtacaaatttggtattattagttttgtaaagtttgtttcttgtactagagggtttcctaaggtgtttaggacttctaatatgagtttggttcgtggctttaggctgcctacctcgggtataaatagagggggagcgt

SEQ ID NO: 1067 - DNA, 1253 bp, Oryza sativa
gtgccaatatttctaggaaattgtccctttctaaggacaatttcgtttttccccccactttcatcttcaatattgattttgcccctatcaaaagctttactgctaatccatgtatattcgtgacaaatgtcgactatatattttgtacctgtactttgtcatgttcatgtattgtatctctgcggtcttctcttctaaattgtctgcgcacacacagataatacctcagtttctgatctaggaagcagactgatcatcatcataattttcatgatgaatgcaaacttcagttccattcgcacatccatgaatgctttttgcgaaatatcagttccagttccatgaattgcaaagtaatgtgggttcaagcacggtaatgaataaatgctcattgaaaaggaatcagacgaggtcatttcataaaatgggatagttgatggatcatggatgagaaaggaaaggtccatcagcagggagagttcctcagtgtcagtgaaacgttctgtggttatgcggatttgtgctggcacgacagtccgtcaccgtgtgctccagctctggtatcaacagtccattgctccgccagctcgatccctcaccggcgatagcatctgctacaatcattaccgaagccaagagcgacgccgccaccaccggcatcactgattagccgttggacacaatggccgcgtaagccatgcgagctatcagaatgccttatccgacatatagccatcatttaaaattatgaccagtactatacatgaaagcaaagtagcaactcacgagtgttcagttattgctcagttgaataaaatggcagttattgcttccttgctttatcagctaaccaccatatgatttcctaatagcacaaaggtgacaatatactagtaacagtctagattcatactttttagattataatcatgccaacagttcagaacatgcgaagacacctgaatgactttcatgatcatactaatatggtcaagaggaagtacgattcgtagatagcatcgcgatacatcagatcatttgagtgatacagtaaatagcgaggtaggcaagactgattcgcttcgagggatccatggaacatggtggcccgaggtttctccttcagtactttggtgctggcttttgggttgacagcaacccgaatctcttcttcaacaggtatctctggcgtgagtacttgtcatctgaaaaaaagcgagctgcaacacaagcacaacctcagagatcttttt

SEQ ID NO: 1068 - DNA, 319 bp, Oryza sativa
  unsure (1)..(319): unsure at all n locations
nnnnnnnnnnnnnnnnnnnnnnnnnnnnnnnnnnnnnnnnnnnnnnnnnnnnnnnnnnnnnntaactcctatttacaattcagattgcttttatcttgttcttgcttgtttcttcgatttgcttgcaggaataaggttgatttgcaccggcaagatcaacaaaccacggagaggtgtattgatcgctaaggcgcaacacaacgtctcgtacggttgtagtcgaatcgtcaacgtttctcccaaatcgtagttatcacaactcaccgaaagatcgggccaacaacagccttaagtgtcgaaaagaactcatggttcatca

SEQ ID NO: 1069 - DNA, 538 bp, Oryza sativa
  unsure (1)..(538): unsure at all n locations
nnnnnnnnnnnnnnnnnnnnnnnnnnnnnnnnnnnnnnnnnnnnnnnnnnnnnntgtcgaaaatgcagtcgttgttgtacagctccgacagctgcaaaagaattcttaacttcttgtgttgttgtgttctgactgacacagctgaccgggcgatgtaagacagtgaaatgcttctgtgctggataaatgatgtaccttaggacgaaggaactcatgcaccttgtaagttgcaacaggggagctctccacgcgcaagtcccagagctgcaaatggcgaagttaactgaagttattcaggaacactgaaggtttcagtatccaaccatccatatgacacgctgcctgtacacttggacctttttagaagccatgtcaagtggaattcagaataccttcaggttcatgtagtctcgagttagcagatacttcccatctccggtgaacttcacatcggagatgcaagagatgatctcggtgaagagcgtcctaggctgcacgctgttcccacgatcctggaatctgaaaaacagtaacgaac

SEQ ID NO: 1070 - DNA, 346 bp, Oryza sativa
  unsure (1)..(346): unsure at all n locations
gcnnnnnnnnnnnnnnnnnnnnnnnnnnnnnnnnnnnnnnnnnnnnnnnnnnnnnnnnttctttttttctttaatgggcggagattgttatggttgtcgtccaaatgacacttggatgggacaactcacacctacctgcactcccggcggagacgggcgcaacgtgagatcgtggctgcccgttgctgatgcgaccagtgtcagaccggtcattcttgtccaccacgcgtcagtttaacaacgtgcacgtttgccctttttcgtgtaacaccttgcctgtaatgggtaggatgaagcctggtataaatctaaccagggctaacgtgccatctctaaaaaataacac

SEQ ID NO: 1071 - DNA, 242 bp, Oryza sativa
gtggcgtgctgcgggcaggggccgtacaacgggatcggactgtgcacggcggcgtcgaacgtgtgcgacgacagggaggcgttcgcgttctgggacgcgttccacccaacggagaaggccaaccgcatcgtcgtcggccagttcatgcacggctccaccgaatacatgcaccccatgaacctcagcaccatcctcgccgtcgacgacgaggaacggcgcctctagataaatagatagatatg

SEQ ID NO: 1072 - DNA, 819 bp, Oryza sativa
ccaaacaagtgtagcagctaccattagcaatcatgcaaccaaaataattgtaagcagaacagattgaaatataaaaattatcttgacatacaggtgaaagcaacactcgctgtagagggagctctgtagaagcaaagaggccaacagctgttgcaacagtgcgtacaaattcttcccgcaccctccagctcttgtgagtccatgcataacttccagctctttcaacaatgattgtcggtgatgaaacctgagaatgtagagagtaaaaacagcttagtataccccgcaaaataatatcagaaccataaaggtccataagaatataaatgaatattaacattggaaaagcaacagtccaacaaaagatgagaaatctccatgcatacaagagaatatacagcctggaaaataagctcaagccaccaaggacattttttaaattcaaagtacaaataagtatttattttcaatggtgtagcaaattagcaacaggcaatgccatgtttcaaatgcaactaaaacattgattttgaagggctctgtccaaattcatagctaaaggtagctatattttgagacaaagggagtaaaaaagaagcagcatgcagaaaaggagaaatataggttcaactagctaaattctgtgtgttggtaattggctatggaaaaaaataatcaaacatgttctatatccaaaataagtgaatatgattttcgaacaaacatgtattttccccttttgtgtgcgcgtgtgtgttatagacatgacaattcagtcgttttgggctgttccatattaaatttgatttttcttaatgg

SEQ ID NO: 1073 - DNA, 504 bp, Oryza sativa
cgtgttgtttctctcccgtttttgcaatgccacggcggccatggtgggcacatttggtacggtgctcccgcgtgcatggtaaatgggcctcatgtgatttgggctgggcgcctgggcagtatatgggcttgatgggctgggtgtaatatttcttcagcgcacaccttctaatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgtttttcactgcattccgtcctactatttgtaaagcggaatatgtctgtctaga

SEQ ID NO: 1074 - DNA, 3682 bp, Oryza sativa
  unsure (1)..(3682): unsure at all n locations
tgtacatgctgcggcggcgccgtgcgtgatcacgctccgagatagcgttactggtttggcggcctgcaacgacgacacgttaatatataccagtaaccgcgtttccccgcctgacaaaacggagttttatacaattctagtgcactaatcaaaggttagcgtgttcaagtgcaagatgttagcacgtaactatatagttttctatggcaggagagctttgctctggtccttctaaagtccagctaaagggcccgtgtttttatctgaactttttttcccatcttacaagctgatgagactaggggtctttctctgatctgccgatagattaagaaggaccggtcggttctgatatgtcaactggtggattgggctttctttgctttgccccatcacgcatgctctttatctttagatcaacaaggtaaatgatgagtgctgaactgatgactgggaggatcgactgtgtatggctccgtagtataccatgaattaattcttttgttattttgaacgaaccgcaactgattgtgcaattcttttgttatgaattaattatgaatatactccctccattatatatttataagccgttacaaattatttttattaaatattatgtaaatatattttgataatatgtttgttttatgttaaaatatggctatattttttgaaaaaacttggttaaacttaaacgtgtttgactagataaatattaaaactacttataatataaaacggagtgagtagatattaggatgtgtgacacagcacaaacacgaatggaagtggttttcattttttactccaaatctttgtgtcatgataaagtgaacgcacgtcactactaagcgattagtttttgttctcttgaactagcgcaacttcattgttatatatccacttgcttctttatatattacattttccttggcaagaagtattgctaagttccggatgcaattatgcagaaaacgacttatcgccttaagttcacaactaaacatggagcatatggccaacttaaatttcatgcacgaataatatagaataaatagcatgatattcttctacatgtgtggttactattacaacatatgtccacacatgttctcattcaggtaataataacctaacttaaagggctgtaaaagttatactgttggacaaagcctgacaaccattcaaatgaaaaataacttaaaagaccactaatctacacgataagaatatattggtatacgcttgattgctagtagtgcttacctaagtggtgtgtttatttaagagtttgaacaattgaacagaaaacaagtatatgcagcatgtttttattgaaaattgcctgattttgcaccaaaaaaaaggcatagcctaacggcaaatctttaaggtcattaaatttctaactaaaacaaacccacatgcgtttactattagcgtgcaccaagatttaatctcaggtgagtgtagtcatacacttcaccatttccacataattcacattataaattagaaaaggacattactttattctttcgacgccacaaattactgtagctacggtgtaaagaaccatacagtttccatgctatactcccgtcaaagctagaaatactgttttaaacattgacaagttcttcaaaatacatttctgttgtaaaacattttaaaaacctaatgatattataatttcataaaatatttttaaaagcaaatgttctacacacatgatttttatacacccatctagtagtaattaaatattgggaaaattgcaaaaccaccccaaatatcactctaagtttgagataccctccctgtaagaaaatttgttgcaaattcccaccttctaatttaccttggttttgatttaggcaccttggtttggaatatatagtgagtttaccatgaaaaacacaatgaaatgaccatgataacacaacgaaatgatcgtcttatacagaacaaacaacataatctcttgctcccgccgagtgggactcggctgattttgccacaagattcttcatgaatcacgtacgtgtggagagaatgtgtctaaatcaaaccaaggtgaattaggaggtggggatttgcaacaaattttcttatggggaggcatctcaaactcagagtgacatttggggtggtttttgtaattttcccttaaatatttaaaaggatgcatgctaattaattagttttgtatagtttgacttaaacaaatttgaaatgatatgatatgtcgtatgtaaaaaagaaaatgatatgaaggaaacgctagtggttttgtgtggatacatgacttaatccactaccactagagtataaaattcttatacccataaaatattcgcatacgcacttgcgctatcaattcagtgatattagtgattttctgctagcctttatctgtttagcactttctccgttttataatgtaagattttttaacattgtctgtatgaatatagatattaatgaatctagacatataaacggaggaagtatgtattagagtacatatattttttatcggaaactagagtacatgcattagcgtgtacgtgtgtgatggtggtgtacgtgcgcgcatctatcttccgtgttatctaaaaacacaacacctgcatatgtcatatctgctacctactnnnnnnnnnnnnnnnnnnnnnnnnnnnnnnnnnnactgtacgcaccacgtgcaacacgtaccaagtaccatgttctcaacctaataaaaatcagctaattacctgtgatgatcggtctttccacgcgataataccattgtcacgaacccatcatgcgcaactaacgaaccccgcgccgcgcgaggatgacggatcgctctcatgaaccctacctatccatgaatccatccatccatccagcgaaattcgcttccggcttcatgccatccacgatcccagcggcacaacgcgccacacaccacgggccgctcgtacaagtccgttgtgctgcgtgcagagtgcagcgtgctcctcgacaaggaatctctatctctctcgtcaattctcctctgctctcttttttttgttttttttgtcccatgttaatccctactagtcctaagctaaagcgcgctctgatgggggtgatattatcacatcccgatcccgcgatatcatcagcgcccactcactcacgccgcgcacagccgcgcgcactcgcgagcacgcgcgctttacgctttttcttacggcttaaaccgtgtgaccgagcgcgcgggggtgaccgaccggtggattccacagtgtcgcgcgcgcttgaccccgagtcagcgtgcggtcccgactccgactccgcgggcgcggttgcgcgctgttggttggagtacgccgcggcgaacgacggggagagtggtggactggactggtagcgtgacggtggtggggttaggccccggggctcccgtgttgacgacgcggcgacccggccgaccgtataaagggagacgtactccctccgtactcgtaaagaaaatcatttagaacaatatttaagttaaatcttagaaatataaatcatgaataatcacaagttgttgagtttaaaaatacaaaaattatataaatagatttatcttaaatcattaatnnnnnnnnnnnnnnnnnnnnnnnnnnnnnnnnnnnnnnnnnnnnnnnnnnnnnnn

SEQ ID NO: 1075 - DNA, 827 bp, Oryza sativa
cattgacacaatcgaaaagaagcctttggtatgaactttgctcccgaagctccaagactttgttgaacagaatcggatcaagaggacagtcaggtaaatgccagccagtgaaaagcatactcgactgcgcatcgtctaatccagcagacgacattatattttgcacaagaacatggcattccgattcatcgtcatctacatcagggagaaaagaagactgccctcgggtgccaggtaatgctgattctgaagtggtgtcgtcccatgataaggaacaagcaacagcctcaattgctgaagatcttgagacagcttctgaagaaagttaagcagaaatgtcagtatataaactaaccaatctgagacttgaagaactctaggctggaaactagacttactagcattttttgatgtagtgcttgcagatgattcaggttcattacaactgctatcttcagagggtgcatcaagaactgacgtagggctgggttggtcgcgtgtactatttaggacctcattcagtcctagtttattcaggtttccacttcgacaatccaatgatgcaggtacatcagttaaagcagttgttccctgtaataaaatttctcatcaaattctctgtggccgaacaaatgcattgaacaaatatttcttacaaatggaagaaaggatgtcatagctcaagaataaatgtgcccatatcaattacccagctatatgaaaagaacataagatttggcttgcaagatagatgagatgaagtgcctacctctgaagtgctggttgattgcacagcacaaatatcaagtatgtcctcacaaatggtg

SEQ ID NO: 1076 - DNA, 548 bp, Oryza sativa
tttaatttttttcatagcaacatgttttggtttgtacaaacaaaaaatcattcagtacacacggacacacagctagaggtggagactatcagtccaaagactagtgatgcgtgcacatattgatgctttctctgttggtcatggtctcatggatgacgcggtaagtcgaaaggtccctgtaagacgttagtgcttctcatcagggagtgagggtagtgtgcatgatggcaatgattgggtgcactcgcaagaggaattttcgcttcccctcttgctcccccgcctgtacaaataaagagaggttaagggagtttgtttgggagggtctagcccgtgattagtttcaaagtttttcttccaactttcagcttttctattacatcaaaactttcctatgcacaatctttcgccttttctgtcgtcatcattcccctttcaacctagctttcaattcccccgtgaactaaacacagctctaatgtagctggagtgctggacctggtgcccacaattggtggtgctgatttcctctcttttgtggtgggagc

SEQ ID NO: 1077 - DNA, 460 bp, Oryza sativa
ccaaattcaggctgaaaaggaaggaacgttgttttgacaagaaggtgaggtacgtgaataggaagaaacttgctgaaacaaggccgagggtgcgagggcaatttgttagacaggcaaactatacagatataaccagcactggagatgatatctcagaagatgaagatgatgatccatcctccagggaggtagagatggtttcttctccagagtagtttgaaaggttttcctatatgtaaaatagagtgcagatgattactgctcactttgcaactcattagatgtaggcaatacatttcttctgcttttaactaggcaatacatccactcgctcacacacaatacatcctttttgtcccccaaggaacttgtggcatatccatcactgttactatggacgttttggagaaaatcatctttgaaggtgagatgtaattatgctagttagtgatgcataggc

SEQ ID NO: 1078 - DNA, 359 bp, Oryza sativa
agtgagtatgccatcctaatattggaatattgggcagatgctcctgaaatacagcgtgcatctgatatatacgaagatctaataaaatgctgtgtggctgatgcaatgagtgaggtagggctaacaccatccatttttcctgacttaagtcaccataatgttcagtattaattattaaatgcctgaaaatttgttttgatgttattcttgtgccgtgttgcaaatgcaggtccgtgcaactgcaagatcttgctataggatgttcaccaagacatggcctgagcgctcacgtcggctttttatgtcatttgatcctgcagtacaaagggtatacgattatacttttctgcatgtttttc

SEQ ID NO: 1079 - DNA, 1057 bp, Oryza sativa
  unsure (1)..(1057): unsure at all n locations
nnnnnnnnnnnnnnnnnnnnnnnnnnnnnnnnnnnnnnnnnnnnaatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgttttccactgcattccgtcctactatatgtaaagcggaatatgtctgtctagagctctagggttcttttttatgtcttgggccaccaatgaattgtttacgcatatatgtatgtgtagattcttgagtacatccagaagagtgtagagatgctcagaaatgtaatggattccttttggctttggctctaagattgtagtaaaagagaatccattatattacatgcgggatagagattaattaactcgatcatcaacataggataaagaggcgcaaatataccgttttatattaaagccaaaacataacctaccaaaattttggtgacttaagtagtaaaataaaggaaaaactaaggagttatttagtatggaaatcctacaaggaaaaaaaaactagaaattgctactccctccgtactaaaatataagtgtttttggatggatgagatacatcatagtactacgaatctagatagtctcttgtccaaattcgtagtaatatgatgtgtcacatctactcaaaagccctttgtgtctcgaaattcctatgtttttcatatagtgctatcaaaaaacattttcacaatcttgtggatttactttctatagtatttaatgaggtgtggcatcctattttacaaatttgtgtatttactttccatattattcactgaggtgtggcatcatgttcttgtattttctaaatcctgattttcaaatacctgaatgt

SEQ ID NO: 1080 - DNA, 1323 bp, Oryza sativa
  unsure (1)..(1323): unsure at all n locations
nnnnnnnnnnnnnnnnnnnnnnnnnnnnnnnnnnnnnnnnnnnnnnnnnnnnnnnaaaattatatcccaataggctctatgaatattatagtatttataagattttatttgacttgggcttttttatcaatttatattggaatttggataaaacttctcgaaatctcaaacagtttctactttcaagcctcgtcggaacgtcgaaatttcgcttaatccgattggatttcgtcggaatcgtaaaccctgatagcaaaccaaacatattctttggactttcatgctctttgcatggaattttggacttggttggtttgtgccaaaggccctgtttgggggagcttggcccaactatagcttttcccaaaaagctgcttctactagaagctaccccaaacagtccacagcttctaagaatctgtagttacagattctgaaaaataaactaagaagctgggtttcagagctcttccagattctcagaagctggctaccaaacagctgcttctcagaatctaaaagcttccccaaacagacccaaacttacccaagccaaaacaattggcaatgccaaaaaataatcattcacttggtttatgtaaaggtttatgccaaaaaaattgacaaagtgattaggaaatggcctttatttcctgatgcgtacggatgtaccttgcctgcttggcatgcttggtagattcattcaatcgagaacctaaacaagtaaccgcaccagtgtatgacacgaaaaaaacacaacacgtttccatcttactgccataacattgaactatatagaacttgtggtagctcaccatcaagctgcacatcaatgttctcctcccccatcgtcatcatggcagcggtggactagctagcttcggttccgcgcgtcccatcaccatcagcatcgatcgccggcatcttcaggtgtcacgggtgctagtttttttttttcccctggtgatcgtttgtccactatcctaacacgcgccactgttgtacacataaaccgccttctcttctcccccgctgcatcgcacgatttcgcaacgacgatcatacgattattccctctccctctacgtcgcctgctgcacaacggaacaaacagccgttttcatgttcgcgcccgcctactcgtcccagctcgtcctgagtcctgacactggcttgggctgacgcgtcatgtacatgttctcatacatgtacatgttctcatacaatttgttcggaataaaatcctgtggcgctgtgcatatggctggctggctctggctcggctggacctgaatacgtacgtacgtatttgacatgcactgg

SEQ ID NO: 1081 - DNA, 548 bp, Oryza sativa
tttgggacaaagtttgaattacagaagttgatttattttgagacgaagcgagtacacatttgtttctggcgtaaaatgacataaacagtgtacaaaaaaaggggagaaattcatcagttgtaacttgcaaagacatatcatcgttgacaggcaggaacaaaatccagcacagcttctccacgagctccttccagactccaccctcaatttgctcggtaatgtcaaccaactgcgtcctcatcgttttcacccagcctgttccttcaacctcctgcttcgcaactctctctatcatgatcccagcattatctctcgtgctcacccagaacatccgtgccccgtaaatccaatctttcaggatgctccaaacttctatccgcaatgcaggagagaaggcgtccatccatgttcttgagtgtgctttgctccatgggaatgtacttagcaaggtgttctcgcggatctcaacaagagcaacattgacacaatcgaaaagaagcctttggtatgaactttgctcccgaagctccaagactttgttgaacaga

SEQ ID NO: 1082 - DNA, 831 bp, Oryza sativa
agtaactacctgacaaatttataagtcttcttggttgactatattccctaataagccacttattaggaaataaaaattaatttatagataaaaattttatatatttattcttagcgacttaaaaaccaatgctgaaaaagaaactaagttaagtatatcttaaatcaacttcaaaattaagtttaaaaattcaaattttggcttttgctctagcttattagcccaacagatgggcctattgtctatgcagtgaacagttccatactacggcacagtaagataaaagtttacaaaggttaccattgtgatttattaaggcttgctgccaagatattattatcaagattcctgtttataatttgcttatttgcacacgctactttatcctggcaaatccattttattctgactgtgatttagtgatgcctatattttgttggcgcctacaatacaatgtagatactactagcatatctgcttatgaactacagatctgcaaatgcaatggatctcaaataattatgcccacggttcccacattagatgcgcacgagtaattaaactctctgcaaaatggttccagaaatgccaacaggacaatgaacaaagcctagtcagtttagcttcaaattcaaacacaaccaatttgcaaggaatagttaatttcggagcaaatactatcgaacaacagaactgcgcagaacattcttcagaggtagtacatggctgatcacaaaggacaatgatgtgaccatgactactatagatacaaccgtcgttcacatcaagatcaagctgtccaagttctgcaatccagttcggtcacctgct

SEQ ID NO: 1083 - DNA, 729 bp, Oryza sativa
cagttagtgttcaacccttcggtttcgccgttcattcatgacttcttttattatgcagttatatgcgggaagcttgagtggacgtccacccacttattgcatgttatttaaatgattataaaaaaaattaaaaaaaatatgaacaagatagatcaatatgtaatatatcaattcacaaacatgtaagttaaaattcaacttctacaaattataacaaaaataacaaacaaaactcaaattactgtatgtatatttacaattaaatttgttatttttgttacaacttatagaagttgaatttgaacttacatgtttgtggagtgatatattacatattgatctctcttgtcaatttttttgaaaattttccgtaaccatctagctgacatgcaataaacgggtggacgtccactcaaattattagaatccatctctatgtatatgcaaactgtttttgagcaaacaaatgaaactaaatcacctacgagatcctccatgtccgcgggcttcatgtccacgacgttgaagcactggtccgtcacctccaggtgccacaggttgatcctgaggtcgtcggccgacacgaacgtctccccgtcactgcacacatgaaaaagagaacaaatctacattatgacctcgttaattctcagagttgagacagaatggcatgacacaggttgtaaacttgtactgtaatagctggatcaaccaacctaccagttgttc

SEQ ID NO: 1084 - DNA, 522 bp, Oryza sativa
agttccagtttgtcttgtgccatcactttcaaaagaaccaagtggctttagtaccgtaatccgttttttctgaggtggtgctagattggtgtgagaccctaccaactgtcttgagaaaattgagttaggttcttcaagaaatttcagaaacaaatctttgtttgaacttacaaccctaagagcttcttgtaagtcctttgaatgaagcggcttctctgccatgcctaagcattttttctccatgacacttcctcgcaaaatatccactctgttacttgtgttcccagaagaccctcctttctgcgaaattttgtcctgaaaatagctcatccgtgtttgtgcttcagatacttcatacacatcattatattgaactgcttcctgacaaaatgggtggatatcttgtgtcgttgactttatgagacgatgctgctcttgttgctttaagtctttgtttagtgcttttaactggttacatgattgacttttcctgaaaccacttttggcctggtgttaaactgg

SEQ ID NO: 1085 - DNA, 613 bp, Oryza sativa
  unsure (1)..(613): unsure at all n locations
caagctgctggttgagtacgtgaggcagcacggcgaagggaggtggaattctgtcgccaagatcacaggtaggtgctatagctactgattgagtggtgttcttgcatgttcgtgaccatttcgatgttctctcgcacgttgtcccaaatcaagaagctcgatatatatagccttttaggaagaaattatagctagtagcatcagtttgcatttggtttgttaaattgcacgttggggcagtcaaacatgcaattagtacatgtttaaggttgcatatgtcgcccatgattgtcaagttgcatgatttgattccaattgcggcatttggtacgatcgtgttttcggagaataggcatttggtgcttgctctagcacatgcattaattaattaaaccgcgtatgaactgcatgcacgcgcgtgtaaattcgtcagaaccttttcctagctgtaaccgtggaaatccttttcctagctgagagttagcttcagatgattagcattaaccaagctttactttcttagttaagtacaaatgggagtggtaggtgtgtcatgtannnnnnnnnnnnnnnnnnnnnnnnnnnnnnnnnnnnnnnnnnnnnnnnnnnnnnn

SEQ ID NO: 1086 - DNA, 1296 bp, Oryza sativa
ttatcaaatttagtttcattcccttgtaaccttattccagttgtttcaactttctattgttcccccttacaaaggtcattgcaattgtatcttgtggaagcagataagaagttgtctcggtgtaatcttgttttgtggagtcaaatgtttgcttgtgtgttgcttgggaatattttatccgagatgctcatatttaccttgaaagatagcattattgttatatcttcttttacatcaagttatttcctttcgttcgaaaaaaaaatgcataaagttatttgcacgaagagacaggattatgtgaggtcggtgttggaagtacttaaggctctgtagcttcagtcataaatttttttgcttctgatagaaagaatgggaagagcatgtatgtgttgaatacttgaatctacgaacgtctaagcatgtactgagactgaagcactgtaattgcatcttggttattcttgcaagctgatgctgccaaagtgcttcccgcatactgcaggctagtactagagcacagatttccggcagatgtccagaaaagcttccttggacatgaacatacagccaaaagaagtgcttgtaatgctggagacagatgctttactcagtacttttcttgggagcttttaagtgtccaggaaagatagcatccttgattgatcttgttcgacatatcaacgctgccatctttcacatatcaacgctgccatctttcttgttgttcgatttgcaatgaagaggcaggattgtgtgggtgggtattgcaaagtaagaatacgtgccattctgtttatcaatagctcggtcacaaatatgtgttgtttttctgatgaaaataataatagaacacatgtaattaatctacaaacatctaagcatatatgtattgaaaatcgctgtctctgaataccgaagcactgcaggtggtaccttgatccatcatacgtcctagtcattcttgcaagctgaaactgccaaagtacttactgtatactgctagagatagtactccttcgtttttttaatatatatcatcgttgactttttaaaatacatttgatcattcgtcttattaaaaaatatagtaattattatttattttattatgacttgatttatctttaaatgttctttaagcatgatttatttatatatatatatatatatatatatatatatatatatatatatatatatatatatatatatatatatatatatatatatatttgtgtgaaaaaattgaataagacaaatggtacgggtaccgagctcgaattcgccctatag

SEQ ID NO: 1087 - DNA, 678 bp, Oryza sativa
ttcctttttgaagaatcttgacttgaaataggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcaggggcctgggggctcactccgacgcgcccgggtcaccagccttgtcgtcgttatcgtccgcaccaccgtcgacgccctcctcgttggagtcgatggcgaacgcgagccgaggggccgcaccctcgaagctgggaacgatgtggtcggcggcgtcccggacctgcgcgcgtgcgccgtcctcgggttacaaaagggaactcttccagcgctggccacggggagaa

SEQ ID NO: 1088 - DNA, 955 bp, Oryza sativa
atcaacgtagtggaaatcctggctattgtcgtccaataaagtcataaatttatgcggattggtgatgacttggtgtttcagtgttttaaaaaagtgttctgcagagcttaacggcacccttttttttagaaaaaaaaacattgatttgatgaaagaatatcatatggatatatttaagatcagaacttcataaagattagcccatggacatatgtaagggtcaaaatgtcacttaatttagtatcgaatggtgcaagtttgtatctttcaaaacttcaggagtttgttttttttgcacgacaatatgaatataaaatattggtagagtttcattttgctaccaagcattcatattttatttctctattcttgacctcgcttatgtaggttctaaatttacagtctgtgtgagaatggagtttctcttgaggttaaaaatgatgtttcatcactaatttgtatttgataacctgcatatttgaatgcatgaacatacaatgcactctgttttattcacatttttctcaatcagctgagttttaactcttatcttccatattctcaaggtgcacgggtatctgttagtgatggtacagtcactattgtagcaaaaacccaaccaattatggataaggctatcgagaaggtatgtatcaacaatacaacaatatgctatttattcattgtgcttatgaaagggtctgtgatctttgcttgcactttattcatgatcttctgttctataaaatttgaaatatgagtacaacacaaagtgcctgggagcaagaaccccagaccattctaaatttctaacttttctacctcattacaggtagaatttcttgtgggtcgtgaaattgaagttggcagaacggtcacaggtgttgtttcctcaataaaagagcccggtccttttgtggaattcaatggtggacagcaaggtctacttcatatt

SEQ ID NO: 1089 - DNA, 604 bp, Oryza sativa
cacaaaatatgaaggaaaaagaacgcacgagaatattcttcgatccaatcccagtaagaacgcacgagaatatccttcgatccaatcccagtgaccaccaacttctggtttttgttagttaaggcgatccatggcgcgcgcgcgcacgtacgcagcccacgacgcgccacgggccagaagcacagctgcacaagcaacaaacaagcgaacgccccgcccccgcgaagaaaagaacggcaaacaaacggctcgcaaaggctttttccgcatatcccactagtcccacactctccactctactccactctgcttcactgtctcctccgctccgttgcttaccccctcccaaaacccaccgccgccgccgcctccgccgcgcaagccaagctgctccctcccctccccggccgccggcggcggccaagaatgctccgctgccgcatcaccccaggtgtgcatctagcgattctctctctctctctggatcacaggctcacttaacttcgggcctttcttgtgccgggattcccatgggatgggatgtgatgtgatgtgcctggttggatttgggttgtgctggatggaaaatgggtaccgagctcga

SEQ ID NO: 1090 - DNA, 1274 bp, Oryza sativa
agtgcaagttcagactgggtagctagagtaccagcctttatttttattcagacactactgcaccaaggacagaaaggcattcaagaagttatgcagaattttgaaaaggtcatgaagttatttttccgttatttggatgatcctcatcacaaagttgcacaggcagctttctctacacttgcagatattattccagcttgcaagaagcaatttgagagctatgttgaaagaattttaccgtatgtattttcaagacttattgatccaaaggaattagttaggcaaccatgttcatcaaccttggaagttgttggccgcacatatcccattgacacattgctacctgctctagtacgttcactggatgaacaaaggtctccaaaagcaaaactggctgttcttgagtttgctaataagtcattcagcaggtacaaagtagactcagaaggttatagtaacagtggctttcttaagctatggctttcaaagctagcacctttaatacatgaaaagaatgcaaagttgaaggaaacttccatttctggaatcatagcagtttattctcattttgactcaacagcggttctaaattttattttaaatttgtctattgaagaacaaaaccttgtgaggcgagcactgaagcaatatactcctcgtatcgaggtcgatctggtaaattacttgcagagcaaaaaagaacgttcacgtcccaaatcttatgaccaagttgattttggaaattcttctgaagatggttatgcactgacaccaaagagtagttatgcatttgggcggttttctgctagttcccttgataatgcatcagggaagaagatgaatatggttcatggatcaatattccttgatatttctactggccgaacatcctctgatgtcagcattgataatgttaagcaatgtttcaaacctgaagctgaagttcttgcaacaagtagggaatcaaagaacattgctcgcacagttgtagaagctgcacgttcatggacagactatcctggaaaatcagatgctaccattgatgatgaaaattctactggtactcctcgtctggagtttggtcgtcttgctgtttctgatggacgtggtgctgttatttcaacttctgtggaagacgctcaagagggaaatccacttgtggagcttagttctgtgaagattaccccacacaccagtaatggccctagcatcccacaacttattcatcaggtacgcctgaaatatctcctttttccatcaactttgttagtaat

SEQ ID NO: 1091 - DNA, 1946 bp, Oryza sativa
catgtgaccaaggatgtcgtggcgaaggtaaactttcctcatttaggaagccctcttgcttttgggctaatccctttttaatgccggtgcaggtttcaaatgaagcaaaccagtgcttaaatgtcgtgttggcaaaatatgatctttttaaatgccttgctgtatgtacagagctcccttttttgtataaaagagtatatattaatgcaacactacttgtttacacttcttgttactagcagcttatacttttctttatctttgtgcttgcactgcaggttattgtacctttgttggttagtgatgatgaaaagatgcttgtcgtgtgtaccaactgtttgacaaaggtatcttagttacacgctttaattatcattgatgcaacaccaactccaaagataattgaataaaaacatcagacaatgaggagaagtaattgacctacatttaatttgtaataactttatatgtctatattcgtaaattcaagattcaaaataatctcaaaattctagattcctgaagtgttactagtacaatgaggcagtcattaatggtatttttatctctaataaggcctgtcacaacttgaatatcttggcaactaccaactaccgagttgattactggtgtaccttatacaactatttcattgaagcttcgttgctggtttacttgtgaatgagattaagtaaatattttttatattacaagaaacatgttagcttgtagagctgttccatctcatactggaattttattgttcatacataccatactaaccttatttggttgctggttttctcctggtaattttgcagcttgttggacgcctatcagaggaggaattaatgactcaactgccttcatttttaccagcactttttgatgctttcaataaccagagtccagatgttcgcaaggtgctttgcttgttctttgacactagtaatatgcccgtgcattgcaatgggcccatactactgagaatgggttgtggattagcctaaacatgcaatttttttaaccaattgtttttttttgtttttgtccggggaattttctatttttatgtgggagcacgcgctgcgtgcgaggggaggacggatgactccacttttatgtagtagagagttttcatagggatatgctagtaaagaaggcaatagactgatagttaacatgatagaaacatggtaggcatgtaaagaaggcaatagactgatagttaacatgatagaaacatgtaaagaaggcaatagactgatagttaacatgatagaaacatggtaggcatgtgatagactgatagtaaagaaataagtacggaatccatttatacaacaaaagtttacttcatacacaggaacagtatggcccatttgtagtcattcctaaaattatttaaactgatttatcatgattgtttaaattggatatatgaaaatgatatgtttgggtttgttcgaatattatttccattatattataatttaccatgctctatgttagtgccatagtgcattctctattttgagtttctaataatatgtccatgtttggtcactgtcaattgcactttaatcacaagtgaccatctgcctgctgtctaccattgttatctggattatgtatcaatatgttttagataattaaattcattccagcctttgcttcacagaagctacgtgtaataatatatgactatgtgcacgtttaatacatatcacctttaaaaaaatgaatgttttgtgtttggaatctgatatcgtattcactttcttccagactgttgtattctgcttggtggatatctacattatgcttgggaaagcatttgtaccatatctagaggggcttaatagcacgcagctgcgcctagtaacaatctatgcaaacaggatatcacaggcaaggtctggtgcaccgattgatgctaaccacta

SEQ ID NO: 1092 - DNA, 1302 bp, Oryza sativa
  unsure (1)..(1302): unsure at all n locations
nnnnnnnnnnnnnnnnnnnnnnnnnnnnnnnnnnnnnnnnnnnnnnnnnnntagatggtattggtagatatacaatgtcacgttctttgtcaatgctagtgctacatgcttacattcttcaaccgtattgatatcgttatgtaaaaaaaaagtttttgattgtttatgaatgtaaaatttagtttttctaatttttgcgggtatggtattgaagttgtcattaaatatactatatgaatataaaaaattcccaatcatacctgtactgttttcttaaaaaataataagagtaaattttacaaaactacacgttttttttatccaagttacagaaaaccacacactgacacttagcgtttaagtacatatattttggtagtgtagttttacaaaaccacactatcaatgaattgattcacctgtgatatggcgtggctgttccacttatgatgaggacatggcatcctattaccagccatcgcacaaaattaataggatgccatattctcgtcctaggtgtaacaaccacgtcatctcacaggtgaatccatttatttactaaaaaatatatatacttaagtgccaagtatcaaagtgtgtgtggttttttgcaacttgatcataaaacgtgcagttttgtgaaatttactcaaataataatgatgatttcgttttgacgttgtgaaatccctgggccctggcacccgacaagctaattctgtctccggtcgtccgccctggaccgcgcacctttgatctgaccgctgagatgcgatcgacgtttttttaataagggtgtggaccaatcccgaagggtgatactaacgcgaggaccaaacgagaaaattgccaaagggcgaaggctttttctcgggttttggcgcgcaccgaccgaggctgcggcggaagcggtggcgagggatcgcctcccgcgtcggaaccctaaaagggtccctttcggctcctcttctatgaagcccccacggcccccgcgtggcccgtccttccaggccccagcggggccgaggccccttccagagccctcctacccaggtatcgcccagctccatcggtggcgcttcttgtttctttctttcttggctttagggatctttttattgccggtgcatgatgcgagctaggatcgtggatcgagggagaaatttctagaaatcgggctggaagagttgggattgagtgggattgggggttcgtgaatgaagacgccgagttcaattaatccggggatcaaaactaaacaacgggcaatgcgaatccttgccctttggcgaatacaaaaga

SEQ ID NO: 1093 - DNA, 1149 bp, Oryza sativa
aatctaccatgagcaagtcaatgcgaaagctttccattctggttgaattcgttttctctgatctcctttatccatgaatgatgcagttttagactcttctaactattaattgtcttctctgcagaacatggcaataatgatacacctcagttgaacccacatgattacttgactgttcatgttcacacacccataactcaggtttcgtttgaagccgtaggaatttcaagaaacactggtgagacattttcatctttcaataagaaatacatagcatagtgactgactactatactgctgttgccggaaattgtcactatgatatatagacatttcctgtgtatggatgttaacttgttttagaaatgcactattttgtagggttatcattccatcataaataatggcgcccatggtagttgaggtttttcttatatacatatactctttgaatgaaaataacagaaattactatcaggcaaggcagtaatcctaggctctttgtattatttatgtttgttttcctcatgctgcctacgacacatcttttctaaagtgtgttggttgctgatatttggtctgcaaccgttggctgatacaagaacatgttactgattccccatgcataaattagtattgcgagatacatatgattagaagtgttctcccagcaatttacgtctgctatatttatctaatgtgctaagctcatattcttttcacttttgatgatagacatagaaccttggagtggacggatcttttcagaaaagagaggaaaattattaaagctagctgcaaaaactatgtcaatggaaagttctgagtttttgcagagaaggttgacattacatattgaagaactcctttactttatattttcatgttgtccgataatggttggcctgatgacataaatttctcagatcagaattttttgctgacatcctgcaaaggctaggcgccaacagcatgataaaaaaggtatcctttgctgaacctatgtaatgcactatcacccactcaaaaatgtttgtctattatttacaagttccatgatttgatttgattttttttttttgctgtaatgtagcaccgtaaggagtccatgagaatgatgaaggtctgtggccatactcctactggcac

SEQ ID NO: 1094 - DNA, 1247 bp, Oryza sativa
aacaccggccaagaaaaataagaaagaaaaagctgactcttcaaatgatgtgctggatgccattccagagcaaaataaaagtaacatcatgaactattctagtccctcaaacttcaggtctgggtctatgaagctgggtgacgtagttacagcaaaggtctaccagatacgagcctatggattagtacttgagttgagtgatggagttcgtggaatgcataaatttgcggtaatttcatacctaaactctctagtgagcaagttaatttgcttcgggatttgcaatattaatatcacattgcttgtcctttttgtccttctattatatgaaaaagaactgctatatgactatcgcatacatataacatctttgatagttaggaaagaaattatgtttccatatttgcagtattgaacatgacaatgcaatatcagatcggatggatccattgccctcaataacaaaaacttagctaaacataacaatgtagtatcattatttatgtattttaatttcattgcactgacattgaaacctttgcaggaaaatggacacaaggattttgaggtcggagaagaactacttgtgaaatgctcaagtttcaatgcaaagggaattccggtcttctcattgctagattagtagccattttgatggggctaatgtcttctctataggcctacagaaatagacgcttgtaaatgtgtagcagctaattcatcgacttgaggaacatgagaaataatactgcggctccctcgacttttgtcagagtgctaccaaaattgtgtggctgtcgttagtagttttgccctgcaactcacaaacgcccaaacattacgcatcacttggtatctgaatctcttttgcagcagttgtacacttgtatttttgccacgctgtttcttattcatcgttgaaactaaccgtaacagtagcattcatatttctctccactcgtaatcccatataattcatttcattctttaatacagttacttctaccatgagaatctctgagcagcagcttcttgggagttgggatatcttcatttcattcattgttgtgtggtgcgaagtgtgaattgtacatacagaagtacagaactggacgcaaaattgtggccttttctgccaccaggtcccacaacgacgaggcctgtggctccgaggccgcctctgataatcgccaagaaatgaaccaaaaaaacgaaccaaagatgaggtgatagactgactagcactg

SEQ ID NO: 1095 - DNA, 613 bp, Oryza sativa
aaaaatcatatatatcaaattcattgtctactactagctcccaatcaatgtatgcaacagaatcatacttcccatcatagaatggtaacttagatgcaacttgttcaaaattatagtcatgtacctcatatgcatcacatggagaagtcgtcatatctcgtcgaaggtgtagaagtcgatgttctcgtattcccttacacaatcctaccatggttagtagcaaacaagaaacacacaaaaatatgcacgctcctatcaactactaggtagtggcagctcaaatatcacacacactcaagcttttaaccaagctcttacaagttcttactaaagcaagcggaatggtgatgtacaccgacttaaccaagcaccccaatggaggttggatgtatcgatgccttggcaaacacttgctgtacggctgcaatcagatctgtggagctctgggtaggcttaaatatgtagcaaagggatagcaaatgctctaatgagagaatgcaaagttgaataatggttccaagtcaagtaccgtgctggtcctaggctagaacgtactagagacgcgagcctagacactaacgataccacaaaatagcactaggaacaactcatg

SEQ ID NO: 1096 - DNA, 2140 bp, Oryza sativa
  unsure (1)..(2140): unsure at all n locations
nnnnnnnnnnnnnnnnnnnnnnnnnnnnnnnnnnnnnnnnnnnnnnnnnnnnnnnaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagagactgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaagaggagcaggcgcgccgcaatcttgaatgcgtccgcgccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccgacatgctttgggatgcggtctcccgcctgaagcgcgccggtcggcaagcgggtctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcacgggtcggggttgctgccgaccacatcgtcaacggcttcgagggctcggcccctcggctcgcgttcgcccccgactccgacgagggggggaacgccagcagtgcaagcgacggtggcaacgaggccggcgacctgggcgcgtcagaatgagcccccaggcccccgccaatcttaacttttttctttttctttcttctaaggccttcatgcctcttttttgtacaaattaacttaatctgcaatcagaaatgatgaaaaaaatttttgtgttagttttattttgctatacatacgagatgaggatgatctgtgccgtggtccttttgcgtcttagcttgaaataagggttcgtgcccttggatggctcgggtcggggctagtgcctggggagatccacatgtcgagactggccaggccgggaacgtggtgaccgaggggtatgggtgacccgattgtaggtttttgccgattcccccccggagttcaccacgccccggggcacggctcggttctgggccccgtttggcgattttagctgaccgaaccgaacccccgagggcaaggtcaagcatgagtgaccttatttcaagtcaagattcttcaaaaggaaaaaacggcacagacacaacctttagaaaattgaaactgcttctattgaaatgctgaaataaaggaaaaaggaatatatgcgcatgtgtggtagcccccggccaatcctgcacacccgaggggggtgcggggttggcccgagccaaaacctgacacccgacccccccccttcaggggtagaagcgacgaaggtgttcgat

SEQ ID NO: 1097 - DNA, 712 bp, Oryza sativa
cacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaatgtcactcgccagcggtcagattcttagtggattcggggcatggcaattacaggaagattatcgagaacagaccaagtttaaagagtatgcggcatggcaatttttgtattaactagatagagtcagttagttccttttatttttaggaaatattgtttagagtctgatcaggacttgtatattttactttatctttaggaaagtttgtgtctttttccagcaaggactaatatctacccatgtgtataaatatgtacatcccgtatccttgtaatatatctctcgatcaatacaattatggcgcatcccaccctttttatttccttctttctcaacgagttcttgtttcaagttaggtttcattggcgtcgatctccgatgaagggtaaggcttgttaaggatgtttgatcggcagggctagggcctcgatactataatcttgtcgatgtaaagggtaccgagctcg

SEQ ID NO: 1098 - DNA, 8038 bp, Oryza sativa
actgaaagctagcttaggagcctagaggagtggtacccatacgagcgtggtaccaccaataaatctgtggtcagatatataatattaggcaaaatctaatccgcgtgcgctctccgttttgccttatcgcgcaacacgctcatcggccgtccgattccacaagtgctggtgcgtccgtacatagcctggtgattcacggacgtggcatcatctagagggatccaaattggaagccatgtgatgctctacactacgccggcttcaaaaataattttctcttaaactaatcatccgatctacgatccgattacaccgttgtgttcgtaagaattgaatctttataacaagatctcacatgattatattttgatgaaaaaatagaaattatttttataatatatctaaattacttttagatttcactaaattacttctcagacacataaaagtatattcaataaagcctaaaagtaatttacatatattatagaagtaacttagaaaaaaagaaagtaactttatcatgacattaaaagtaaatcagttacggaggtaaaaacatgagtctatgtagaaactaaatttaatcagcataaattacatcattgactaaaaatgattatataataaacaactcataacacgaatgtatagatttctttcgatgtcttgacaagttacttcacttttgttacttctataatataggtaaattactttcaggttttattaaattacttttatgactaagaagtgatttaatgaaatctaaaactaatttagatatattataaaagtaatttctatttttttcatataaatatagtgatgtgagatcttgttataaagatttaattattacgaacacaatggtgtaatcggatcgtaaatcggatgggtaatctaagaaaaaattccataaaaagaaaaaaagtgcatgcactcttgagtatactagtaacaactacatatgagactgaggtagctggttattaccatacatagaacggtgtcgttgtattaataccacttgaatctgaccccatgatatagatgcatgcgtgtagagaaacagaagtttctagaacgttgacagcggatggattctttatacggtagctagctatatatacaatatatatccaataatgctccagtataaaaccatatgcacctctagtcatctactagctaactaaactagtagtgtggtacacagaccaagcaggagataggccacaacatggtggtccaacccaggtccagcctctgtctgtcctgctcgctacagcagatcatgccggctggttgataggcacatacaactacaaagctagcctgcgacgataatatctccccggccatgcatggacgcgtggctcgggacctcctccagtttcaatatttttttaacacactctgaaaaaacgtattttacaaatagactctcagggatgccgaggtgggatatctcagcaccatatggtgctgacgtttttattacggcgccaatcaatttggtgctagtctaccatctaggttttgtccaaatcctactgatttgatgctaatttattgggataaaacttacaaattcgatgtatcataattcattaccgcttatttatttttagttaccaaatcttaatatgggggaggatgtatgtccctccctcattatacctaaatcctgtttttttaaatgaatacctaaatcctgttggttagctttggggaaaaaattacaaataatgagtcacaatccaattttgcctcttttcaaaatttaatagcaaatcaagagaatttaggtattgggaggagtgaatgatcgacattcttctctcagattaagctttcactaaaaaagttatcagaatgaactaggatacatcgatttgttaggttttttcttttccaaaaattgatggcaactcaatactcggcctatcgtcaataccaaaacaacctcggcgttcaacatatttagtcttaaggcatcccatcttggtgccaatatccgtagcaccaaggtggttccataccatatctataattagttttctggggacctatatgtaaaacatatattttagaagggctaaaatataaaaaatccaggagtggctggccataagaccgtactgcatgcagttgtgtgctgctgagccattcggtccctccatccatccatccatgtgagttcagctgggcctactgcactgcagtcctcaacggtgcatgccccagttgcccacggcccacacaggtttttcttcagctttaattaacccaccgctgagtattcagcaagagagcgtactggatggtccagttctcggttacgtgaccagtcgtcgactgtatggcgagctactttcatatatgcgaatgtaatctcttatgtgagtgtgtggcgggctacattcgtatctaggaatctaatctcttacctgtgatatctacccgtataaacatcttcgcaagactcgtatctgcgaatctaatctcttacatgtgatttctacccctataagcatcttcgcgagactgagccaatatatcttgagattaataaagtcaccatgggtgtctcgatgtcaatgggtacatcgtctactactgaaagaataatttgccataaatgcgagtacccgtatcaagtctagaacttgaacccggatggattggttccaccacaaaaaaatctaactagttgagttacgcccacttcgcttatgtgtgattttagatgtgtatatattgcgtgatgattcatggtgatcaacttaattaattatttaaaaatcaaatatataatatttatgtgtatatatatagggtgcatttggtttagcatagcttacttaggttagacaagagggtgcatctgatttaaccaataaattagtgacatattttgttgagtccggtgaatcacattgacagggccacctaagcggtgcgtacgttagtaatagatctggcctgtggaggatgaagtcatcacaacaataatgtcgtatccctctgtcgaccccattcattattgctgcatggtttcatttgcaaaattatttctcttagttcaactatacacttacttgcagaagggatgcttttgttctatattatctttaattttaatccaggtgatgtaccggggattttatgtctcctgaacttttcttttcaataagttgctttgttatataaaaaaaaaacctaggctatatcgcatgagaagatctattgtttagggagagcatggacctatgagaaaacaagaatggagcttcgatgctagcttgtaattggagacccaataccattagatccatcgttagatcatctcgtcgccttgttggtatcctatcttactataatattgatgtccactaacttttaaagcttaaaatacaagtgtgtgccacatcgtcacttactatcaattattatttagagtctttaaaatcatatgcaagtgtgccacatcattacttactagcaattattatctagagtattttaaatcatatgtaagtgcaccacatcatcacccactagtaattattatctagactatttcaaatatcatgcaaatatgacatatcatttataattttgttatatttttataactcaatatgcaagcattgtcaaatcattaattatcttcacatcatttttatattatttaaatatatatctaccatttctataatatatagcatgtattcatccacttattctgtagcaaagtgcggggtacgaactaattaccataatttgtaagataggcacagtttagtcacctacccctccgtccaaaaagaatcaatctataaggggatatgggacaggggagtatgttataaagcaaccagtcacttcattatataatttgttttggttatgtgaatcccatggaacatatcaattcacgtgggttgcctgtaaagttggagtcattatggggacgtagctagagtgttggagccatcacacgggaatcaattctttgattgcgcctattccaatggcaattggcaactaagggaatattgttcttgtaagcgcctccactctgtattatgagccacaatatgatcccactgtcaaattgcccgcgctcatcggggcacacagttgttttaatttatttgatcggttaagtcttgtacatgcgttatgccacgattagctcgagcaatttgacagtgggatcaatttgagctagctaatatgttaaaaaacgtactattgcattattgttgactactccctccatcccatttcgagtgaagccataattttctgtgctcaactttaatcgtccattttatttaaaattttttttataaattaaaaaacataagtcaagcataaactactattcatgttctatcattttataacaacgaaaatactaattataaaaattttcaaataagacgaacgatcaaaattagacacggaaacttatatggttacatttaaaaaaggacggagggagtattttctgaatcgcgtgtgatcttgtttacgacaaaagaaatcggtgtgagacttacattttggaaaaaattgggacatggcacatgttggacaagatttccatcgcgaaataagatgagttacttgtttgagcaatttgttttaagataatgcaaatgttttatacacctctaacttctatcatattacacacagccataagctaaaaaaaacaaaatgagatctaaggtgatatatatctcattgagtagcatgggataaatccccgactccctcttactattgagtaacattaaaacaaataatttttttagccagcatattctcattgaacaccacccgtaatgaaaaaaaaatcccatctttgagcaatttatgatatgtgatcaaattttgtctaaatacatacggacatggcatggtgaggcaaattctcattggaccgacttgtgacaaattaaatttttgcaacatagaagagggaagcacatcgttttgtaggggataagcacgagagattgttgtcgtggacagctaaaagtttagagcatgaatatatgcaacatacacacacatagacatagacatatggatatggtgggtagcctagacctgcattatcacatctatcttgatcggcaggcccatgacttttgatgacaaaggttggtggtatctcccattctagttgttccaatttttatacataattggacgcactcggagagcgaatatcttataacgtacggtcgctattgtgcttaaaatatcacttatctgatcaaagcagtcgccctcaaactgctgggattgcagaaaaagatactggtataacaggaacgttttctgctgatatatttaatatatggagaggcattctaaaaaaaggcaaaaattcagcgctcaacagtaaaactaaaaggtaccacttataaggtatttaaatactggcacagttaattaggtagtaaggataaaaagataattttctaggggatagagaaggatataattgtgttaagtattagttctatatgtacatatgtaccgcatcggtacgagtagttatcatctgcaggacgatatttgcgtgctcttttgagatttacattttttttcttaagaacaaattcgcctagtaatcatccatttcattatttacatgttttgtacaattcactaattaacacaattttacatatcttagggaattaaatgacttattttataatgtcatgcatatacttagattttaatattcacctgagaataaccatctccctgatttactttacttcttataaaatggaaaccacctccacattgcaagtccatttattgggcatatatgtgcatgcattttagaaggcaggcaattgccgcaacgtacacaccacatgccaaattgttagtgatatgccttagaggcaatcatagagatgattgtatcatacactatgtttacatatttatccgacattgttctttgaaatagataactccttattggttaatgaatatgtgattcttttatgagactctttatgttgtttgttactatttctaaaggatccctgatcaaatatcatatgtggaacaaatatgtttatatgatcagcacatgtattaattgatgatcatgtcttatggattatggtatagacataccaaattaataatgtggacacatgttggtgaacatgttattggatagacccaacatgagacactgtaagagccatatgtgttgtgtcatcagtgatctcttttagtgttggtgttgaatccttagacctaagattatcatggttctcaacatgtgtagtagcttacttagggattgctaaacgctactccgtaattgggtagttataaaagtagttttcgggtatgctatgaaacatgcagtgggatatgaataatcaagatgggatttgcccctcctatggagagatatctctgggcccctcgatgttgtagattatggaagtgcatggccatgccaaaggtgaatgaggagtcaatcacaagttatataatctattaacaggttcgagtgaataattaagctattagaggatgtcacatatctagccttgagcttaatcgatatcgtgaggcaaaggggttcatacaagtatacactacaggttcagtcgatatgatcattatgtatgtccggtgggttaatacgttctgctaggggccgctgttgacgtgtggaccgaaaaggagttttcgggttacagccgaatatacatgaacctacagggtcgcacgcttaatgggccggaataaggcgattggatggagatccaatataagcttaattcggatagggatccgaataggagtcctacgggccttggaggcccgagtgatggatcctatatattcgtgaggggtgcgaccggcggagatattgcatcacgtgagaaaccctagccgtcacttccctccccacgcaaaaccctagccgcgcgcgggtgctagcatatctgcgcgtggcgttctgtccctgtacgtgtagataccggtagaggcgccgctggtttgcggtgctgattagcgtgggagtacggcgaggagaacgcgtgaggaggagaaggtcgagccggtgcgatcgactacttcctctacatcgacgcgcgctacttcgcgagagttccttcgacttctcagtgtcttcttccgctgcgcagcgcgtcgagtggtaacgatctatgatctaatacttgcatggttcctggtttacgcgatagaaaattttgatatatgctatcgtagcctacgcgtatcccaatagtggtatcagagccaccttttatagtttatgatctagatcattgcatatagttgatatgcggatgtagtagatgagatctattatgttgtatatgagttcttaggtgatcggaacatgcgatgaaccgatagccgcatgggttgatgagatcaatcggtatgtgtgttggtgacttcactggaatgtctagtactcaccaaggccaagggcgattgtgttcatcggatagtccgatgtccacaagaaccgcacgccaatgagaaaaacgagccattgagattgactcggtttcggcataatttgattacgccgttaaggttttcacatggcgaatcgtatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggactccacctaagacatcttctccaacgcttctcttactgaagaggggaaagattgagcaagaatgagtacaacaacagtactcagcaagccacaccggagatgcataattaatgcaagggagtacaaggggataataatataggg

SEQ ID NO: 1099 - DNA, 7007 bp, Oryza sativa
cgcctgtcagtggcgcgcgcgcggggaggaggccgatgggccgcggggaaaggaaaaaaaggaagggagagttgggccgagccggcccaagagaggaagggggggaaaagaagacttttagagatttttctttttataaaccttttcaactttgtttatttcttctcaattattatttgtgctctgaaaattccactaaaatttgagggctccttttagaccaaggagaatttaacaaaaattctccgggccacatttgaatttttcttgtacgtattttagtgtttaccaatttcttttcgaattttaactaattctattattccttttagagaatgatttttaatttcgggatgaatttatcaggacgtgacaaatccaccccccttacaagaatctcgtccccgagattcgaggaggctagcaagaagataggttgggcggtcttctcttcttgtctgacttcttccgctctggactgcttggctcgatctcctgttgcagaagaaatcttctcttcacccgacttgtccctggttgcacctttaactgactcagactaggctgcggtggttgaggatggggcttcagttctagaacttcttatcattcatatctttggcgtcaacctcataccagttaccaccttcgtgacatgcgtcgacatcagctttgtcattactaggatatcatgtttggcaacttgcccctaactgcctcatattagctttcctggtctccgggtgctagctacttctgctattcgattccagggtcaaccactctaactataagttatgcttcccaagagaaccaatttatcccgcttgacatgctttgacgtcttcccgaatgactttgctgctggacttgttattgtctgatcgtgatcctgccagatctgaagcttcgttgttagaggtgattttaatctgacctctgtagactatcttcgaacatatcactggttctataactgggaatggctctcacgaacaagcagctcggattcactttctttatgttcagtttactttccgctattctcttcatgttgtcatcatttagcattcaacgtattcctgtgcaccttcagccttgatgtgttctttctcgatggatcgattgctaggaaaatgcgttgagcgatactattgcaagtgcttttattctagtagcatctgatacaaagcccaaggttgaaccgagctttagattccactgttcaggttttacttcttgacttcttggtcatgtcacaaaagtttccatccttgtccccatagaagtacttctacctgcggtcatctctcttactcgtgaattcacctactttaatgacagggcaactgttgtagggttgtttgctatcgggagtcttcctcgagtgacacaaatcatggttctcgttatcctttatcaatcacctttcgacctacttcttttcccagtaaccaaacatcttttccgatctcttccaaaagaatcccatggaacttgtctgtattacacatttctccctcattacatgaatacgaggcactgccttaaacaaaaagggacggtgcttaacatcggtacattgtatcctcaacatgaatcatccataagcatagcaagctcactgtttatagacatgaatatatttatgtattacatgattgctgcaaactttcgattacaccatgataagtagcgaactgaaaaccacaaacatggctgctcattttgattctggagagatatagctggcattgttctagtgactgcatcatccttgattggttctgtgattatgtgataggactgcatattgctatcattcacaggagaagcttccttctgattgctgtttgaagcggatgacggtcttctgcttggtatcgccctccggaggttgattgccctttgcttggcctggagtaggtcggggagagacacaactttttccatcgacgacaattccttgctgaggctgtcggtgcagagaatggttaatgctgaaggtattattgccatgatttattgcagagttaggtggagcaagaggagcattggtgctgtggatgatatcatcgatgttgttgttggagctgactagctgacgagacaatcgtagggttgttcgttggatttctgcggtcttggtcaacaacacactgagttggcaatccttgggcccacggtttgctccttcgcacagaaaacatgtcaccttgcgagtgggacactcccctggtggatggtcttcttcatagggagtgcagagtgtgagacacatgctagcaacgtgtccaatttctccacaacgggtgcatgcctttgatccgaagaagacacatctgaaactcttagtccaaacaaatgtctctttggttgatcacttgattttcttcgccatcaatcgcgaggttatttgattcataatagattatgagcttacggagatgagaccctgggtctccctaatcagcaacaaagtgtacacaactcaccggacttgcgatcttaacatggatccttcataaacttatcaaactccttcataatctcatgtttctctgttattacatgattgacggggaacaactataaaacataagtatatgattactgatacaagagtattatggttgcttctgactagcgctaggcttaacaggtactgcatttgctccagtgaccacttggcgattggcacgtctgcttccttaacaggtactaccgttgtaaataactttcttacgcttgggttcttcatcctgtacttgatttcttggctgctgtgctggaacatccaaaggtacaatgccgatactggcctctgtcttgtcaactgatggctggggctgtggtaatgcactcgctggagttggagctgttgcaacgcgggctataggactgcttcgggatgcatggatgacaattcgctgaggagcaagcttccgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacacgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtcttgtcattcctggtggaggccattctgtgctggtaatgatcatcttacggacttcatcttcggttcgcattggtgtttttcttttctgctgaggacgctcccttgcatagtgcccttgctcatcacacataaagcaaatgttacttgcttcttttgggtcaacatgtggcacgtcaccatgggtccttcgggatgctggcggcatgctgacttgtggtgtgagtgcttggactgcctccaactgcacttgaggttgtatttgactcaggttcagaattggcgtctgatgctgctgtagtatctctataagcaatcggttctggttaatcaggtgttggaccagtgtcacacaactggtgtctggtgcttcattcactcgggagcttgaggtaccaatgtcctgacttctaaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacaactaacgactctaccctagagggtggcttaggttctgcgacgggttctccaagatcttcactcttgcttcacatctggcttcactgcttcctttgctgcgctgacggatccaacagccttctggagtttcgacaaacaactgacgatgtcttcttcttcactgacctgaccaactagtactagttgaaatccgaagaaggaagaagggagtaaaccttttgcaaatagcattaagggaaggagaaaaaaggaactttcgcaaatagttttatttataaaatatgtccttaggttttatccacttggcttatcctacagtcgagatggctctgataccatcttgtcgcgaccgggaaaattgccttttcccgaacgccagtgtattaatccccgtcccaggaaaagccggggtacaccacacaaacatgatataaaggacacatctttattatatcgataatatttacattattacaaaggcacttcaggcctgacaatcaaaaataaacagcagcggactagcgggcctacggctccatcttcacaggcgctcaactggggtataagccaggactccacctaagacatcttctccaaagcttctcttactgaagaggggagaaagatagagcaagaatgagtacaaccacagtactcagcaagacacaccggagaatgcatgattaatgcaagggagtacaaggagataataatataggggttcagttttacagtaaacagcatttaaaagtcacttggttgcccaaagctattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgaccaaatgatatgaatatacccaaagtctaaaattataaaatccacctaatgttgtcctattaatcagcgaagcatctacctaaattcatactagtggaaccataaatagagtgtccactagttggggttttgtttattctagggtgaacaaggtaataatatcaataacaataatagtatggtcataacaaaggtaaataggcatggctaaataaaacagtgataacgcgggaatttaaataaagcgataatgcattaatttaaattaaaataattttataaactgggattcaatatgctcaaggatgatgtgacttgccttgctcgctttcccaaacgctggcttcaacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaatctcatttattgcgtcagccgagggagagggcgcgcggaccgggtccacgggagtggggcccatgcgtcaacctctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcggccttgccggcacggccgacgggaggggaacgcgcccgcgccccgatggtcaccgccggcgaccaccggcgcggcggagcggcacccgagagagaggagggaagggggaaggcgaatggaacggtcttcggctcaccccggtcgacggcgacgacgggaacggcggccgaagcggaagaaggcggcggcgcggttcgggacggcgaggacgacggtgctccggcggtcggcgagcaaaacggaggcgcggacgaggtcgacgggaacgcggcgaagccgatggaggtgacgccgagtggggaggaggtcccgagcgacgacggcggcgaactggagctcggcggcgacggcggagagaaggtgcgacggtgcgggctcgattccgacggggaggagaggcggcgagtggcggaaacggaggaggagagcacggggaacgcttatatagcgccgggagagagagaga

SEQ ID NO: 1100 - DNA, 1533 bp, Oryza sativa
gaacgaatccgagggagagagagagggaaaaacgggggaaacgggagagggaatcgcggggaatgattcccccctcattatggcgcgcagggacggtgggatgcggcggaatctgcggcggcggcggcgctagggcacgggcgagcggcgggagcggcgggaggaaggcgatgacaggtgggccccacccgtcagcgagggcggcgggcgggcccgcctgtcagcggcgcgcgcgcggggaggaggccgatgggccgcggggagaggagagagagggagggagagttgggccgagccggcccaagagaggaaggggggaaaagaagacttttagagatttttctttttataaaccttttcaactttgtttatttcttctcaattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagagaatgatttttatttcgggatgaatttatcaggacgtgacagtttgccatagtaaagtgtcactttttatcatgataaaataggatagatgtcggacatctatatgcggagattattggtttacttgacaaggttattggaccttggggcataggttgggttggacatggagatgtcaccccaacagcacaagagtcacatatgatgtgattagcaaggtgttgcttacctgttttgataattgtctagcttggatgccaaagctcactagacactaataaaatgaggatcttaactcactatgttactagagggaattttgtttcacaatacataatgggagtatcttttgttaaattgtttgatgaaaggttaaatgtaaacatggtgctgattttgcatacatatatttctattgtagattatggcagctcatgcaccatccaattttaacttgcggtctattcttgagaaagagaagttgactggaacaaacttcatggattggtatcgcaacctgagaattgttctcaggcaagagcacaaagagtttctgcttatacagccttttccagctgacttgcccaacaatgctcctgctgctcaacgtaggaagcatgaaaggcgatgcaatgattaccttgatataagctgtctcatgcttgctactatgtcccctgagcttcaaagccaatatgaggcattggatgctcatacgataatcacgggactacgtaacatgtttgaggaccaagcaagagctgagaggtttaatacctcaaagttcttgtttgcgtacaggcttgcacaaggtaatccagtgagcccacatgtgatcaaaatgattggttaccccgagagtctggataagcttggttttccccttagccgagagttggctactgatttgattctccagtcgctccctcccagctttgagccgttcattatgaatttcaacatgaacaacctgaacaggaccttggc

SEQ ID NO: 1101 - DNA, 761 bp, Oryza sativa
cgagctcggtaccccgttatctctgcttcttgtttgcaagcagagggttatggttttagatctgtggacaatggttgttcagtttattataatgacattttctatttccatgcacccatgatgaatggcttatacattgtgaatcttgatggatgttcagtctataacattaatgcaaaaagacaacgtcctaatgatttgaatcccacttttatttggcattgtcgcttgggtcatataaatgagaaacgcatggagaagcttcatagagatggacttctacactcatttgattttgaatcatttgagacatgtgaatcttgtttacttggcaaaatgacaaaggcacctttcacgggtcaaagtgaaagggcaagtgaactattggcactagtacatactgatgtatgtggaccaatgagctcaactgccagaagtggttttgggtactttattacctttaccgatgactttagtagatatggttatgtctacttaatgaggcataagtctgagtcctttgaaaagttcaaggaatttcagaatgaggtacaaaatcatttgggcaagacaatcaagtatctacgatctgatcatggtggagagtacctgagacttgaatttggtaatcatctaaaggagtgtggaattgttccacaactcactccgccaggaacgccttagtggaatggggtgtctgaacggaggaatcgtacattgttggacatggtgcgatcaggggatcctctagagtcgacctg

SEQ ID NO: 1102 - DNA, 357 bp, Oryza sativa
  unsure (1)..(357): unsure at all n locations
gtggttttgggtactttattacctttaccgatgactttagtagatatggttatgtctacttaatgaggcataagtctgagtcctttgaaaagttcaaggaatttcagaatgaggtacaaaatcatttgggcaagacaatcaagtatctacgatctgatcatggtggagagtacctgagacttgaatttggtaatcatctaaaggagtgtggaattgttccacaactcactccgccaggaacgccttagtggaatggggtgtcagaaaaaaggaatcgtacattgttggacatggtgcgatcannnnnnnnnnnnnnnnnnnnnnnnnnnnnnnnnnnnnnnnnnnnnnnnnnnnnnn

SEQ ID NO: 1103 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnnnnaggcaagacagaatctgtctcgcaacttttcccaactaccgtttacacatccaacggtagaggtgtaccattgctttgctctctcttgaagagagaacgggaacaatttcgaccgcacagtttcttgtttcatgccacgaatcttaaggaacttacgaattacatgagcagacttgttcaaagtctcgcagatgattgtagggattttctagatcaaagccagaaaaaggattttccctaaccatactgattagttgtgtaaatgggctccaataaaggaggtggctcatagaattcgccccgaggagcagacagctcaaaaagaggttgctccatggtcgagaagagtgacaggaatacttctctagtatagcaggagcgaaggtagaaataaaaaaaataaaaaggatatgaggatgaactaggttcagaaatgatcagcaaccgttccccggcaacggcgtcagaaatgcttgttggtatttaatacggtcacagataaaatccgcaagcgcacggatataccgatgtagcactttccctacggagtattccaagggtatcgaatccaaaggaacgtgtgtgggcaaatctttcttgcggtcatccaaggacaccaagccaatgataggctaggatagagaggatttactagtgaga

SEQ ID NO: 1104 - DNA, 2771 bp, Oryza sativa
ccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaaaagaagtttgtgtggagcccgcaatgcgaaaaggcgttccaaactctcaaggaaaagttggtttcctcgccagtgttaatcttgccggatactcgcaaggactttatggtgtactgtgatgcttcgcgccaaggattggggtgcgtgctcatgcaggacggtcatgtggtagcctatgcttcacgccagctacgacctcatgaaggcaactaccctacacatgacttggagttagcagcggtggttcatgctctaaaaatctggcggcactatctcattgggaaccgctgtgaaatatatactgatcataagagtttgaaatacatcttcacccagtcggacctgaatcttcggcaaaggagatggttcgaactcatcaaggattatgatgtgggaattcactatcatccttgctaagccaacgtggttgccgacgctctaagtcgaaagagccactgcaacactctcaacgttcggggcattccacccgaacttaatcaacagatggaagccctgaacctcagcatagttggtcgcggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgagtatgcgttccagatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaggcagaacaccaacgaccggtcggacttctccaacctctccaagtgccggaatggaaatgggatgaaattgggatggatttcatcaccggcctcccaaaaacccaaggtggatatgactctatatgggtaatagtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcaaatcctagaggatatgcttcgcgcatgtgtcctggacttcgggaagacctgggataagagtctcccctatgccgagttctcctacaataacagctatcaagccagcatacaaatggcaccctatgaagcggtgtacggtcgcaaatgccggacaccgctattgtgggaccaagttggagaaagccaagtgttcgggactgatattctgagagaagctgaagctaaagtcagaatcattttggataatcctaaggtgggacaagtccccgcaaaaaaggcatgcagataaccgtcgccgtgatctggaattcgcagtggatgactttgtgtatcttcgggtcacgccattgcgaggtgtgcacaggtttcagacgaaagggaagctcgcacctcggtatgtgggtcccttccgtatcatcgctcgacgtggagaagttgcttaccagctggagttgcccgcctccttgggcaacgtgcatgatgtgttccatgtgtcgcaactcaagaaatgtctccgagtgccatccgagcaggccgactcagagcaaattgaagttcgcgaagacctgacgtatgtggagaagccagtgaaaatcctggacaccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataattaaaattcatgtgaaagcctccaacaattaaaatgtgcaaagataaaagtcaaatgaggcttggaggatttttgtatatttcctaaaagcctaaaatacttaaacaaattttagtggaattttcagagcacaaataataatggaaaagaaataaacaaagttgaaatggttttataaaaagaaaatcctaaaagaagttcttttccccccccttccttcttgggccggctcggcccattccctccctctctctctctttccccccccggcccatcggatccccgcgcgcgcgcgcgccgctgacaggcgggcccgcccgccgctctcgctgacgggtgggacccacctgtcatctaccttctctcgccgcgcccgccgccagcgcccgtgccctagcgccgccgacgccgagaatcccgccgctcccgtccgccccgcgtgcaatcaagaggggggaattattccccgcaatcccctcccccgtttccccctctttaccctctctctctcccttggattcg

SEQ ID NO: 1105 - DNA, 1026 bp, Oryza sativa
ctgatcagagtaaatctattcgaatagccgagccctcggatatgggcaagccgagcaatgtacccaagtcagtgttctaattcttaaaatttgctcaacaactaaaatgtggaatggttggcctgggttggcctgggacgagctgggacccagggtcgggttgccagttcggtccgaatcatcgtaggccttgggttaaggcaggttcgtgtgggttcacggccttgattaataatattggatagttctaggatcgtgtttacaaaatggccttgagcaactaaatgtctttaaatgctgtttactgcaaccctaaccctctatattataattcccttgtactcccttgcatttattctgcatttgtgggtgtgtcttgttgagtacggtggttgtactcagtcttgctcaattttcccaagcccagatgaggagttccttgaagatgaaggctttggtgtctagctcgtgcctgccgtcaagcgcctgtggtcgtcgccctagtcttccgctgtttttcgttgtctttgagtgtgctgggccgttgttgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacacccactccctcgggcaaccctcaggcgacagcctccggggaggctcgcgacgaggccgcgggcacatcgcctgggcccacctccccgggtgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgagcccgcatgggcacgcgttgagcagg

SEQ ID NO: 1106 - DNA, 1794 bp, Oryza sativa
gccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccatgcttcttgagaatattgaaggtcttggttttaaggcctttgaggatttctgcattggcgcgctccacttggccattgcttctggggtgggcaggtgaggcgaagcaaagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgataaccggataagcctcgggccacttagtgaacttgtcgatcgcaacatacagatactcaaacccgcccggggcccgtttgaacggtcccaggatatcaagcccccagacagcaaatggccatgatagtggtatgatctgcagggcctgggccggctgatggatttgcctggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagcccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggggagggcctggctcttgatagcgtggcgtggttcaaagtgcagatcgaactcagaaagctcgattgcccattttaccacccgtcctgtaccctctcgattatgcaagatttgaccgagggggtaagacgtaaccacagtgaccctatgtgcctgaaaataatggcgcagtttcctcgaggccatcagaatag

SEQ ID NO: 1107 - DNA, 19045 bp, Oryza sativa
agaaagctcgattgcccattttaccacccgtcctgtaccctctcgattatgcaagatttgaccgaggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggctgatcctctctactaggggccgtacccccggggggttcttcgttcaagtgggctttgggggcgcacttgttttctgtgccgatgacctcggggtcggaggatgaaaggggcggccttccctcagtggcctcgggcccgtcctgggggtcgggggctcctggcatcgtcggacaagcgggcaaagggccaactccggtcgtcaggggcctctggccttcgttgggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccggctccggtcgtcaggggccgtaggccaccgtccgaatcgggggcctctcctccccgctcgctcccgggccaagttagcacagagtgggggtgcacgaaatgaggattgtcttcatcgcgctccacaaccaatgctgcactaactacttggggggtcgccgctaagtaaagtagcaggggctcatttggctccggggcgactagaactgggggagagctgagatatgcctttaactgagtgagggcatgttcagcttcctccgtccaagtaaacggccccgagcgcttgagagcttaaacaagggtagcgccttctctcccagccttgatatgaaacgacttagggcggccatgcaaccggtgacgcattgcacatccctaagtttgctgggggggcgcatccgctcaatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctcgagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggagaaaccaccatcgcaatctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcagcggcgggggccttctgtttggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagttctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagtacgccgatcactacgtcggcgctcaatgtcgaggcgggcatccggctcttcatgctgatcctcccgagtcggaggcgccgacgaaggagtggtagccgaatggcgtgcagcagccgccgctcgccgcgccctccgccttgatgacacagaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgcgggtttggctccccgtcgtcgccgctcacactcggagagaggtcgtgcgcctttgcttgctcggccattaggcagaacaagggaaacttggcgcacacggaagagtatgagagctcagaaaacacacactgagccccctacctggcgcgccagatgacggagctcgtggcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctcagccttccaaaaaggaaaaagtcccctctctaaatgggcaaggtcctccttttatatctcaaggggataccacatgcacctttctctttaatgggcggagatcggtacggtttccatccgggagcccttctgatgggacagcccacacctacccccacctcccccgaagacagagatgacgcgggaccgtggctgtctgtcgatgacgcgaccagtgccagactggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgctaggccacgtgggcgattgcgtctgcctcaagcctctggtcatgatactcccggtcccatatcaccgacaccgtgggaagatcatgtagagacagcttgactaataatttatatattacttgtgataatcatattctaagcaggggttaagataatccaagggtagagtgacacacaagcattaactactcattctcataatatatcatctaagttaagtggatagaaaagagaaagaaaatcttttcctatacttgtaatatacatagtatacatacattctagctagctgatatacgagctaatactctctatcggatgccttcctggtacttcgagaagccaccactggctgcagagttcctacgacaacccgctatgaccatacaaccggggctaaatacggaggaataccctccccaggaaattaacttaggattatataccagcgaggaggaatacccggactgagctgtcacaatcagcggcccacctctcattcgcaatatataaccccaaataatgatatcccgtaatctagacaccacgtctaaactaccagatactactctaatatcatcgtcgtgacatagagtaattgcataagcaaacattataccgcaccaaagcatctcccagataagctagccgtatattcagtataacataaacataatgtaaagtaggcattcatatactcagaaagtattccaataccataaatgtataaagaagagtattctaataaaagtacaaagcttacaaaagagaagagagaagctattagagccatacccgaactcttccgaaggcttccggactcctgatttttactctattcctattccaccagctagatactactaaactaaacttgagagaaatgaaaaagctattgcttgaggtgtgtgttgaagtgaagagagtgagctccttatatagaggtagttatgacggttgtggaaggggaaatgtccgaagtaccccgcaaccgccatcaggagaagatctggagcgtctctgccaaaccccacatccaacggtggagaaatgggttcggccgaacctggggccggcccaaccagcccacaatttggctggtggcctcctggacttctcttctccgcagacttgtgaattttggcccaattcatcgtgtcaactcgtcaactctgagttcttggcccattcatacataagtctggtgctcgacatcgtccgattgatttatcgtttgcgttgacatcaattctccttcattttagtgtcattctctgcaaaaggttagtatacctaatactagtggaatattattattctaacatgtttatgcattgcaagcatggctagttcacctctattttggtaatattgactgtcgaaactgatcaataacgaccatcaacaatacttcactcgaacaacctcatattttcgcttatgcttatacttatcagccaaaattttgaattttcaactttaaatttggagctgatttcggggtttttcattgtagtttatttttcagcctgtgcttttagatcgttaagaataagtatataaaagttttttttctcgaatacgcaggagagtacataaaagttttattcacaatttttttttgcaaatacattattcgctttttcctccaatatgcgacacgacgtggctaaaaatttgtcacaaaacaagcgtgacaaaaaaatgaggtaccttgttaacgtatgattaatgaagtatgagctacaaaagacttaaaatattaattaatatgattttctaaagcaactttctaaatgtatttttaaaaataagttcaggaagcgtgcgtatggaaaacgaaagggtggaagtgggaaaagaggagaaatgaatgcagcctaagtttacctttctcgccaaaaaaatatctacattatttactgatgttaaagaagatataattgctaatagggatgatttagatattatatagtataaatctaagaaatagcataaatgtttatcaaagcaacatagtataaatctaacaaatagcataaatgtttatcaaagcaacaccattcaagaaattttatggagaactcgtactttagatgtcatttatatgtcttgtcaagcgtagcctacgatgcatggccgtgcttcacatgggctacctttgtagttaaagaaaaatgcttgtatttgatatggtccgagtagtacttcataagtctcagaatgaataaatttttcatttcccccctccatttatcctcggataagttcattttttcagccattattactttggagattataaaaatagatgataaatatattaagaatagataaactactgaataataaaaatagttacattagggatttgataaagggatagtattttagtttttttatttatatatactacatccgtcccaaaatataacaacctatgattgaatgggatatatcctagtccaataaatctggacaacactttgtattcaacgtgcaatcctaaatagtcatattttgtgacggagggagtactagtagataagtaaaataataaatttattttgtgaaagatggagtatagttcttacacccaaaaatgaatttcgtttgtttgacaaacggaccaacgatcagaccacgctgtgactgtgagccggacaacactttgtattcaacgtgcaattgtgactgagggagtactagtagatagataagtaaaataataaatttatggctgaatagctaatttaatccctcaagttttaccgaaggctcaatttggtccttcacattttattttgtccacatagctcctctaaatatttgttttggcttgaaatcaccttaggcccacttaatatgccatatggctatttctagttaatatttctattagaaaatgtcccttttacacttaatttgtatatacaactatatactagaaaatagaaaaccaaagatgaataaacaacattgcagatgtgtttcccattatttcaacatgtgcacataaaacttaagcaattgctactgtatatactttctagtacataatttattttcgttttacataatttactatggtgacctataagaaaatcaagcatgcaatttttctcttatatatgtgaatgataggggtataagtgtcatttatcaaaagagttgttggttcaatgctacatttgaactaaaatgaaaacttaaaggactaatacggatagattgaaacatcaaggactaaactgagtcccagatgaaatttgaaggagcaccttttgtgaaagatggagtataagctcctacgccaaaaaaaagaatttcggttgggcgacaaacggaccaacgatcagaccacgatgtgactgtgagcctggacaacgcagcagcaagccccgtaccgcgcgtacgccggggcaacgtggcacacgctcctaccctagcgatcggagacgagccgaccgcgttgtggcgcgcgcccccattgccattgcaattgctcgtctcgtctgtcgtctcatggctctgctcgagtgctcgactcgcccacacgacactgccaccgcgcgccattaactcccgcacccgcattcatgcccgcgccgcgttccaaccaccgcaccgccttaaatgcccctccatcccccattcccatccctcctcacctccacctccacctagctctagagccttccctctcctcctcctccacatccaccggagagagtgtgtttattggttcttggaggagagatgtccaagatggcggaggagaaggtgctggcggcgccggccaccgtcgacggcgggatgcagtcctccggggacctgcaggcttcgtcggcggcggcggcgcgtgtgcggcccgtcgagacgctcctccgcgccgcgccgctggggctctgcgtcgccgccatggccatcatgctccgcaactcggtcaccaacgagtacggcaccgtctcctactccgacctcggcggcttcaagtacgcttctggaactctcctgcggcggcggcggatcgacatggctcactctcctctgatctgatttctttttgttgtttttctttttcccaaggtacctggtgtacgcgaacgggctctgcgccgcctactcgctggcgtcggcgttctacatcgccgtgccgaggccggcgacgttgtcccgctcctgggtcgttttcctcctcgaccaggttgctttcccctcactgctgcttcttcctccatttcttgccttcccaacaaggattcactccaatttgcagccctttcgattcattttgctcgagcaatcatgctcctgtagtagaatgaaaaaaaaaaaaagctcgatgcgtcggaaataaaaagcagaaatctcggggtatttagagggggaaagttgaagttcgataaaattttgtttaaatttgagtaaaattgacttaatttatttatttttgaatatatcggacgaaagaatatcctatcagaggatggaaattcctgaaatttcagatgttcttgaaatttcgttcccgaatttccgttatgtctgtgtcgagctcactgaggtatttgtaggacggtgttttcggtgtgaacctttccttggatccgtatgtatctgttagcttaccaaaccgagaaatcaacaaatcctgtaaaaaaagatctgatcctttttagttcatatataacccaactgacgaactgaaccgaccgataacatctgcaaaaaagattctgagggatcatatcatacctatccatacgatgaactaactaaggctgacttcttttcttctctttcctaactcacctctctcgtcttgcttatgcatggtttttaaaatactaaacggtatattttaaaaaaaagtttctatatgaaagttactttaaaaaatcatttaatatatttatgttatttttaagctaatacttaattaattatacattgatacaccaccatgtttttgggaccgtctcgaacataatatttttctcaatttcaaacttcaactttcttattattttccgttagcttgttttttaaactgttaaataatactttttgacaaaatgtttctacgtaaaagttgtttaaaagattcaaataaatccattttaaattttataataattaatacttaattagtgggacaatagccattttgctccatgaagtttcgctctgagatcattttagtccatgacctttcaaattgtccaagcgagcctttaaactttttaaactttatcatgtggacatatatatatatatatatatatatatatatatatatagtcctttggcccatcggaaatttgccatgtaggcatgccatgtcatctttcaatgtcatctttcaatgccacgtcatctttcaatgtaaatatatgatgaaatgcccaatttgcccatacacatgaccaaattgttcctggagcaaaacttctattctcccttaattaattatatgcgaatgaactttctcgttttatgtgcgccaaaaaaattatcaaatcaactgagagaacatgctaagctgagatgagatcacatatatgcaggtgttcacgtacctgatcctggcagcgggggcggcgtcggcggagctactgtacctggcgtacaacggcgacaaggaggtgacgtggagcgaggcgtgcggcgtcttcggtggattctgccggcaggcgaggacgtcggtggccatcaccttcgcctccgttgcctggtacatcctcctctccctcatctcctcctaccgcctcttcagcgcctacgacccaccccagccttccctcggcaacaagggcgtcgagatcgccgccttcccccgctgatcgccgccgccgccggagacgaagaagaagacgaccacccagacgaccaccaccaccacgacatccccagctactaagcttgagctgctgcgtgcttgggtactactactagctaggcgagagcatgattaagtaataataataagtacttttatctctccagctaaatatatagtgatgagtgctttttaatttcttcttgtgctctgttatatatatatgtgattatctctgacctgatcatgatcatcgtcgtcatatactcatatatctctactcgaactcgtggtatgtatggttgttgattcgatcagctgtggtgaactgattgacccgttacaaagattgcaaactggatatgtatctgcggttagagaatgggtggtataatttgagatcttgaatgggtgttgcttaagggctccttattttccccctttggaatgaatgatttattgagaacattggagtaagaaaaaaaaaagaacttggaaattagatgtcacggtttgttgtatcgtaatattacgagtctatcggaaatttatagaaaacggcgtttggtaataccattggaaaaacatgtatatcatgtggaatttacacgagacaatgtatatttgagtttatgcaaaattcaaatataatagcctagtactccctccgttttttaatagatgacaccgttgattttttctcacatgtttgactattcgttttattcaaaaaatttatgcaaatgtataagatataaatcacacttaaagtactatgagtgataaaacgactcataataaaataaattataattacgtaaattttttaaataagataaatagtcaaatatgtgagaaaaagtcaacggttttaactttatttttttattttttaaaaattttatggtgtagtaggaagagagtaggggtttagggtttagggtttagtagtagcttccaaaggattttgttggactccttactctgttcaaagcaatcgtgtacaaataatcttacatcggattttagtactataaaattcatactctctccgtccttaaaaaaaaaaaaagataaactctgggtttccgtgtccaacgtttaattatccgtcttatatgaaatttttctataattagtattttcattattgttagatgataaaacatgattaacactttatgcgtgacttatctttttaatttttttcataattttttcaaataagacggacggtcaaacgttggacacggaaacttagggtttgtattttttttttttttgggacggagggagtacgttctatttagtacatgaggcactgttctgtggaggggggttaggaatggtggatagtaatatgattatttaaaagcagctttttataaagtttctttttttttagaaacgtaacatttaaacatttgttcagaaagcatgcctatgcctatgaaggctgtgtttagtttatactaaaattgaaagtttggtttaaattagaacgatatgacgaaaaagttggaaatttgtgtgtgtaggaaagttttgatgtgatggaaaagttgaaaatttgaagaaaactttggagcaaaacacggcggaaaatgaaaagcgagagagaagttgggaaaataggagaaaaaacttccgtatggaaagcttttgtaaagactgtattctttatatagttcattaaacgtgcatgtgaaaaaacttccgtacggaaaacttttgtaaaaactgtattgtttatatagttcattaaacgtgcacgtgaaaaaggagaaaaaataaagttatttgtagtagaaaagaacacacaacaaagtaatttacagaacagttcaccagaggttggtgactgcagttatttaggaatcactaggccctcttaccttgaaagcattttaatctgaaattagaaaacaaaaacttgaaataattaaaaaccattttcaaaatttccttatgctggtatttattggattttattttttcttttcctattgtaccattgccaaaaactaattaaataatttcaaaggtaatttaaaaaggaatcaacttcaaattctaaatttgaaataagaaaatgaataattttgatattgggaatatatataccatctttgactctttatgtaattatttatatatattaataattagcaagtcctaattgtcgtgtatacttttttttaaagataatatcagccgatataatttaacaattatattgacattccattaaaattataatattataatatacctgtaaatagcccggataacataagattggctcgatccattattcattgaataagtaataccaaaatgtagaatgaaccaatatctacatatatcatacattgttgttttttctccaatcaatataggggttgctcagattgtatccaaaataaaccttatcaaaatttgggtctagatcccctggagttggagccaactccaccggtagatttggctcaatcttaaccgttcttctgacttctacggctgggatcatggcacctactcttcttctaatcaactatcttaatcatatagatttagaggaaaatatttagtttttttgaagtacttcccaccataaccatgattattctccgaccaatagtatcaataaaacaacgctggccatcacaaaaccatataaataaacattagcattatgttcttcaccatggttggaggtggagatggtgggtggaatacccttgaatcttcagtttgactgtttgaggcaatgaagaacaatatgccaattttatcaccatagctgaactaaagtttgatgacaaagacgaagctatcgcggctctggaggggaaacgatggtctgctgctttggtactagtaatttaattaggaaaggaaagaaacacagttacagagattagagaaaatctcagccgtataagtcaaaaggacggttgagattcggccaaatccaccggtggagttggccccaactccaggggatctggacccatcaaaatttggtatattgtcaaaattttagtaggatttcttatgtattatcaaaatttggcaagaaagtaaatggatgcacatatttgacaacttaaaaaaaacatggtttgaaatggtattaatctgaaccagcccgaaacttcggagtactctctactagtactagccatttcaagaaaaaaaaaaaccctgccgcttgtttaagagaaatttaaaattttgtcgttaacaagttcttttttttttttttgctattgactagttagcgtgcacgtgcaaggcacgtcaacaatattgaatagtaaatactttacatatatggaacagaaaaaacttaacctttactgtaacaatagagagaaacaaatcgattattctttttctaaaaaacaaacaatcaaataatatatcaccgataattgtttacggcccattgccatccccgccacttaacgccttgcatgttggccccaagccacactcttttttaggcagagagaattcagttatttttttagtatttataattatccaaaatggtgctactgtttgttaatggtggtgcaaacaattgctttgctggtccagtttaaaatcggatgattaacggaagcatagtgacagggataaatctccgagaaaaatggcataaatcaacaatactcaaagagtctcgcattgatgctatgtaagagaaaatttgattatgaaatacaagttacaaattatcatggtcatgtaactgtttgctagtgtttatgcaaatggtcatttctttcattacggtttgattagataattactaacagcatcattaggttgataaattggatggttgctaataacatcatcaggttgctgtgacaatatgatctttctgcaagaaaaggttgcagttatagtgatgaagttgtgagccaaaaggcagaataaaggcacagtgacatctgtcacgctgatggtactgaagtacgcaaatctgtttacaaattgtagcatttttttgtcatttttcagttgaggtagatgtgagaggcgacgtcttggatgagctagttgaagccctaaagcagcctggtttgagcacctgcaaacaaaaccacacctccagctgtcaatcaatcagcttccaaatttgccaaaattactataagaaaatcttgcaatggtcaagcacgtttaatacacgtctaataaaaccattttctatatacagacttagaacatattgtttttctcaattttatcaaaattatctaattgaatgttgtgatttgtcagatacacattaaaacaaaaccctgctgaaattatctgaacttcgcataccacctgctgaatcactgtaaaacaaaaacatttttttctctgaaccttgatgttcatcgccaaagttgggttaggcagtatccaacacatgggcctaaattgtccctttaggcaatatacatacatatgaggtagtgtaagagatacattacagaagaaatttggagagcagcaacatttacagtgctctcctgtctaaacaaatcgttccttgcttcaattatctttggacatgtggtctatatatactctgtacatttcaataatcttgagacatgttgtctatactcagtccattacaatgctctccagtccaaacaggtgaaatggattgaagccataactcctactacgagtatatgaaataagagtattaacaatgtatatatttcttaccaacaatattgtagatatgcagtgatccttgtggcagtgcaattcaaatatggtatctaaaatatgggtaattatcataacaggataaacaagctacaaaggatttatgccacatgtaaatttacttaattaacttgcaatgtcaactggctgaaataataatttttcgagatgattacagcactttaaaagcaatagcttcaaaggctaacaacaaaaacactatagctgataaaaaaggtacggtaaattatatttcttgccttcaatagtagaaaagaaatagaactgcattgacaaatgaaagatgtccagaaatctcaaaacttttttacatatctagctatcaaagtcacatatatgcccattccagtcaaatatatgattaaattaagaaatgcacaaattggaatacccagaaactgcatcacattagtttgagctaccatgtaataataatctactgccacatgggaatatgatattgaaaattagcctaagaacaaaagtacagtggagcccaagaactaattgcctataggataagccccaaccacaggatggcatccatggtctagctttgtggtctgccaaaacatttacgtgttttcctctaacagagctcaccttcacctgcaacaatcaggcctcaggaccagaggggaagtcacagttccatagcatctgagtttacaacagaggggatgattgaatcgaattacatccagctagggtaatattcaaaaatagaaatagaacgacaaaagaagttaaagaataatgcacgtgcaaggcaaagaaccataaattaacatgacatgtttcataattgtaatcattccatagttcataatagatgcgcaagaagttcagttaagaaatttttttaccaaatcaaattaatgttgcaccaaacaaaaaactatccaatataattatgagccaaatggcatgcggatttttttagatgcaaaagtttagttttttcttctgagatgaaactgtatacaaaatactgcatacctcatgagtacatggtgtttgaatatgtgacaatgaagtggaccattgctacaggcctaaggaagaaccagctccaacaggggaagaacataagcactccagagccatttcttcaattcaggggttcctatcaatgaaaactgaaaaacaaatcctttgtacataaacaattgcatgtttgtactgcaggaaaaacgtttacatattcagttatcatgaattatgtgtatagaactaaacttgacatgttcaaggaaaatattatcactgcataaatctgaatttgtgatgtgtatgaaagcatgatatccagtaatatcaatagaatactctacatgcaataccattgcttataatgatgtccaaagtatcaagtgatggtgcatagaagtataggactataggggcttgtagcagcagaaatattagaatggcctcatcctgaaactaaagtatgcagtatttttagtccataacggtctccacatgtctttagtagtaacaatgacaaagatatacagggactgtcacacagtcagtcacatatgtgggctgggccaagcggtgggaggagaaaaacaaaatttgcatcaacaagaagcacgtgaggtaactaacaatgtctattggtaaaaattgtacaaatctacgaaacaaaacgtctagaacaatccatgcatacaaacttttataaaaatatttctaaaagtaatgaccttctcaatctcagatgattcacattgctagcgttcacctttagaatgaatatcctactctgctcttttcagcttggaatttcctcctggaatcaaataataataccaggttgaattttatattgacaatgtactattatttgcatatttcagaaaaaagctagtgagcaaggcatcatacactgttaactgttcaatgtgcaagatgtctaaaatgacaggggaagtatgcagtacgacaataatcaaatctctataacttcgccactttctttactatagtccctcttggtggtgtttggatccagggacttaactttagtctctgtatttagacactaatttagagtattaaatatagactacttacaaaactaattacataaatgaaagctaatttgcgagataaattttttaagcataattaatccataattagagaatgtttactgtagcatcacatagactaatcatggattgattaggctcaatagattcgtctcgcgaattagttcaagattatggatgagttttattaatagtctacatttaatatttataattagtatccaaacatccgatgtgatagggacttaaaagttttagtcccatctaaacagggtcttagacttttttctcgagaatacacaaaagtttttcatgcctttgtatctagaattgggaggtagctcctcctagatttaaaaaatcatccaatattatataagttaagttgtctaaagaagattatatttcacatgttattaagtacccacggatgatttgcttctttcagcaaattaggtactggtgccgtcttctccttcatctatctctcagttgtatcattttccacgtacaaaacatgctttgagtcagtgctaccactgataaggaaattgatattggcattcatactaatactaactaaagaggaggaagggcaacaaaggatgggcttgcaaataaatttaaggtacttgaattgcacctcagtggaggcggtggagagcctagcctaggatatgagcattttgtttgttacctctctgaccaaggagctcacttttttttccccggaaaacaaggagctgactttggttacagaaaaatcagaagcatgtactggaaagcaataatccctctagatgaaattgaactgggttggatagcaatagtatacaagttcactaattcacctgttgttgataacctattactatattccattcttaccccttctcttatagctcattctcataatttgtaactccaccgcagtccctaccaaacaataaatcacaatttatccatccaaaacaacatttgctaagagagttagggcctgtttggtacaactccaactcctaaatataactccaggagttgagtctggagtggagttgtggagctggctaaacccagctggg

SEQ ID NO: 1108 - DNA, 11864 bp, Oryza sativa
  unsure (1)..(11864): unsure at all n locations
aactctagtacattttttgagagagctctacccaactccactcctagttttggtggagctgaaactgtttggctgagctccagctccaggagaggtggagttgaagctggagttgtgccaaacaggccctaactattttctaggacatggttggctgcagcttcagttcattctctggcaacatcctgttggttgcaggctgccgctggtactctttgatccccgcaagctggcactgctaattaacccccaacggccactgtcattgctaacaacatggcctctaggcgctagtctaaaattcgttgggtgggtgagctagactgggttcccctattaaaataaaatccccaactggcataatctgtataaaatcccaaatacacagtcagaataatacgcaggcagcagcagctgaaccaagcggcaagcgcacatgagccgaaccagcaataggagccgaggagaacccctcccacgtaccttgagcagcaccatggaagcccggtagtcgcagctctgctcctgtcgtcacgccagatcgcaggtggagttcatggcagcgatggatccacggctccgatggtggcggttgcaggcggagtagggaaccggtggcggcgaggaattgaggaggcagcggggaaggcgcgacggtggtgaagcgcgaacgcgcgcgaggggaacccgcagagggggaaagcgcggcggtagtgaggcacggatgcggggggaagggcgccggtgggatgcgtagacacggggtggggaacgcccaacggcggtggggaggcacggtcaggggtggaggcggggaggagtgcgcccggcggtttggggataggacggggaagagcgctaatccaatcgctattttgctgtaaccgctgtttactcgaggtatgagattggtgggagatcgctaattgcagaggtgatccaacttttgatataagccattggatgaatagatctaagggtaaaaaaaaagtaggtatttgatgaactcgtactttttatagtagtatagatgagtcataacccacaccgcttggtttttgcaccaatcagtgatgcaattacgaaatgacagtaatgcttcgttcggttgatcatattaaagaaaagattagggagatttagaggagaataatttcacatctattaatgagtggaattaatcccctgtaacctcgatctaataggaaataaccgaacaaagagaaataaaagagacatgtaggctaatatttttatttaacctttcacataattttttttctattaatccaaaaatgaatgttatttaatcagcactatgtctagtaaccaatatacacaatttgagagaatctaagattgacttgggaacatttctggattgatgccaaaatatgccataccaattatttggcaacttaaatagtatgcgattggtttggattagagccagagcattgctaatgcccatactttatttggcaatattctagaacttccttcactgatatcaaacacatgaatagcaaaccaaatatatatactactagaaaatttatgctcctgttggcgcgcctactgattaacccgtacatgcgaaatatgtagcgatatagcctcttaatagtattttaatttccgttatttttaatccaaacggatagtatgtcatgatcaagctttaagataaggtgtggcttggttagcagttggagtagcacacagtggtaaagctcgagaagctttaccattgcacgtcatcgttgataggaccgatcatttttcaaatgatttcatgatgtgccaatagtaccttgctatgtatttaatttattttgcattaacatttgattttgatgctactccatttttattttttaagatagttttttttacttgatttagttctctatacttttgtagtgctaatattttacggatatataaaagtggcatttgtttactttgatgtcaaattctgtagcatgagatgaggacattggtatatacttgaaatgttccttagggtagtaacctcttgttacatagttgcataatagatttattggtaattttttaattgcttggaattgtgtcatcctttatacaatttttttggaattttaattttgtgtactaaaagtcacatttagatctatcatatgacacgtataagttaatagtacattggctcataataatgaagagaggaaaaaaaatcctctcaaaaaacaagagaaaaaaaaaagaaaagacaaacaaccaaagaggcctagtcctacccctctcccactggctggcacagctgagctgcagcccagccactggcgggacggcccaactcgagcgaaaaagctaattggcgactggacatgtgtcgcgcgcgggggtggggcggcggacggcgcccgcgagagaggttttttatttcggtctctgttttgtttttttttctgtttcttccttttttttgggttctatttctgttttggttttttcggttttttttctctttctttttctgctttttttaagatgtacgtatgcaaagtttatattcgtatatataccaaattttgtatttgtacgcatataaagtttgtattcgtgttattttctctcggtatatatataggtggtttgtatacacgtatgcaaaaattgtatacatgtatactttttatatgtcaatttttggtacacataaaaattatatatacgtatgtatatactttatatacgtatgtataaattttgtattgtatatgtcgacgtttgatgttgcaattccggtatttgtataggatggagatcgttggtactaggatatatacgagagtgaggtaaaagagacggagacatgatttttatacaggttaggaccccttaattggcaggtaataaccctacatcctgttgaccgaagccggtcgttgctcttattcatcataatcacaccagtacaatatttggggtagcctatctaactgttgtcgacatgacggtctgaacgtctgactcgtagtcgacaacagggtagccttcctcctcgagttcgtgcccggcaagatcagagacaacgctatgtctctcctgacagtatccggagacatcgtaggggactagccgtgcttatccctgatgtcgatatccggcggcttatcttggcgtatgttggcttgtatgttgtggcctctattgttccatgtatgttgattgtctcttctatggtgggtgtgtgttgatcgtctcccctctcctcctagggggccttgtatttatacccataagtgtcctcttgtccaagtagaactagggaaaccaatatggatacaatccaagtagtccttgtcgtttccatgtagaactctggttgtctttccttatccggaactcctcctatatccgcgggttgtttccgtataagacatggtatgtggtgggtcctgccgagatttagtcaactactattaggtatgtggtatccataaccctgacagtagtccccgacttcaatgcaaatgaacgagttcatattctcaaccgcaaaccttagaggaactgttatcgagctcacgtgaccgttctcggtgagttcagagataacgttaaacttcctttatcagcctcgtgtgggcacctaaagggtttgtctgagtcaatcatcaaagtcaaccaagaaagtacagagcatatgactaagttacccgtcttgctgtaatcgagaatttggattgaagtcaagaaattttatctcgacaggtacaccatctcttcattccgtattccttgtcgagatccaccaaccgttcttgagtaatcgagtaggcgtagagtctgcgacggagccttgtcaacatttgtcgtactcgcctttgtcgatcttggtgtagaaccatagagacatggagtcttcaacgatgtcgaatagagttttcctgaaatcaatacttagaaaagaatattagatagaaatagcccccgagtgaacgctcaaagggtgacatgttataatatgtatggaaaactaaaaatgaattaaatttacataccaatgttttgtatatgagcgtctactcttttaccaacttcgatcagtcaatttgtttgagttatacactctccctagcccccagccttgtcgtcggagaatcgttctcgggaaataaggctcttagacctttgacctgcatcggttgaataagcacttatcctagcccccagccgtgaagttggaaaacccaatttccgattacacggcttggttaatacgcacggtgagaactcttacacgaccagatcttacatggtcttttgtctctacaggatccgacaaggccttatccgctctgggcgtccctagccgaagttcccttaggttcctcggaggccttgtcaagacggtgtaaaaggacattaggataggtttcaatgctaggtgtttttgtggtaagggatctctgggtaaaacgcttggcgatattgtgtacctgaggtcaacttttgttgaagtagaggtaatgggagaatcgctacacctctagtcaagaaccaggtagtagtcgtaactcaacgactagaagtaaatgtacgagagatcactacgattgaatggttaagaaccagtgagtaggtgtctctcgatcatttgaagtcgtggtgcgaggaccgctgcgttattgctgtagtcgtacctcgaccatctgaggttgcggtgcgagggattgctacgtactggtttgaggaccagcgaacgtgtagaatcatctctcgaacaccaatggaggttgcggtgcgagagattgctacgtactggtttggggaccagcgaacaagtagaattatttctcgaacaccaatggaagttgcggtgcgagagattgctacgtactggttcgaggaccagtgaacgtgtagaattatctttcgaacaccaatggaggtgctagagttggtttattacatgtgcgtctcatgtggccagcatgactcacgcacccaacttatagcatatccggatgtccattcgcaatcatgtcgggtgatcaagccgacggtgttcgcgaggaattatccgttaacaatcttttctcgagtagtccagccatggccgatgctatgaggtaggtcgtcggtcttcgttggtaggttgggcgcgacgactctgcatttgtcgagatcgttctcgataatgcggtgtactcgacgacaacctactcgggtgctcaattgttcctgaagaatattttctagaaggcaagacatatagcagagaatatcgagtatgtactcaacaaactgcatggatcttctagcattatcaggatataacgagcagatataaatatcaggcattatgtagaccataaacaagcatgatttatacagaagaaaatagagcgagcccccagcgttagaccgtagtcaatttaacatcggggacacccgcgcaacaaatattgtataaaaaacatgctctaggtaaacataataaattattgatctgacaacatctgaaaataggtacggtaaattgtgtataaaatattgcgtacctttatagatacatgccggatgtatctacgggattagtagattaatttaaaaaatcaatctactatataccttgatttgcatgcccgacatactatcaatagaagatataagtatgcatgcagtagacctggacgtcaatatcttgctgtcttggaagagcaatgccacctgtcgcatgcatacatgtgtctaggcatgtgtacgtggcatggttaggcaagcacgcttggttgaccaattccggctagcacacggcaagttggcgacgcagtggcgcctattctcggagaatttcgcgcggcatgcatcgaggtatattggttggtgggaatcggcgtcgtgtccggcctgtgcgcagccagccaataactcacaccaattgatgtcgtgcacgaggaggaattgatattggatcggttttggaagctgccgatactgaagattctccacggtggcgatgacttgatgaagcttggtcgatctcgccggatcgaatattcgacgacgatggttccgatcttgttggacgacatactccggtcgggttagatctccccataaccgaagttgtcaagtagcttgttgttggagaatccatctcttaaacccatctcgtcgaaaccctgaagcaccaaatccccctacctagcgcgccattgttgacgtttgatgtcgcgattctggtatttgcatagtatggggatcgttggtactaggatatatgcgagactgaggtaaaagagacggagacaggatttttatacaggttcggacccctgaattgtcaggtaataaccctacatcctgttggccaaagccagtcgttgctcttattcatcataatcataccagtacaatatttggggtagcctatctaactgttgtcgacatggcggtctgaaggtctgactcgtagtcgacaatagggtagccttcctcctcgagttcgtgcccggcgagatcagagacaacgctatgtctctcctgacagtatccggagacaccgtaagggactagccgtgcttatccctgatgtcgatatctggcggcttgtcttggcgtatgttgacttgtatgttgtggcctctgttgttccgtgtatgttgattgtctcttctatggtgggtgtgtgttgattgtctgtctcccctctcctcctagggggccttgtatttatacccataagtgtccccttgtccaagtagaactagggaaaccaatatggatacaatccgagtagtccttgtcgtttccatatagaaatctggttgtatttccttatccggaactcctcctacatccgtaggttgtttccgtataggacatggtatgtggtaggtcctgccgagatttagtcaactactattagatatgtggtatccataaccctgaaacgtagtagtattgtcgtagtagtattgctgttgctactactacagtagtagcggcgcgcaacagtggtagtagcagtagtaggagtaggagtagtggtagagcagtagttgcaggaggagtggactggtcacgcgcccacgctcccgtgcaaatcactcattaggggcaccccaactcgagttgtgctactactacgaagccacgaaggggagtggagggcctaggactacacccgtcatctaatgtatagtgcgccgtgctgcgtaaatttgcatgaaaacccgtcggctctagaatatcagattactctacctaccaaagaattatttcctccctcctataatataagacgcgcccgtatttcaagattcaacgtgtaaaacatttgacccatacatagtataatatggaatgaattttatttattaaaaattatatcattggattgatatttaaatttacttgtatatggctataattttgttgctacaaaccttataatatataagatattatgaactaaagattagttttgtagaccattttaactttaaccgcgccttatagagggaacagcattagtagtgcgaaaattcgcgtagattttgacacctggtttggtttgtgacctaaattggccttaccaatttttgtcgatgccaaattttggctaggcaaagttgtgtttggattgaagccaaaatagcccaagttaattattgaaatggcctattttcttaggcatgtcaaaatttggtttcaaaccaaatagacactacacactgttaaaacgaatttgctatatatttgtcgacaaattttcctccaaaaatttgtcagatgtaattacagtacaatcgtagtgtaattacactgtaacttgcatgcaattacactgtaactataatgaaatttgtatgtaactttcaagaatctctcggtaacatgttatttcagtaaaatagaggttgtgggaacttctttcacatatgtgtgtgctgtgatttttttctttctcaccagaacaaatcttgcaatagatctaacgattcaaaattacgtgaaacttacatacaagttacactgtagttacatgcaagttacagtgtaattacatacaagtttcagtgtaattacactacgattgtactataattacatctgtcaaatttttagtagaaaatttatcaacaaatgtataggtggtcccctattaaaattgccaaatactggtaaggccaatttaggcctcaaaccaaaaccggcccatagtgtctcagaagcatatggaacggagccacgtaggagctggctactgggcccgtgggctgtggctggcccggcccgctccgttccagtgagccggggcccggagggaagaagagagcaaccagagcagcgcgtgtcgagcggcggcgactcggttagcggatggccgccttgccgcaggctgctgccggcgtcccggcgagccgtcgtgtcggcgaccggaggtgggacacgcgctgcggcgccggggaggccccgcatgggtgcgcggaggcgtggggggcagcgcctggtgccgcacctggagcaggcggcagccgacggggtggcgtgggggcggcgcggcggaggcgcactgcccaccacagaaagacggcagccgagccggcagagccactcctgcaccatcaatcgaacatgcagggtacgtggattttttttcctccaatttttttcccatattcatttgtactgtcaaattgcttggtgaggagttcatttcagctttcagattcgctctgcgacagtgtaacatgtttagggttcctttggagtaattcctatataagtcatttggtttataggattgctttaaaggaaatttactacataggataggaaagtttcctccacttcttggaggaattttagcatcaggtctaacctctagtttcaaattcctttgagattttcaattcattttatctccaacaaatcaatatataatcttaaatctcctatggttttcctatgatacatccaaacacatgttttaaacgattcctgtagtattacttcctgtatgattcaccatcgtgtgacatctcaatccttgtgttttttatattcctgtattctcctgtgacttttgttgagaatgccttggaaggctgaaacgataggtggtactacgtgttgtttaaactgtgctgataggtagaccacaaattagaacttaagaattgatgtttgccagcagcctagcaccctagtcggaacttggaagggaccagaataatgaaatgatttgttggtcattaatagacagtttcttttgattgacagcggaaattactcgatattgttcttcaaattattagtggtatgaaccttttgagtgattgacaggaaacaaatccaccactatctgttaaagatgagagccaaaagtctgcagttggcctgacgatattgttctgttcatagtcagtcgcgtcttcttgtattggttttgttttaccctgattgcgtgaagtgaaactattattcaggttcgctcaagtcaataagattttcacatttctctttttaaaaagggataagattcagacaatcatttctgcaagtgcatattgttctgctgctccttttgcagattataattgtcgacgctatttgtgatcccgtgcatgcactttggcactcgtccatgcctcattttttccccttccgcagccactgcagatggttggtgatcataggttattcaacactcaagtcctgaacttcccttttccttaattgacaataccagggttggtgccgatattggcttttacctaatttaagtatctccgccatgtgtggcagggatttctcttggttaggattaacctaattaaccatccggcatgatccatgcatggcacagcttgtgggtctcctatttttggggttgatcttcctccttcctccccttggtattagaggacatcatctccctgtcccctctttgccctgccatttccttctccttcctcctgcagcagctgtcgtaagtcgtggcacgacagctgctgcgatatctatcgcaccaggaaggatccttccgaggaggaaaggcaaacggcgggacgcttgagccaacacacaccattgacaaaaacattaattagatcgtgatagaggaatataacaatcacagaagccatggcaagcagcggcaaggagcaccggcgaggtgttccacgcccaccgccgttgtcgctctacatcgagagggagcaaggtgaggtcatcatggctggtcaggcgctggcgacgacgaggatgctccagcaggtcgccaccagcagcagtggcaagaagaggatactgtccaagcagctgtccatgaaggagacaacccgggaggtcaagtgggagaagcggcgcaggcagatacaccggcagaggagcagcatggcccttcaggatgttgaggaagaagcgagtgccaacatgttcgccgccaccactgacagcgaaatgggctccagcaccgagcgggtgcccaagaggctgaccgatggagacctcgatgagctgaggggatccatggagcttggctttggattcgacgaggagaatggtgggcagaacctctgtgacacgctccctgccctcgacctctacttcgccgtcaaccggcagctctcggagcccaagatgcgtttgtccactagctccttgccatcaccgacatcagcgacgtcgtcctcctctaccctcggtggcacatcgaacccgggtagccccgtcgcaccttcttctttcatggactcgtggaagatttgcagtccaggtaaagaaaaaaaagaacaatatttatcccctttctcttggaatattgattctatttgtgttaatttatgtcactgtttttgtctgctaagatgatgtgaaattgtgatgcatgcaacttaacaggtgacaaccctcagcttgtgaagacaaggcttaggcactgggctcaagtagtggcctgttcagtgaaacactccagctgatcagtgctgtaacaaccatattctcctcccaaaagccattaacaatacaatgtttatatatatatatatatatatatatatatatatatatatatatatatatatatatgcatatccctgcatgcattggttagatggcgaaggatgagaaaattaaacttcgatggtataaactgaacgtaaccttttttccctctgatgatgacgcccatggttgtgtttgtatatatacagattttagtatacaaatatgtatgtgttggcaaacattaatgttctacatattgcatatatgtgtcctggttttgcaagaatatttttcatgccaattaatctctggccgatctctaattgatacaaatacagccttcactaacataacatgttggttgatttcagtaaaaccatatggaacagaactacagttacagaaacagaaaccagagactatcttagttgtaccagagtcacaaatgattctatgaggacttcatagaggtagagtgtgcgtgtgtattcataggaatgagtgtgagcgcattgtgagcgcctgtgtttgtattttacttataaaaaaaattgctccaaaatgcatatacattttatgttaatatacttggtgagctttgccacaagagcacttaagcatcactttttttcctgggttccttggtgaatttcagacctagttaaaaaaaaatctctctctctgatcccacataaaaacatgtgttaagattcgacctatatagggtgagtcctcgtgttggaagcaagggcctcaaagtaacggttaagaattgatccataggtggtgnnnnnnnnnnnnnnnnnnnnnnnnnnnnnnnnnnnnnnnnnnnnnnnnnnnnnnnnnnn

SEQ ID NO: 1109 - DNA, 1569 bp, Oryza sativa
atgatgacgcccatggttgtgttgtatatatacagattttagtatacaaatatgtatgtgttggcaaacattaatgttctacatattgcatatatgtgtcctggttttgcaagaatatttttcatgccaattaatctctggccgatctctaattgatacaaatacagccttcactaacataacatgttggttgatttcagtaaaaccatatggaacagaactacagttacagaaacagaaaccagagactatcttagttgtaccagagtcacaaatgattctatgaggacttcatagaggtagagtgtgcgtgtgtattcataggaatgagtgtgagcgcattgtgagcgcctgtgtttgtattttacttataaaaaaaattgctccaaaatgcatatacattttatgttaatatacttggtgagctttgccacaagagcacttaagcatcactttttttcctgggttccttggtgaatttcagacctagttaaaaaaaaatctctctctctgatcccacataaaaacatgtgttaagattcgacctatatagggtgagtcctcgtgttggaagcaagggcctcaaagtaacggttaagaattgatccataggtggtgagtccgggtgttgaggcttattcttaatgaaaaaccatggggacgtccattctcgcgtcggtcaagtgtttttttttaatcacagtagttatagtcgtctgaaaggaaagagttaaaatatacttcctccgtctcaaaataagtgcaacttggtaccgtgcatgtttaacgtttgactgttcgtcttatttgaaatttttttatgattagtatttttattgttattaaatgataaaacatgaatagtactttatgtgtgattaattctttttaattttttcataaaattttaaataaaacggatagtcaaacatcggacatgggtacccatggctacacttattttgggacagaggtagtagaatatttagtgggccaacattgggctgttaatttcttcatggagagagtgcgcacaatatcttcccatgggctgccttacatatgtactgagccataggggcctctggccctctggttcccgataatttcatgtaattccaagttttggtcaatacagtgtttgcttttcaatcttcttagcgcatgttttttttaaagaaactcttagcccatgctggtctgggccttttgtgtgagcttattataagatagaaggcccaagcccaacagttatgcgtgccaaaatgcaagtccgtgacatgcaaatgtcagatgctgtcgactacctctacaaatgtatgtcattttagagttatgtacatgaataaagtggttaaaatgatatgtaggtattgcatattggaaataatacatatcatttatacatgaggtgacgagggtggtaacaccatctagtccactgatgctcattcccccatgagaaactgataagctgtgatggcataagtgtttatgttgtaatgcattgtctatctattttgtgcacaaattttgacagtttgaccctttgcaaaaactatttttaca

SEQ ID NO: 1110 - DNA, 2468 bp, Oryza sativa
  unsure (1)..(2468): unsure at all n locations
ttgtgtgccaaaactcttaggcatatattagttgttgctttggcagactctaagccaactgctctaagatatgctatgatctaaatcagatcatcttgaaacatgtggtgtctgtgtgtgtattttgtgtgtcaaaactatgtggagtgttatcatttgaactgagtgacatttgataatttgatttgagctatgtttcaatttgctgaaattatgtggcttgtactgatctgatctgagatggcatgtaaaaatgttgaagttatgtgcattgtgatgatctgagctgatattatgtttgtgaatttgtatgatctgatatgttgacctgatctaagctgaaatttcaaaatgttctatttggtatcttatgtttgtgagctatatcatgtttgtaatatgaaaatattgtgcaatgtgcaatgtgagctatcttcatcgaaattcactggaattactgaaatttcagacagccatagctgcattcactcaaattccagacaaccatattgcatcttagatgtattcattgataattcagaatattacagctcagttgttgtacacatcaagttattaactaacacctaacacaaatggcagcaataggactagaacaaccaccattgtgacctaattggtgctaacatagtgcacctcatgcgaaagggactatagcctagtggttacaagagcctcaatagcaccttaggtcctgggttcgattccccatgagagcgaatgttctaggatttaacggcattgtgcttcagtggtgggcgatgtactgtcgacagtgaggcgcttgtagtgatttcgtcaatctcaaggatttgccggcccagtctttgaagatgctcataggggtagggtttgcgtgcatgcgttcacaggggtgagtgtctgcgttgtactatgtaattaaaaaaaacatattgcacctcacgtctgaactagtaacacaaccaacatcacaaacacacatgccagcaataacattacaagcacaaatctctgtttctctatcctactgttaattgccctcatagcagccatttttgcatcattctccgatgccacaagcctcaaatttgccacttgatttattgctgcactcagctctgtgcactgctcttcttcctttggcctcagttcttcaacagcacgctctaactcagccttctcccttcttagcgacaacacggcttcaggaagatcattcaacaactccctcaaaaagctgcttgttgggggtcataccacccaaaaagattgcaaccggcgccctgaaaacttgacatacaaaatcacccaaccaatgtgctaggtccaacaaaaaaaaaacaatcaaaacaaatcgcaaacactcaactgattgttgcatctgtagtaccaccggcctgggttgtccatgctccaggagatccactgcgccgcttttgcaccacaccggcacatcaccgctggctgataatcgaattgcccaactcacagcggattgggagcacgattggtgggatgtgacgaacccgacgatcgtttactacaagacctcgccatcgcctagctataactccaattctcgccgccgccactgccctaagctagggtttgagctgagagggagaaggggaaaatgtcgtgccaagataaccccgtctattaacgcctcaacggcgccctgacatgtagggcccacagtgcaccacgtcagcaaaatcgggcaaaaaatgagtcgatattgccatgggacctcctttgaacggtttgtgcgagtttaggggtacacatatctgattttgtggttaagggacctaaaaatattcgacgttaagttgagggacctccggtgaacttgttagcttttcaatcttctgagcccatgttttttttaagaaattcttaacccatgttggtctgggccttttgtgtgagcttattataagatagaaagcccaagcccaacagttatgcgtgccaaaatgcaagtccgggacatatgcaaatgtcagatgctgtcgactacctctccaaatgaatgtcattttagagttatgtacatgaataaagtggttaaaatgatatgtaggtattgcatattggaaataatacatatcatttatacatgaggtgatgagggtggtaacatttataattaataagggcaaattaagaaaaggtgggagacaaatgctttgaagttccataacaacctatatttagagaagaggaaaaaaaacataaaaaaacctacatttgaaaaggggtagacaggaggccctaccaatctccttgttatttcaactttttcttcagattatttgctccatgctttaaaaaaaatgctttctcaaaaaattttattctactgtatacttaaaatatttaatttatccttacaannnnnnnnnnnnnnnnnnnnnnnnnnnnnnnnnnntttaactcccaaattaatgctcccaccaatt

SEQ ID NO: 1111 - DNA, 478 bp, Oryza sativa
cagtcggtgtcagtttttttatcattggaattatcagatccagtcggccgaaggtcgttgtcctagaatctctcaactacatcaacggctatcttattggcggctttctgcgcatcgttgatgaggtcaagggcggcctcttcgctcgtcccatctgcaaagccatcaatggcgtcaatatcaatcttcgggtataaagacttggtcattgccaacgccaggcttgctcccatacttccagcttccttgatattcttaaagtatgtatccggagcaattctcagcttgtcgaaaatctcagaagcatcaaatgtactcggaccattgttattgaaaaacatggcttggatgagtggggtagcagcgttggcgacttcatccctagccccttcaagcctcttgattttgttgaccaagacattaaattgagcctaagactttattttgcgatctgcataaatagatttatatcaacgag

SEQ ID NO: 1112 - DNA, 1095 bp, Oryza sativa
  unsure (1)..(1095): unsure at all n locations
aatttccattttggtgttaagaggcatcatgtggtaactagatcctgttatttccttttttattttttttaaaacgttatgtatcttttatctggtagcaattggccctaattctctcattctctcattcgcagaagcctttgtttgaaaggctatacactgcaaccatttgtaatagaatgcggatccatgtttttcatctatagaaaatccaagctagccattctccattgccttcataatatctactgtccagaagataaagttttagatcagtagtcagagactcttagcagagacctgaaaaatatttttgaatttttttaagttatgttaacttctttgtgttcctaggatctacttctgagtattgatatgaatctccttttagtgtcaaagtgcttaaatattgatttgtttcttaatatttctttttttttatcttcattcatctgaatggcaacaggaagtatggctttaatggatgctggaatacctgtaagggaacatgtggctggtgtttctgttggtcttgtcagtgaagtggaccagacaactggagatatttctagttatcgcatattaacggatattttagtaagtatagttgcataccatttctaccatcaatccttataaataactattcctttttcatccaactgtatattttggttggtgctgaactgaacatggccattgatgtttcccagggtcttgagnnnnnnnnnnnnnnnnnnnnnnnnnnnnnnnnnnnaacaaggagaggtattactgctattcaactggatataaaacctgctggaataccgttggacataatatgtgaaagtttggaacctgcacgaaaggctcgaaatcaaatccttgaccgtatggaccaggaaataagttctgcacgtgcttttaatgatgggagctctcctcgattaggtttgttagtgcacttatagtttagttcttttaaggagttcttttttggtgcaaacattgcttgatcaacaccagaattgcccttcatttgcagctacactgagcttcagcagtgattctcttaagaaactgctttttcacaggaaaaaaattgagcaagaa

SEQ ID NO: 1113 - DNA, 585 bp, Oryza sativa
cccgatagcttaggagatgactttgcaacctttgggcgtttcttcttaggatcatttgtaacatcttgcgcatcacattcagcagcacttcgaattataactgcaggagtagaacacccaggtgtctcctcaatcatgttgtcttcgtctttgctgatggatggttcagcattagcatccttgctaggcatgttctctacagccgtccagccaacaacttcttgacttggcaaaggatcagtatgattacttgctaaatccttcttttcatgggcatggggcagggtagctttaagagaaagtttaatgttacccctcaagtcctgtccaatgcatgtcaatgagagcacttggccaacagatacaacatccgagaccttagacacctgcaggtagaagggaaaataaaatgagcactaaatacatatatattaaatacaactgattaaaagctggttaatcaacattttaaccagtatgaatgcaatgaactaatggatcacttatactgtgaaacgtgattgaacctcttcttgttgctcaagtgtgtttgggtagaacaatagtcttatatccatgggtgac

SEQ ID NO: 1114 - DNA, 1874 bp, Oryza sativa
tgtaaatgttgcacgtggtgttcttggtgtgtttcactcagtatcttacgatgttagtagttacaactatttttcttgtatggtataaaaatgtttcaattaggaatataatcatatatttgataaaaataatcatttgagattttgttttgaaaatttacttgtaaggagtataacaatgtaggagtaattagatagtatatataataaatagtttagtagaaaaatcaatttaaaatttatttatgttgcatgtcctccttcttgcatgcatggagtagaccatttattcataagagaaacaaagagatagacacgtagacaggaaagatgcatactttttgtatcgagtagtagtactagtctactgcatttagggcagtaacagtgtgccacacattttcgccgaacctcgcttgccaccaaggccaggaacggtattagctacatgctctacagtggaggtcactcatggtgggtccccccactctctctattgctctctctatccccctttacttttcactctgcttttcatcacatcgccttttctatcgcgtaggaaatgaggcgtcggcacggagcgttcccggcgatggactcggatccaagcggagctacggtggtgtttagggtggaaaataacatctgagatctcgtttgtttagagatacatatatgtgtgggcgtgccagtgtacctgaatacacaatgtaaacaaaacataggaaacatgctctttattaatcttaaaagatcataaatacaaattcccaatgtaatatatatgtatgcgcgctccataatctgtcattggacagatctgacttgtgcgatgtggtctcctggttcctggggcctcgagaagctcccagttaattacctccgcaggtctaggcctgcaagagaacctccgattaagctgcttgtggtcgtctcgtcgtcttcacttcgcattctccatgcatggttgtgatgatgatgtaaatgtgtgtgtgtgtgtgtgagcgccggcagcgatccatggcctcgtcggtccgtgcgccagtgttggtcgcccaccctccgtcgtctagccttgtcggtcttgaacaacgtgtcgatgtagattgttggtgaagacatgcatggagttgcgtagcttgaacgacttgacgtcacagcagttgcgtcgagattagattagagaagaatcagggaggaattattgaagatggttgatgtagacggtggccggatttaatcaaagctcggcatctcatttgggacaaataagaaaaaccaacaggacttcttcagcccacgcattggtttgtgcatggcactgtagcagcgatgacatgtcgtcctccgattggttggccacgttgccacaataattaacttaatcaacatgcattagctagcttgttgccatccaacagcactggctcgccgtcctcccgtcgtccttcctctgtactgcagccatacttgcctccatcgtcatccgctggtttcgacgccatgcatgatgcttgacctccggcatgagaactgatagaagtcttggcagtcggcggcagctccgccgatcctcggcgcgctccggcagggcggcttcccgacgacctcctccatggttagcccgctccagtgcggtgaagcttgcaaatcaaggatgtctggtatctcggcgaggtcgcagcttcgggtagatgcatcaccagcggcttgaattagcagcgtcgagtccagggacaagtagcactgcgtcggcttgaacagacaccggcatcgatgaagcttctgtgacgccgtaagatgaatcggccaccgcgacttccccggcgacgacgatacgtgtagaaggatccctatgcatggatgtgtgc

SEQ ID NO: 1115 - DNA, 2628 bp, Oryza sativa
atgttactacggctacacttaatctaagcctcacatcaataccatagtgcctgtgaacctcgaatattaacgattcattcgtacaaaaatcctacaaaatttctgttaagcagtggtcattatggacagatccttttttttttgtccacacgaaaattctatgaagttcagacgtttaattgtccttgatcatcaaagttatatcgaccgtccattctccgatgtactcatcctggccgtccaccgctacgagccttctccccctcgtacgcatacgcgaaacgcccccccaccgccgccgccgccgccgtattcctcctccgctcctcccttctcaagcaaaccaccggacctccctcgtctccgcatccggtccacccctcgctgctcgggtgtgcccctcgcgttgccctgtacgccggcgaggcgctatctccacctcatcgtgctgattttcccttctgtgggtgtgcaggaatcatcagaaaggaggaggaggatatgccgctgggactgatactgagctcgctcggaaggtcgatgcggcgtaagcggctgtcctcgctcggcatcctctcctccaagagggcgcctcgggattactacaaggggaagaactgcaagcccaccgggttccacacccgcaaaggtaatgccttgcgggacgctctgtgatctgattctagtcgtctgtattgctcaagcatgctctctttgtgtataatcgcatataagattgcgaccaggttttgcttagctgagaaattttgtgatttcgaaccggatagtttaattaaaccgaacgttgatggagaatgaaatggtgacagttgctagtcaccacactatttgcccaaccggaaatctggaagaacctaggaagggatgttctttatgtgaatcgttttgttccaggatttatctgagtcaaccgtgcaagtaattgtctgcttactgtaatttgggaggtgctttcaataatgtcaaatatcgcttcaataaaaggtgtgagtaaccaaagtttaataaggcattaaagatctagtgagtagcaaataacatttcaattcaacaggtccatttcaactggtggttcagccaagcagaaatttctcatggacacattgaaaaatgctctatctatcatagttacataatggtattttaatttgtatggtatataatcatcctacagaacatagtaaatcttggtgctatcatggctgcagctgtactgtggtaacgctcaagccatggcaaggtgcaaagcactattgcattggcttgcagccgcagcccacacaaccgcagcaaagagatccgaacagcctgtttgttagtctgccagaaagaaaaatattgaagagcagagtctggtggtattcagttcaccttgaaaatatgtaggcagtattcaacaaagaggcccaaacataaaatattgaagagcagagtctggtggtattcagttcaccttgaaaatatgtaggcagtattcaacaaagaagcccaaacatatctgtatgcaagtacagttttaccagtgctagatgattatgggtaacaaattacaggataacgcaaagacttatccatcagtggatatttgctcttagctataacttagccttgacctttctatgcaattcttgtttggagcacggacatgtttaaattttagttatcattgattagtttgattgttttgtgcaagggacggatacttctccattgtattcctgatttacttgatacttgattcaaatgacatttgtactaactattatatgatcattcaactgattgtcgttatctatgtccatcccttttctttcatgagtaaagcaacctacttgcttagtctaattttcgaaatattgattaattctgcaggtggatatgttatggtggatgagaagttgccaagatttgtggtccctgacttgactgatttcaaggtaattagcatactgccacggtttagtgtccactgcttctctggttaattccagtctgaacttgctgggcaaacttttaaaagtaacttaatggcacctaacaaacagaaaatagctaatataacataatcaaagctctcagttctgtttgaggtccttcttaagaaatatgatggaaataacttgccatgtccaaattttatctgaaaagatgatgacttcattccttgggcaatgagttgaatgctccataatccattactgttgaaacgtttaactcaggcaagacagataaattgatcatgaatggtataacatggaattcttctttatgtggtatgagtgaccaaggaatcatcttgttcctgttttttttcccttttcaattatggttgtgtgtatagtaataaatttcctgtataaatgactgcagttgaagccgtacgtgtcacaatgtgccagggacatcacagcgtcatcggcatcctccacttcagcagagactagtgaaaacaagaagtgatcttatggatgctctaggcattgtttgtgttttgcaagaacgcagagcatctttgcagttatgcttttcttatggtgaaaacaagaactgatcttagtgcatgtagcttcatcgtctgctgcatgttgactattatttagctacatc

SEQ ID NO: 1116 - DNA, 756 bp, Oryza sativa
ctatttttatatagattgatgggctgaataaatgtgtgatgtgtgtggagatgggcaaatgtgttcatgtgggctatatttggcattgaggagacgttcatataggctatatttggcactgagaagacgaagagactcacctggttgggctcaatcctacattccatctaacctctgaaaagcacgaggtttaagcttttggaagaagggattcgtcagtcggtaggaaaagtactaaaattgtctgggccgctgtgggcctcatgcctggctctctttaccgggcctcggcctctatatgggcctaacaggtagacatgtttgctcatctcattcgtcgcgacccctcgcctctgtatatgggcctaacaggtagacacgttcgctcatctcattcgtcgcggcccctcgcctctgaatatgggcctaataggtactccgtaggcacgttcgctcatctgatctcgccggttctctgtaaagtcaaatgctgtgcctaaagaaaagaaaaaccaggcacggcgactatctgttttgccgtttgtttgaagtttgaacagctaataaactactactccctccgtcctaatataaaggattttaagtttttgtttgtactatttgaccactcgttttattcaaaaatttttttgtaaatataaaaataaaaaattatgcttgaagtactttggataataaagtaagtcaaaaaaaataaataataattttaaatttttttgaataagacgagtggtt

SEQ ID NO: 1117 - DNA, 597 bp, Oryza sativa
tcatgcaaattaaaaccaatcaagcaatcatataaaacagagtttaacatgattatctccctacttctgcaaaattgtgacctatgctgtcctaaactccaattttgatctttcttcgtgtcattcctcttcctggactggccatagcaagacttattgccctttctgcgcccgagtgaagcgattgctggcagagctggcagcaagttacaaggctgttgaattggatgtggaaagtgagtggattatttttttttctgttattttctttcttctggttatttttattgtacatactaacatatgctaaatttcgtcttctttgctctccaatctatatacaacatattactccgccgtgctgcatctattttagatatcattggatttattgtagttgagtttagagcaaaactggttgcaataatgagtttaatcaaattgaaatgctgaaaatggctgtaaacttcactcttttgaaagaaaccggccggttatttaaagagaagaaaaaaaagagcaatgcatttgcaaaattctgacaaatagtgcataaaagagaactaaacaaccgaacagagaagaaactacagggac

SEQ ID NO: 1118 - DNA, 754 bp, Oryza sativa
attaggggcggcgggcgtggtggggccgtggccgtgcgatacgggagccgtcacgcgcgcgagctgggggccagcgaacgaacgccagggagacgcgctactgtagtagtactgtggaaacgacgacgcaagaggcggagggaggtggtgccgtggtggtgccgtgggagtgggagcgccacgcccacgtacgtgcggcggcgtccacggtggccgcgtccccgccctccgttgcggatcacgacgaaagccgcgccagcccaccgcggacgtgccaaggcggagaaaaatccagagggaaacgcggctctcacgttttcacgtagtacagaccttgatgggcagcatggcgatacggtggtggctgggctgatgagtaaaagattttgagctaccggacgagacgagtggccggtagagagcagcagctggatggggggtgttttttttttccccgtgttggcaacttgggatgcccattgccactacgccgatccggagagcgactggtcgtggacttgtggtggcggctcgtggcgccggcctagcgctttttctgtagctttgcttttcttgtttgccactggcgatgtacgtggtggcctccgggctccggcagcaaatcggcgatgctgcaaaatgggtttagcgttaacagccctgtcgtttgtttactgatctgttaccagcgctgtaattcagtaattcagcagaatggtaaacacaaccaagatttttgattgcagctctgaac

SEQ ID NO: 1119 - DNA, 1115 bp, Oryza sativa
caagagtgtcaattgatccaaaataaagttaaagagggtaccatatcagcgtaattttgtttactggatcctactgcctgtgataggcgagtcagtgttacaataattgttgattttccctgtctgtttccagcatcctctatgtttatatcaattttggggcctaatgatggcaaataactttttatgctatctccaaatggataatttcgtcctgttacggattctatcttcctagcatcagcagttgccaaactctcaaaagaatcaattccagcagtcttcagtgcctgggatgacagtgataacctcaagcattaattatgcagactgcagatacataaacataattacatacccaataaagataataaagttaataacctttgctgtgacaattccaattccaggcaattgcttcagcaaaaatggactactctcccaaagtttttggtgtaagcatttcgcaaggagcatagaacttatggcagacttgtaattctttttgtatataaaatattctctcatgcatttggcaaccctgcatccatttgagcatattgaattcatttcctgcatcaaatcgcaaaaattaaaatatgtcaaaagaataggtgacaaaatcaaatggtattttgaactggacaaacaaattacctggttgagagatagatcatggactagagggtccccagttaaacaatcatttgccagaataaatattttttcttctcttgtttgaatacgcttcttccttttcccatttgcaccaacaacatggaaccaaagccttccctctttgtcagcatttatctcattaaggagcttcttctcatttcgtcgtagttggatcccttgatattacagaaaaaaaatcaaatcgctaatttattatatttaattattaattagaataaactggagttacctacaagtaatctctgcagagtggcagatgatatgcaacagatcttccaaagtgcaacaggcagaagctttgacaataagcttcatagtatcaaatttcagatagaattttgtcatcagcctcccaggttctgagtagaaaatatatatctcagaagagtcatctttaatatgcaaatgaactgagt

SEQ ID NO: 1120 - DNA, 1421 bp, Oryza sativa
gtaatgtatttagcccaaattaatagaaagatttgctatggatcaggttggtggatactatagatggtagtgcttctattctctcctcaaaactgaattgcacaaaagccacagatattaagcaatgctagtgggcacaccatcaaaagcctactttccacaatgtaggtaggtgtgcagatgggaaacacacaaggcgtaccacaaagtgaggacacaccgttttccaactaaagccaaactattttgcagaagcgtggaattggcaaaagactaaacttcaatttgtatagcgtaagcttgtaccaatagacctgtattaatttgtatcatcatttttttaataaaaaaaatagaaaatttacctaatggttttagaaggaaaccatcttcatctgtccaaattagaccatactcccccagctcatggatcttctcaacacatatatctgtaaattgagttcataacgatcaaaatcccatagaaccatgaattctacaaaatccaagaaagatatacctttcatttgcttttcaagaagttcacgtggaatttctttcttaattccgtaatgctgaggattctggtaattcaattcgtcaaagtcagtttatgcatttaagcgaaatggatttaaagatttaataatactaatttgcccatgccttctttatcctgatgtacaaatacgagcacttgagccactcaatagccaaagttatatcagacaccgtcagctgaacaatctctgcatttagatgctcaccggcacatggaagtaacctggtcatagcatctatactcagcgagaagtttgaaatggtatgcagtccatgtcaaagtcaactaggtgaaattattagttttcagttgaacataaaacacttactgagactccaccatctcacatccatttagaaggttctcatatagatgcacctacaagatataacaggttagcacaaaagacctatagagccaattttgcccaataatggtatcaaaatatctcagagttaacaagagtggaaaatatagatcctttactgtctctcttcttgtcatgattataattgttccagtatcatcaaatggtggacgcccagcccttccacacatctgtagatcacccaaataaggggaggggcattgttagaagcaagaggaaaccatatagtataattttataattgaatcacaaaatgctctgaactacaatgctttaaatgcatgttagttttaattaaaaaaatatgatcttacacattacactataaataattgaactagtatgtggcatgaaatttgcacgtccaatttcaagtgttttgcagatataagatcaaatgatgtgttttcgtcaaagaaaaggatcaaacgatatgatgttgtggcaataagtatgtcagaatcaactttg

SEQ ID NO: 1121 - DNA, 632 bp, Oryza sativa
  unsure (1)..(632): unsure at all n locations
nnnnnnnnnnnnnnnnnnnnnnnnnnnnnnnnnnnnnnnnnnnnnnnaacagtgaaattaaatttctttacgtttataattttacagggatgttttaggtctcactgttgactgtacaaacatactgttacataattatgtattattccctttcttgttaacattgttttgcatgtttttgtttgaaataaactcttccttttatcaggtgcaattgattatccatcatttcttacgctcctgaaccagctagttcctcccttatctgtccagctgtctggccgacggtctagcatagtaaaacaggtatttgatttaacaccaattcttgaggggctgtcaaattagttcatccaaaaatatttcattttagaagtacatgtgtgttatggaattctgttagaaaaaaaaaaattcttattgaatttgcaatgactgaacaaaccttggtgaaaaaaaattgctgaccaagtttttttccaggcatgccatctactttatatgctatcaaaagaactccttggtgattttgaagcatgtgctaaaatatttattccggtaaccatagaacctgtttcagtgttttgcaacagtaagtcagtactcttatacttcctcagtagggctaacat

SEQ ID NO: 1122 - DNA, 1845 bp, Oryza sativa
ttcttgctctattgtaagtatatcctcatgaattgattcacattctcaggcagttaaatgcatcaacccacaacttagattagctaagagagctggcaaaaagaagaaagagtacaagatctcattgatttcagataaatcctatgagaaaattagaacattatcagaagcacccattgaagaagtcttcactgattcaacatacggcaaggtgattatatgttatctgtactcttccttaaaaaatatgtggaggggaaataaaatgctcgattgtgaccattttgtatgaattcaagccaccactatttgttttctatgccctgtcttttgtttgagaagcaaaatgtaacatgtttcaaactttactttttctttacaacatgaactcactgagtatttttctttctgcagtttgagcgaggagaagccttggaaaatattacacaatctgtgaaagcaaagcttgaagaagaatgcgatgaggacagcttgaagtttcttcacaaggcagttgatacagtgagaaaacaggtagtgcacactaattgctttggttaaagccttgcaaatggagggaaaaacctatttttggcaactgatggacatcaaatgcatgcatgtcggtcaacttattattgtacatatacagctaacatatatcctgattttgcaatgcgcgatggctgatgtcattattcgaccttttgcccttctgcatgaatgattttatcacatctagttttcctgcttgaatgattttatcacatccaatttaaatgcatcgaaacttacaagtttggaatgacctggtcatgctaacagaaatagcagagcacttttatttctttatgatttaacagaaattataaactttggcaagtctgtaacttatgtatccaacacattagtgtataacaaatctcattgtttagcactttaaacttagcatgccggttttgcattgagacaagcaaacttctagtcctgatgcatccttttgagccttcgtttgcttcatatgcctagatttacacaacctacataatttattggtgttgtagatcccagatgtactagctatccttgacaaaaatctgatattactttattcagtgttatgttcttatgtagagtcacttctgttatttcagttgacatggatttgtgcccatcttttgcgcaggttatacgcaaaagaataatcgagaaaggacttagagttgatggcaggcaacttgatgaagttaggccactctactgtgaatccagcacatatccaatattgcatggatatgccctgttttcacgtggggatacacaggttctctcgcacacactttaaattgaaggaacattgcaacatttgttttccagtaaagtgcccacccacatggactactttatttgtaggttttatgtacagttacccttggtgctcctggtgatgctcagcgattggattcaattgttggtcctccaacaaagcgtttcatgcttcactacagctttccaccattttcaataaatgaagttgcgaaacgtgggggcttgaatcgacgtgaagttggacatggtacattgtctagtttatgtttgtgtgcagattataggaactagtgagttaattaccctgaagtattagacaaacaactaaggtcatgtttggattgtggcctattggtacgatgagatagtctcacatgggtacgtgtactcagtaagagagtgtgttgaaaaatggagaaaggaccagtgaacaatagatagttgagtccttggcaatgggtacgtgtactcagtaagagagtgtgttaaaaatgggggtaccgagctgaattcgcc

SEQ ID NO: 1123 - DNA, 708 bp, Oryza sativa
gaacaagataaaagcaatctgaattgtaaataggagttaaatacgaatgataagttggggttccgaagaacaagcagacggacggtctagccgacacgcgcgctgcaagcaagtagcaatggctaaactttaatctatcaaaacccaataaactgtaaaggggtacctgactatttaaggaggtgggaggacgacctaaggggaccctagggtcgtgctccacctggttggggcgcaccccacatgggccccacttgggccggggtcccagacgaagttacaagcccataggcccattataggtgacgcagcaccttcttttttgatttcgcccgactgggatggaatttggcgatgaagctggatccattggaaagatgactccgagagctttccatcaagtactcatggacccaaaatggagctcgcatgcatatttggcggccgtttgaagtcgacactgtagcaggtggccgaactggattgcagaacttggacagcttgatcttgatgtgaacgacggttgtatctatagtagccatggtcacatcatcctccccttcttcacggaaaaccgtcctcggtttttccatatggtgctcttcgtgtagtccatttaaaactacctgtttcttccaatcacaacaagacaaactcgagataattttgttagcaataacatttctctctagattgcatgttttatcc

SEQ ID NO: 1124 - DNA, 562 bp, Oryza sativa
ttatgccggttccgtttttccaaacagatctcgaaaccgacaccaaacaaaaaattcaccaaggtgtatgggatggcacggtgtagattgaaccaaaaggaaaggagagggagtcggactcaaggggggaatgccgcatggaaggtggtgggactcggtgagaaatctaaaagaaggaaaccgattccttttctgcgtggcccccaaatagaaacgaaagcaatctaatctagtctaatattctccttctatcttcctcatgcgcatcttctgcttccttcttcttcacgcgcacatgcacggcaaaaacaaacacacacaaggatcggcaaactctagatgcaactcaagaactcaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaag

SEQ ID NO: 1125 - DNA, 366 bp, Oryza sativa
gtgcgcttgccgggctccgcgctggacgcgctcgcggcggacgcgcggcgcggggcggaggcgttcgacgtcgcggtgaagatcccgaccgtcatccacagtggctaccacagctacgacccccgccacgtccacctggggacgcttgtgtcgtgcatgtcgagcgggtcggggacgaccccgtcgccgcgctgaggactccgtgccatgcgtccagtacggacatcgctgcgtcatacccaaacaaggggaggacgcagcctgggggtgccagttaacgtgcgtgaatatgcaatccgcccgtcatgtggtagtgagcgaaccagtttctacgttactagaatataatagagttcagtttttttt

SEQ ID NO: 1126 - DNA, 851 bp, Oryza sativa
  unsure (1)..(851): unsure at all n locations
tnnnnnnnnnnnnnnnnnnnnnnnnnnnnnnnnnnnnnnnnnnnnnnnnnnnnnnnnnatcgcaagaaaacaaaagcagagaacatatataaaccgggcgatctcgatctcgatcatctgcaaatgcttaacaaataataacagtagtagcaatccaaagccaacgccctgcaattatatgtgcgcatatgtggatcgcccttccctttccggtcgctgggctttatccgccctcgcccatttaacaatccggcgcgcgggacacctgtcgccggctcgccgcgcgactagcgcgccgtggccgcgggcgacagcgacgccgcgcgtaaactaatcggccgcgggagcttgcccgaaatggcagccattgaacgccggaatagtttagtctccccgcgagcgcgcctcgccagaaagcaacgagccgtacgtcgacgtagcagcggacagcgcgcgcggatggtgggtgtgggtgtgggtcgtggcgtggtgtgcgacggcaaacgtcctggcagggccgtgtggcgtgtggcgagagagagggaccgaatgcgtgagccaggtgggcgcgcgggctggagcagcgcgtcgcatcgatcccactcgccgtgacagctacgccggagataaaataaaccggctgaatcgatcgcccggccgtggctaagctagccgtgtaggaccaagctacttacgggctaggctacagggctctacgtggaggcgagggggctctccggtcttgccggccagccggccaggacggcatcgtgaggctgtgacaaagatgccctttgctcggtccccggttaatttagtgaggtctaaagagaagagtaaaagaacatccc

SEQ ID NO: 1127 - DNA, 934 bp, Oryza sativa
  unsure (1)..(934): unsure at all n locations
nnnnnnnnnnnnnnnnnnnnnnnnnnnnnnnnnnnnnnnnnnnnnnnnnnnnnnncttaagcttatggagaagggcgagcaattcattcatatttcaggttttcaacaagttgcttgtactagttagttgtgctaggtatcctgtgtaaattctttcaagcctaaccttgcagcatacgcatttgaaagaaatgatttttgtataatgaaaatcgaccaaattatgaatgaaaaattatattttgttacagaaaaatgatattctgaactaaaatagtatggttatttgactctgctattacacagtataactgtttgtttgatctgataaatgcaagcacttgcagataataaatgatgaagacgggggcctgcagaaacggtatccttctccatcattgcgtgagaagggtgtccaactttctcatgcttcatctcatgcaagtggtacacatttagccggatacagcacttcagctattgttgcgatggacaagagtgcagctatttcttctgaatcatctctttcgtcaagaagtcttctgtcgcagtcaaagaaaataggtagaactgctgaaagaagcatagagagcgttctcagttcaagtaaacaaaaggtttctgccattgaaagtttattgaagggtgtaagcggccggcaaaatttctcagctatgcgctcaacaagcttggatcttggtattctttaagctgcttaattggagtttgctctttcattatgtagtttaaaattcttagctattgctttccgacttatattataaatacttaagaaatctcaatttcttttttcttttcctcctagtgcaggagttgatcctccatcctctcgtgatcctcctatcccacttgctgcaactgcttcggaccatctgtctttgcagaattccatattgctggattcatccctgcc

SEQ ID NO: 1128 - DNA, 559 bp, Oryza sativa
tgtgtaggcttgtagctatagctagctagcaatttagtaatcgttaagctatagctagtagaaagcgaggcctttatcctgtagcggagggaagctaccccagcagcagccggcgccggcggcgcagtcgatcatcatgtcgtgcaccacgtcgtcgaggttccacaggctgccccacgtggcggcgccgccgtcgagctcctcgcttgagccctcgctcgtcgaggcggcagcgccagcgctggccgccacggcgccgcactcgccgccgccgctgccgaggaggtcgtcgtaggaatagggcgacatgtctcccgggtggtagtacagcaggtcgtccatgtccggcgccatctcctgcattatctggagctcgccgtcgtgggtcagcgaggtggcggctggtggcgcgacctccgcaaggttgtcgtccaccaccgcgctggtggcgtcgtcgtcttgaccgagctgctgctgctggccggtttgcatcagctggctctgctagtgcatctcgcggcgctgcttcaggaaccgagccctcgcgcgctcgatgttc

SEQ ID NO: 1129 - DNA, 214 bp, Oryza sativa
acacgttttgccgaagagctgacgaccatgggcgttttcttcaggcgagcatcttggggccgagcctgcattgccgtacctgagccctgagctccgaggggacaagctgctcgtcggcgcgaacttcgcgtcggccggcgtcgggatcctgaatgacaccggggtgcaattcgtacgataaaaaatgctcaattcatttcacttcaattcacgg

SEQ ID NO: 1130 - DNA, 1678 bp, Oryza sativa
atattctatttgacacaacaaaactttacacccctagatctaaacacaggcttaatgtatcccatttccgttctgcaaataggtcgaacagaacatggcttttgtattgctgcaggctcttgaagttgagaccttcttgttgccttatgccgttgagtggaatgatccaaagaatcgcgagtgcatttactgaacactgctgcagtagtacccaagatgaagccatcatccgtgccttgctactgctagtctggctcttcgcgtcggagaaacgagaaaggtggagtttttcaccgtcggagaaagagcacatttgcctgtgctttgcctgcctgctgagctagtccattgtcaccgtgatttggctgtgtttagctcacgctaaaattgaaagtttggttgaaattcgaacgatgtaacgaaaaaatttaaagtttatgtgtgtaggaaagttttgatgtgatgaaaaagttagaagttttaagaaaaatttagatctaaacacggtgtttgttgaactggacacaagaaattcttccagaattagtgattcttcgtaggaccagtatcatcgtcttcatgccgtcctaaaagtgagaaaaggcttcccgatctggtgatacacgagttgaacaatcaacctgtactctttcgccgatcgattgctcctgacatgttttgggtagcagtacaataatactgcggtgatcaatgcagatctgtagctggcacagcgtcggggagattgtcgcgacgaacgcgcgatgttcgtgacggtgagttagctgcgagccacggcgctacgcaggagaaaatggtggctgcgccgtcgcgcggtgcgacccggaccgtgaaaaccgtatgtttatcatgaggattatcaaaaactaagaagattacggtacgcgataatcatgataactcacgctgttttgtaaaccactagccaatttgcacttagcattattatccaggagggcatacggatcggacgaccgatcatgacattagcgtccgatttacgtgcaaaactactttaaattgatttttctcttaaattacttatccaaatcatgatccgattgcaccattaaattcgttgcaattaaatcttcaaaacaagattacacatggatatattccgacgaaaaaagattagcttattattgaattttttataaatgttgcacgatgttccaccagctatatcggaattgtctcactaggtgattgaaaatgtttcactcgtttaaatcgggtgttgtttcaccttatataaaaacaatgtttcagcaaatagcgaaaaaatatttcagttcactgcaacattatatctatatatagtgaaacattgtgattacattaggtgaaacatttttcggtgaaacaaaaaataaaccaaattctcttaatagggggtttccaaaatatgtgggtttttttgttgcaatagaatatttcgttcactgcaacattagatctatacatagtaaaacattgtgagtacactaggtaaaatattttttatggaaaaaaataaaccaaatttcctaatagaaaggtttcccaaaatatgtgcgttttttgttgcaaaagagtatttaaattactggaacatttagatctataaatagtgacccattataaatacattaggtgaaacgtctattgtggaaaa

SEQ ID NO: 1131 - DNA, 636 bp, Oryza sativa
gcattgattggtgtgtcctgcatcgcctttttctttttctttctttctgaagactctgcatcagacatcagttctgtggaggtgaaaacagccaagaagaggcgagcatttggcttgttgtactgtaccaatgtaccgtttcatgtgctcttcgctggcgctgtgatgaaccaattgatgatcagctctaccgccttcaagttacatggagtttggtagtatacgttggtattccatggcgtgacagtgcctgtgcttttacaggagtatctcacattcagtcattcagacatattctcacccaaatgagaagctatgggagatgggaatgtgctttttacctagagaacatatttactccctccgtattaaatataaacatttctaacattcaaaatttatactgcaatataatcatttatgaggtactaattttaatacacgaaaatccatacattttcagccattcacgtacttgaggagatcatactataaaagagaatcttttttccttaacctcaatatatggtatttttcacgaacgcgcaaaatgattgcatgtcatatattagaataaaagagttatagttacatgatgcaatcagtcagaccggcttatgcaaagggaaggggaaa

SEQ ID NO: 1132 - DNA, 754 bp, Oryza sativa
agatatgtagctgtttttcaaactttctgctgagaaaatgatcagggctgccattgctctcttgtgttttgctgagtaattgtatcggtcaaaatgtgccaaatcctggaccatgtttttcattacgctatatcccacctgaaaacgtgacaattcatttggttctttgcctacaaggtcaccatagttgctgttgtgttgtagaagtattgagcctttaatatacttctttggccttggtggcgcattttccttcaccacatgttccttgcttgaacttgctaattcatacttggctctttgcttgttttcttatccatcttctcacgcttctggtcctttataataccctcctcccttgtttacctttctcatttatagaacccttcacatctgcatctcctccttatcgtcaaattcatagatttgggcatcagcagtcctaaaacctctcatccacatgttttttccttccactatggccagtacaggtgaagcaccatcagtaaaggctacagcaaagacttcaatcccttctggggtaatacagaattcctttctcttggaaccagtacccttcacaatccttctgaacctgcgcttaagttctttgcgggctttatcaattttttgggtagatgatctcaggatagcactgaagtcattagcatgagttaacttcaggtctaaagtaaatagcagttcggatggcatgtcatacactccaaatgactgttcatcacccattctgaat

SEQ ID NO: 1133 - DNA, 10158 bp, Oryza sativa
  unsure (1)..(10158): unsure at all n locations
tcgactttgagatatggcaaatgaatgtcaaaatagctttcctcaatggaaatctcgatgaggatatgtacatgacacaacccaaaggttttgttgatccacaatcaactaaaaagatatgctaattgcagaaatccattcatgggttgaagcaagcatctcggagttggaatattcgttttgatgaagtagtcaaggtgttaggctttttcaaaaacgaacaagagccttgtgtatacaagaagattagtggaagcgcactggtgtttctaatcctatatgtagatgacatattattgattgggaatgatattcctattcttgaatccgttaagacattgttgaaaaatagtttttcaatgaaagacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatgacattaatcttggcaagaatcagtgtcctcaaacgactgatgagcgaaacaagatgagtgtgattccatatgcctcggcaatcggatccatcatgtatgctatgctatgtacatgtccagatgtttcatatgcacttagtgcaacaaaccgatacccatcagatccaggtgagagtcactggatagctgtaaagaatatcttgaagtacttgagaagaactgaggatatgttcctagtctatggaggacaggaagagctcgttgtaaatggttacactgatgcaagcttccaaaccgacaaagatgattttagatcgcggtctggatttgtgttctgcctcaatggaggcgttgtgagttggaagagttccaagcaagatacagtggctgattctacaacagaagccgaatatattgccgcctctgaagcagcaaaggatgctgtttggataaagaaatttgtttcttaactaggtgtgatgactagtgcttctagccctatggacctctattcgataatagtggtgccattgcacaagccaaggaccctagatcgcatcaaaagtccaaacacattttacggcggtatcacctcattcgcaagatagtgggtagaggagatgtgaagatatgcaaaatacatacggatttgaatgttgcagatccgttgacaaagccactccctcaccctaagcatgaggcacacactagggcaatgggtataagatacattcatgattgactctagtgcaagtgggagactgttagtgatatgccctagaggcaatcatagagatgattgtatcacatactatgtttacatatttatccgacattgttccttgaaatagataactccttattggttaatgaatatgtgattctttcatgagactctttatgttgtttgttactatttctaaaggatccctgatcaaatatcatatgtggaataaatatgtttatattatcagcacatgtattaattgatgatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatccttagacctgagattatcatggttctcaacatttgtagtagcttacttagggactgctaaacgctactgcgtaattgcgtagttataaaagtagttttcgggtatgctatgaaacatgtagtgggatatgaataattaagatgggatttgcccctcctatggagagatatctctgggcccctcgatgttgtagattatggaagtgcatggccatgcgaaaggtgaatgaggagtcaatcacaagttatataatctattaacaggttcgagtgaatgattgagctattagaggatgtcacatatctagccttgagcttaatcgatatcgtgaggcaaatggattcatacaagtatacactagaggttcagccgatatgatcattatgtatgtccggtgggtcaatacgttctgctaggggccgctgttgatgtgtggaccgaaaaggagtttttggtttacagccgagtatacatgaacctacagggtcgcacgcttaatgggccggaataaggcgattggatggagatccaatataagcttaattcggatagggatccgaataggagtcctacaggccttggaggcccgagtgatggatcctatatattcgtaaggggtgcgaacgacggagatattgcatcacgtgagaaacctaagccgtcacttccctccccacacaaaaccctagccgcgcgcgggtgctagcacatctccgtgcggcgttctgtgtccctgtacgtgtggataccggtagaggcgccactggtttgcggtgctgatcggtgtgggagtacggtgaggagaacgcacgaggaggagaaggtcgagccggtgcgatcgactacttcctctacatcgacgcgcgctacttcgcgagagttccttcgactttgcagcgtcttcttccgctgcgcagcgcgtcgagtggtaacgatctatgatctaatacttgcatggttcctggtttacgcgatagaaaattttgatttatgctattgtagcctacgcgtatcccaacacaaatatccagagatatgttcgcctttgcctcctataggttttttatcagagctgtagattataaaaatgctcaaccatgatgaccgtgtctccttgcgagtgcacctattcaaaccctcgaagaagaatagaggaggagaactcatctagtctcttatatgaatgaaattgtgagctacgtaaatcactaatcaactgcgtaaatggaatcttagcagatgcgcttcaccatgccattgaccggctgacctcatcaccgcttcaatcctcgaccatgtcggcagttctccctccgatatttttctagtgaaccaattcaaaccctcgtaagaacgaagcgatgtgggagaagagaaagaaagcacaacctgatttttttcccgtgtagatatgatcgatgcctaggtagatttacattctctagcgttgtggagtttatggataccccatacctacacggcatgtatagtctgactgggtatggggtgtcatgtatagatagaatatatttaaaaggactcgggttaaattccaaacttgtatgtcaaggaaatatctgagatcctagttggttacgattgtattttatctgtaactacatattccgttagggatatggactgtattttgtaatacggactccttctcctatataaggaggggtccgggtgcctctaggggcacgattttcacccagatcatacgatcaataatacactcggcggatcaatccccggacaggagtagcgtattacttcttgattaagaaggcctgaacctgtataaaattccttgtctctaaacccatccacttttccagcttgatagccacccccttttagtattgctgaaatcttgtttcgacagttggcgcgccagctaggggtagcgtcaagttcttcgccgactagtgcgatgggtttcatttctggcatcgacgacttcgtcttccctcccgggcaggcgttccgtttcggcagcctcgacttcattaccaacgacttcggtaagatttctctcctcgactcggattcgaaccagtcgggaagaggccagatctccgctccgttcggcatcccgaactcggccatggtctaccccaagatcaactctaccgagttggcttcaaaccacttggacgagatccaatctacttcaacacgacccgatcaagacgattgggcctatccgccaatcctgatgaaactccccgatgatttggctactgtcttcaccacaagggtgtcttctccccataggcctaggcgggatccggcttcagccccggtccggcctagctccagggaagtcggcgtcatactccagccgctcggcacggtttcgacggaacaactggacggctacctcagctcccccggcgtcgactcacgaccaacagagatcgtggagtacgacaacttcggctatcgctacgacaaccgcaacctcgacgacttcgacaagggctttgaagataactacacgcctctctacttcggcatcttcatggctgacaacgagacgggggaacagcgcaaagcccgagaagcagaagagctacgcgtacaacaggaagccgaacgacgccgactggaagaggagcgccaagcacaagagcgagaacggcggcagcgtgagcaacaggaacgcgaacgggctgcaaaggaggctgaggaccgacgacaacgggccttggacgccgggcgacgagcacgagaacttatcgtgcagcaagacgtcgagggaactgcggtctttcgcacccctcaatagaacgcggttgcagcgatcaccctcctcgacaccctcctcaaggaagacgcactcaaccaagctaatcacgtcgtcaacatcttgaccctgaccaagaccatgatcgttgcctcggtcccggttaactccgcaagcgtccgcacgccgactggcagccgagttccccatcttcgatctcaagactatcaccagccgagccttcagcatcgccggcgcaggatccaatcgcaggagcaggggtcacgacgggcgatctgtccactcgcctcccgaacgacacagggagcaccgagttgaacggccacgctccccacctcgcaggcgccccgtcgatcttcgcgatacaatcaaccagtgccacgcggcacgaggctacgtcccccaccattcaccggatcacgacgacgatgtggatggagtcgctgtctaacccagagtggattggccagccggtttcaagccgactggaatcgagaagtatgacggcaccactaacccagagtcctggctcaccgtctacggtctcgcaattcacgtagcaggaggagacaacaaagccatggcaaactacttgcctgtggctctaccgaattctgcccggtcctggcttcatgggttaccccgtggcacaatcggatcatgggcggagcttcgtgaccacttcatcgccaacttccagggcacatttgaacgccctgatacacattttgatctctacaacgtcattcagaagtctggagaatcccttcgggattacatccgatgcttttctgagcaacgcaacaagatctccgacattaccgacgacgttatcatcgccgccttcaccaagggaattcgtcacgaagatctagtcggcaagttcgggcgcaagcctcccaagacggtcaaacagatgtttgaaaaagccaacgagtatgccaaagccgaagatgccattatcgcgtccaagcagtcgggcaccacttagaagccaaagaaagatacgccgactacagaagggagtggaagtgccaatcacaaggatcgcaagcgtaagcccgaggaacttgtgacaactacaacaccatccttctgacaacgttcgcgtgtcaacacttttgacaagatcatgaactcccaatgtccgcatcatcccaattccaatcatgtggcaaaagattgtttcatctacaaacagtttgcagaacaatacgccaagaacgcacgtaaggcctccgacggagatcaaagcacgtcgaagaagaaggacgatgacgatgatgccccgactggttttcaagaccatcacaaggaactcaaccacatctttggcggacccctggcttatgaatctaagagtaagcaaaagctgaccgaatgagagatcaacgctgctcagcccgatacgccccaatttctttggtggtcggagacaacaatgaagtttgaccgctccgatcatcctgaccgagtggtctacccggggcggtaccccctggtactagacctagtggttcgcaacgtcaagcttcgcagatccctcatcgatggtggcagtgcactcaacatccttttcaccaaaaccctggacgacatgcagatccctcgcacggaattaaagccgagtaatgcgccctttcacggagtcattccagggctatccgctacaccactcggccagatcactcttccggttacttttggcactcgggagaacttccgcacagaaaatgtttgcttcaaagttgctgatttcaagacagcgtatcatgccatactcagacgcccggcgttagccaagtttatggctgtcccgcactatacctacatgatgatgaagatgcctggtcctcgaggagtcatatcccttcgaagtgacatcaaacaagccgtcacatgcgacaaggaaagctgtgagatggcctagacccgcgagatcacgatcgcccgagaagaaatccgactggctgcgtccacagcaagcgaaggagaagtgcctgcaaccaagatgccaaagagtggaaaaagcgacgccaagaccaagaaaattcctctagatccctctgatcctactaagactgctgtaataggcactgagttagattgtaaataggaaagcgcgctcgtcacctttcttcaaaataataaagatatctttgcatgaaaacaatctgatatgcctagtattcctagagaggtgattgagcactctttacatgttaaggaagacgctaaaccaatcaagcaacgactccgccgcttcgcacaggataggaaggatgcgatcaaggaggaattgaccaagctgttagcagcaggcttcatcaaggaagttctccatcccgactggctggctaacccagtcttagttcggaagaagacgggacaatggcgcatgtgtgttgattacaccgacctcaacaaatcttgccccaaagatccctttgggttacctcgcattgaccaggtagttgactcaacggccgactgcgagctactcagttttttggattgctactcaggatatcatcagatccgactgaaagaatccgactgcttaaagacttcattcatcacgcccttcggggcctactgctacatcaccatgccctttggattaaagaacgcaggagcaacttatcaatgcatgatccagagatgtttttcaactcagatgagccgcaatgttgaagcttatgtggatgatgtagtcgtcaagaccaaacagaaggatgatttgatcacgtatctagaagaaacctttgcgagcatccgcgcttttaggatgaaactaaaccctgaaaagtgcatcttcagagtaccatcaaggaagctgcttggatttatggtgtctcatagaggcatacaagccaacccggggaaaatcaatgccatcctcaacatgaagccgccaagttcccagaaagatgttcaaaagctgactggttgcatggcggcgctcaactggtttgtttcgcgactcggcgagcgggggatgccctttttcaagctgttgaagaaaacagacaatttccagtggggacccgaagcacaaaaagcctttgaagacttcaaacaacttctcactactccaccagtcctagcttcaccacatccgagagccgctgttgttatatgtgtcggcgacttcccaggttgtaagcacagtcctggttgttgagcgtgaagaagaaggccatgtccaaaaagtccaacgactaatttacttcgttagcgaggttttggctaattccaagacaagatatcctcaggttcaaaagctattatatggtgttttaattactatcaagaaactatctcactactttcaaggtcactcggtcacggtggtcacatcgtttccactcggggatatacgtcataatcgcgaagcaaatgggcggatcgcaaagtgggccttataattgatgtccttggatatatctttcaagccgcgaacttcgatcaagtcccaagctttagccgacttcatcgacgagtggactgagtgccaagaagacatgcctgagaagaagatggagtattggaccatgcattttaacgggtcgaagaggctctcaaacactggagcgggggttgttctaatttccccgactggagaaagactgagctacgtattttggatacatttttctgtgtctcacaacgtgactaaggattgtgatttctttgggaatccggcgtctgatagttcatggagactctcagctggttgttaatcaagtcatgaaagagtggtcctgccttgattataacatgaccgcctaccgacaggaggtacgcaagttggaagacaaattcgacggacttgaactcacccatgttcttcgacataataatgaggcagccaacagactggctaattttggttcaaaacgagaagcagctccttccgacgtatttgttgaacatctttacgaaccaaccgtaccgaggaaagaaacaattgaagccacggacactcaagacgtaagtatgattgaagccgactggagggagcccctcataagatttttgaccaaacaaaaactctctcaagacaaagatgaagccgagcggatctctaggtacagcagactctatgtcattcatgagaccgggttgtacaagaaaagtccatcgggaatcctgcaacgctgtgtgtctttggaagagggtaggcaattgctaaaagatatacattcaggcatctgtggtaatcacgctaccgcacgaaccatcgttggcaaggcttatcggcagggttttttctggcccacagctgtggccgacgccgataaaattgtgcggacatgtgagggttgtcaatttttcgcctgacaaactcatctaccagctcaagagttgcaggccatcccgttgtcttcgccatttgcggtttaggggcttgacatggtcggcccatttaaaaaggcagtcggtggttatactcacctctttgtggctgttgacaaattttctaagtggattgaagctaaaccggtcatcactatcatggcagacaaggctagagatttcttcatcaatattgtgcaccggttcggggtacccaatcggatcatcactgttaacgacactcaatttactggcggagtatttaaagacttttgtgaagacttcggcatcaagatttgttacgcctccgtagcgcatcccatgagtaatggacaagttgaacgcgccaatgtcatggtacttcaagggataaaagcgcgagttttcgaccgactgcatccctatgccggcaagtgggtagaacagctgccatctgtactttggtccctgtgcaccactcccagtcgggccacgggccagtcgacgttttttctagtttatggagcggaagcgatgttgcccaatgaggtggaatttgaatctttacgttttcgtaacttcaacgaagagcgctacggagataactgagtagatgatctcaatcgactggaagaagcccgcgaagcagctttaattcagtcggctcggtacttgcaagggttgcgccgttatcataatcgcaatgttcaatcacgagcctttttagtcggcgacctggttctgagaaaaactacacgggatcgacacaagttatctcccttgtgggaaggaccattcataatttccgaagtcactcggccaggttcttaccgactcaagcgtgaagatggtactaccatcgacaattcttggaatatcgaacatcttcgtcaattttatgcttaggcattacttttgtatttccctctttgactgataacatcatgtttttccttgagttatcagtcgagggctactataataataatagagtatgatttttatcaattcaatttgcttacttgatttatcattgccttgtttgattttttggcttagtcaatgaggactgaaagtttttaataacttttgcgggttttaggctcaataaggtttgacaaaagcttttaagaaatcaggagctaagtttgaaatatcaagcacagcataaattcatcagtattgtacaaattgtgcctccatcatcttcatcatcagaatcattgttataatacaacatcagtcggtgtcagtttttttatcattggaattatcagatccagtcggccgaaggtcgttgtcctagaatctctcaactacatcaacggctnnnnnnnnnnnnnnnnnnnnnnnnnnnnnnnnnnnnnnnnnnnnnnnnnnnnnnn

SEQ ID NO: 1134 - DNA, 19960 bp, Oryza sativa
gggtataaagacttggtcattgccaacgccaggcttgctcccatacttccagcttccttgatattcttaaagtatgtatccggagcaattctcagcttgtcgaaaatctcagaagcatcaaatgtactcggaccattgttattgaaaaacatggcttggatgagtggggtagcagcgttggcgacttcatccctagccccttcaagcctcttgattttgttgaccaagacattaaattgagcctaagactttattttgcgatctgcataaatagatttatatcaacgagtgggcataaagaaaggaatggtttttggagtattagtcaccagtaccttcaacgtctttccgagccgagtccctttgtctcgccaattcggccttgtcattctccagagcttggatccgcttttccaattcaaatatcttggcagcttgcactgtattcttcttgttaattgatattacaaggatggtagcataagtaggttggatagaggttgtatttaccttttcatgaaccgctcagttcaaagttggagtcttgcagctcggcaatccgatcccttagatcatgctcagttttcctagcaagctctttagcttcgtgcagctggtttctggtggcctcaatggttccaagatggggaactagcctttcaagagtcgcagtcttcgcctcgttcctgagatggattctctgcaaggcgagtttgtcggcatttgtgcaaagcggcaaacaggatggttgaagctgcgtatagggagacttacgtttacgatacgagtagcttgcccgagtgcctttttcagcagacatacttcctcgtcttccttttgcttgtttatcatgattccctgaggttgcatgtcgtcatcccaccacttgacttgaatgggtgggcgagaatcttcagccgatcgtatctgaaggacctcttcttcatcaccaatcattggcccttgtatattcatgaataaaggtgaaacaatcgaagaaagcctgtcagatcaaaatgggttcagaggatgtgtttacctataataatttccggtcagggacgagcaggctcttgtactttaacaggagagctggaccctggatcagcactagtatcctttctaggagggctggccatttgagcttctacttcagggacatctttatttagttctgcacccgactggtttccagccgggggctcctgattagcaccgactctagcttcggctgactggtttccagtcaggggctcgttgctgggttctacattgtcggttgccgactgattgtcattcggatgatcttctgcagccggcccgtttcttttgaaggacccatctccatgtcagttggctcagagtcttttccagaaggatctatgtcagatggcttcctacgaatttgagttatgctatcagtgctatttcaataatgaagtgcgcatcaatacaaggataatggctaaatgatttgtacctggagaacttcctgatttttggcataggacgactggatgttttcttcttcgggttagcttgccttgttgattttccggtcaccctcttgctgccagctttttcagagtcatcattttggtcgtcactcagaaccaatttcctctttcggaagtctgattggttggccgattgagtggtgctgggttgagagtcagatcggatttttggtcctccgttagcttgactagtttgccgacggggtgagtggcgttgagcagttggggggtctgacttcatcaaggcgaattcctgggcatgatgatccaagttttccatcaactttgtagatgataaaagcatgcttttgagaaaggctgggattttaaatacatatcggtggaggggggttgaaggcattgtatggcaccactggcagcaagtgcgaatagctgactgcgattgcatttgagaagatcttatacattctctccttcataaccttgaattcaagagattcaggatcttcacggttagggtcatgtttgccgtcgaattcgaaggccgtgcgagatctttctttgattggggccagccggctcttgataaaatgccgggtgatctgttctccttgcagaccttgctccttcagcttcagcatatggtccatcagggcaagcgcctgggcggcttcttctcccattggtagtgaattccaagtgtcctgataaactggaggatgacaggagtactcagggagtgcaggctcggggttttgtacatagaaccaatttgcatgccagcctttgtttgaggttttgaagggcatggagaaatacttttggctcagagttcccctaagttgaaatccagctcccccaactacgcatggcttgcttttgttcggttggggcttgaggaagaagatgcgacggaatagggcaaaatgtggcctgatgcccaaaaaagcttcgcaggcatgtatgaagttggcaatacgaactatggagttcgggtttaggtgatgtaaactaatcccgtagaaatccaaaattccccggaagaatcttgaggttggaagagaaaatcctccatagaagaaatgagaaaataccacgacttcatgtgtgtcgggggtcgggaatgcttcgccgaatgctggacgccatccaatgatctccttcgccggaagaacaccgtgcgccaccatctccttcaggttttcctctgttacatcggagggcgcccactgacactcgaagctttctttctcttctgccatgaatacgaattggatggtgtgatttggtccaagatatggctggagatggatggggaatcgatgcggtggttgcgcggaaggtttttgtggagctcaggaggatggatcggagaggatttgttaaccctagcttccgccagtgtagtttacactgtagcagagaatggggaaaatggcgagagttttggcagggaagacgaaacgacgctctgacttcggcgtttattttgctagggtttcaggagtggtgatggacctgggcctatacagtacttcagcccaatgctattgccagcgtggctagttgtgatccttagggacttaggcatttttgctttggcaaattttgctcacaacagtatggcccaatgatgttaaaatcctttttgacgcagttagatgattccttggaattactatgatgcaaataaaaaaggtactcgacagaaaggtgttatactaattttgtaggccttattaggctgcaaaggctgtttgggttttattgggatgactggttttaatacagtcattcactcggcatgttatatgcttatttttatggtgagagtcatagcctaggctatttagactcatcacttgttgtgttatcacatttacatcacgtttgatggatctttttaagagtttttactcggattcttatcaagtgtgtgaatttatggatctttagagtgtttttcactcaggccttttcatatctccatttttggtatattaaagctaaaagcagtcggctggatgttttattgaacgccgcatatgctttactatatgatattcggttgtcaaaccactcggttgaatgtagtttgcatcttgactatatgtttagttttttaactaatcacgtagtcgggggctacacctaattatgtgcatctagtcgatgcacccggttttttctatttttagaccttcacagtctttgatttttggtactcgggagatcagggcagaagaagtcggagtactcggattatcattctgtgctacgagaagagattgtttcgtcgactgtaaaggtctcaggggctactgtggagtttatggataccccatacctacacggcatgtatagtctgactgggtatggggtgccgtgtatagatagaatgtctttaaaaggactagggttaaattctaaacttgtatgtcaaggaaatatccgagatcctagttggttacgattgtattttatctgtaactacatattccgttagggatatggactgtattttgtaatacggactccttcccctatataaggaggggtccgggtgcctctaggggcacgactttcacccatatcatataatcaataatacactcggcggatcaatccccggacaggagtagggtattacttcttgattaagaaggcctgaacctgtataaaattccttgtctctaaacccatccacttttccagcttgatagccaccccttttagtattgccgaaatcttgtttcgacaagcgtacagtaccgatcaacggagcaaggtattcaattcggcgataatggcaatatttcactagttaattactcctctaccattggttacaatatatttttattccataccttacccctctcttgatcaacggtccacattactccacctcttaataactgtaagtacatttaataatagttgcatatgtatggtacgtatttgatctagtagggtggagacgagccgatcgagccgctcagtctgtggaagcttgacacaagagaggctagttgatttgcttatgaccaccacttacaaggtaatactgctataaaaaccctcatagggaccggtcttataggtgccccttaatttaaaaccatcacctaagggccgtttctcaccgccacacgctgagaaaaataaagaacatgtacctttaagaactataggtaccggttctagaggaaaaaccggcactaaactgtaggtaacggttttctaaaattgaccgagccaagacgatcgatcagtgcgccaaccacataaaaaaactcgcccaaatcttattctctacccggcgtgctatatccctttcctcctcctccttcctacaacccccctgcctcctttatctgtcctcttcctctctgtatgcacacagtggcaatgccctcccctccgccagatccagcgggaggagaggaagtgggcggcggcagcgccccattcggcagatccggtcgtgggcggctgcagcgtcttcccctccgccagatccaacgggaggggaggtggcggcaggggcagtgggctccccactaggaggcagtggtgggagcgcagcgccctcccttctccgccggcaaggaagcagaaggtggagcaaagaagcccggtggccagccctcgccctcccctcccctccaatccccagtctcttttgtaaatgtttttgtgaattattttgttgttgagtatgttcattctgtgatgtcaatagatcatggtcacaatttaattttgatttggggatttcaatttgatttggggatggcgcggtgtcaaacgttggtgagttcggctcgattcgagctggctctctttttcttttctggctcatgctaatctataggtgccagttctaattttcgcataggtgccgtatgctaacctatgtaatgttctgtagccgtgtaattagtttatgccccatgctttgctgcaggatatgtagatgaatgcatgttatacgttataggaatgatagatgtatatgtttaaataatatgaaaatgatgtggagataataatttgacattgcttgcatattgagttctaaaaatataacaaaattgtaaatgatatgttatgttggcatgatatttaaaatattctagataataattactagtgggtgatgatgtgtcaaacttgcatgtgatttaaaatactctagataataattgctagtgggtgatgatctgtcacacttgcatgtgatttaaaatactctagataataattgctagtggatgataatgtgttacacttgcatgtggagctttagtagttagtgggcatcaactttatagtaagatatgatttgacacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaatgtcactcgccagcggtcagattcttagtggattcggggcatggcaattacaggaagattatcgagaacagaccaagtttaaagagtatgcggcatggcaatttttgtattaactagatagagtcagttagttccttttatttttaggaaatattgtttagagtctgatcaggacttgtatattttactttatctttaggaaagtttgtgtctttttccagcaaggactaatatctacccatgtgtataaatatgtacatcccgtatccttgtaatatatctctcgatcaatacaattatggcgcatcccaccctttttatttccttctttctcaacgagttcttgtttcaagttaggtttcattggcgtcgatctccgatgaggggtaaggcttgttaaggatgtttgatcggcagggctagggcctcgatactataatcttgtcgatgtaaacatctattcattatatatcttagttaatttaagtcaatgtctgaatttacctgtatcgactagatcttttctagggttttattggtattagttaaattgtttcatcgatctagattagttaaggtatccaccaccctgaaaatcagtcaaaggccttattgtttagacttaatgctgcatcaattgggtttgacctacaaagtcgtgcttagaatcataaaagctaatctgcctttgattgacaataagggtttcattggtattttagccgatgagttatatagacgttgcatcggcttacaaggattacatacaagttggttttagccaattgcaacaaaggtttcactaattatctaatcttgtggaattatttgacattgaaatatcagctgatgtatgctttaaacatcaaatcggcatttattctatcattcaatttttggtcgattggtttctattggattatattactgttttattacattgtgatcaattgattgtctttatatcattatttactcaagtatcataatctagattggacatatagccggttgctcaaaaccatatcgacatcagctggtattggcattggctagcattgctatcaacttattggccgagtggttctctgatcttcatttcatacgtcttgtcagttgcaggataaaactgattggaatgcctacatctcatcaatattttggacctgcactggagttaagcagatctcccaggctattgtgttcgttgagttagttcgcgccaatacagatctggcaccatcggccgagcgcggatttttcatcaacacatatacaacaccaacattaaattaatttaataaaataaatctactattgtatagtattcatgtttcaggttaaaatgttaattattatggttttaatagaaacttgctcaaacatggagaaatttgacttagaaaaaccaaaacatcttcattttaaaatagtggttgtactatatgacaaccattatatctagacaatttacacccactaccaaaaaaattcatttttcctgggagccaaaaccggtcctggcatgcggttggccagcacgcatgcacgaaaatgtctgcaaaaatcactattttcgcatgcgctcacccttaatgcagcacatacaataatcgatctttgcatgcaactgggttaagtggcccgcatgcaaagatcggttttcgcatgcagacaagttaggccggccgcatgctccatgaggcccattcccaaactgggcatttgggaagatcgtgtctcgtatgtaatacaacatttcccgcaatttcataatcgaaatttgaaattctacgcataggagctaaccaagttgtcattctaactacaatattgcattgacatgtaaatagtcttagaataaataacacaaaacatttatggacgtgtcatacatatattacaaataaacaacagtttcatcacgaacaaaaatattatattttcactatatatgttcttcctcccactctcctagtgggttgaatatgtcttttattgcgatttgactctccttttcgtagaatagcccaagtgcattgtaggcatcatgatgggtgaaacggcagtgctcagcgcacatgttccatataattgtgtcgtcgaaccgatttgctacgtaagggattgacgggatctatggacaaagtggacaataaatgttacaaagtaattttcgacagaataccctgtatggagtgcaatatccggacttacttcatcactgtttgttgtgtacctcttattgactctaaccatctcgcacatgtattatttacatagggaagtctgtggggttgtttaaaacactgtgaacataataataagagaccggtcaatactaacaagtaaggattctacgaaaaattgtgttaatatcatttgtcagtactgacaagcctgtcttggcgtgtagattattccttgtcggctcttttactggcccacctcttttgcggtaatacatatgtgtgttgttcgaacaaaacatttgttatagttacttagaaatttcataatagcaattatgcacatatggattattacattacttacaaaatcagaatagtgaggaactccatgaacgtttccttgtcgtagtgtgttgggtccaatgctacgaacaaatggtcctttggatatactaggaatagtatatagtgatcgctgcaaacaagaaagatgaattagagacatcaattgttaaaaaggatgtattactgcggaaaaaaaatacttagatttacgagcggctgcttatgtaaaagcataagggactgttatgacatttttgtcggcatgcactaattaacatcgctagtgccaagtatgttcctcaaggcgctaagtattgcattagcggcttgagcattcctgtgctcgttctcgtcgtcctccttcgtgggatcctcgggtttctacaaaacatagcctttttcgactattctccaaatagatgggttaatagacttcaaatgcatcttcatcttatgtttccaagcgacatagcgcgtatcgttgaagtacggagctttgccgctataggtactcacataagaagtagatgtggatggatagtcataaggaaacgtatctcccttatcaccatctttgccatcccccgtttggcccgacatgatctctccaagcagttaaggctaattaggagattaggctctgataccagttgaaagggtcaattaggcctagagggggggtgaataggctaatttaaaactttatgcagaagctaaaactgaattagggtcggaaagtttgatccacagccagactatccgaaaataatagatagtctgatgttggatcagactgtctaatctactaaagagtcacaacaagaagatctagcacacaaacaagagtatagcgcaaacagcgactagatctatagcagcacaattaagcaaagctaaagagaggatgaagagagatcaccaacgatgaagttcatggagttgttcccggagttcaaatccttgaggggattctactctccgttgaggagctcactaagagccgggtctttgctaaccctttcctcaagaggttgcactaagcactcctccttctactaaggggtatctctgtccttgcggagatgagatccggccttcacaaacttctcccggccaaccacacgcagagcggtggctcgggagtgacacctagccgtctaggagtcctcaacctccaagagtaaaagacaccacacaactcttggtcaaaccctagtgctcaagatcgagtgaaacacacactaggccctcaaacaccaaatccacaaccacatggatccaccacacaaagaacgaggagggagaaagagctcaaagatccaaagcaccttagcaccaagctcaacccaaagtgaatgagaatgaatgagttgggtaaccctagaaaagggttaggtgaggggtatttatagattcccccaaaatgtggccgttgagagagaatcttttcatcccacctcggaaagtccaaggtgacatcagatagtccgatgttttgacccccaagcaagccacagatagagaacgaaattctggagaatttcgggcaatccgatcgatcggatagtccgatgtcatatcggatattccgttatttttgaagcaagaatttcatcctcttacagagactcaagttccattgaatttcggagtctctgggtcatcggatactctgatcacatcggataatctgatttcaaaatcactcaagaggaaaaaaacaattcaaaacagagagtgaagttctgagaaatttcagatagtccgatgtatcagacaatccgaccttatatcggatagtccgatattttttcgccaacactcagaccaaagacagagagcaaagttctatgaaatttcggatagtctgagcatcggatagtccgatcaggatcggatagtctcacaagaataaaacaagaacacttcaaacaaaggattttgagcactagtgttctaccaattatatgcatgtggtatccctcttaatagtacggcatcctaatactcaagaacacaagatatacatggattagaagacgattaccacaaaacatgctgcaatgcttttaaactcaagttccactcctttttatccttgcattcatctcaacaaaaagcattagtgaacctctaattgtgttgtcattaacaccaaaacaattgaggggtcctagatgcactttcagcagtgaagcttgaactgtaggcggagagggaggagtcggcgcttgagcaggagatgcgggtgatgacctcactagagttggggaaggtggactagtgttgacgcgaaaaacacacactagcctaggagatctgcttagctctagtgtaggtccaaaggttgatgagatgcgggcgtgccagtcagtttgatcctgcaactgacaagatatgtaaacaatagatcaaagagccgatcggctggcaagccgatggagtgattccgaccgatgtcgatacaagccgatagcaatagggtttttgaactatcggctataattctgatgtagaatccgacacttgaagcaaataacaatataaaggtaatcggctgatgatagtaaaatataacaataatataatccaatagaaaccaatcggctaataatgatatgatagaataagcactgatctgaaagttaaagcatacatcggctggaggaccgatgtcattaaatccacaagattagataaacagtgaagcttttgttgcaatcggctaaatccaacttgtatgtaatccttgtaagccgatgcaatgtctagataacttatcggctagcaccccgataaaacactccctaatgatggttaaggggctcttcggacaaggtcttataaatatacctcacttcactcacttgaacgcacacttccaagcttgagctgaattataagagactctattgtactatattgtatactagaataggaagagagtagagtagaagaagttagaagaattccggagttgtcggtaatcttctctcatttctttaattctgtttattactctgatttcaatataatattctccctgagtaatttaaatttatcttgtgagaattatctcttgtttagttcctaaatagcatacaggattattgttcactataatcaactaaaatatagtgattgctttggtgagttgtaaacactaaagtagatattaattgcttagacgtggtgtttaggtaattattatacagtaattgctgtgtatcccacggtatgtttgaggtaggtgtagaggtggtgacagccctcgagatcacttaagtcctccctgtccgggtacgtagtagagcgacatctgggaacagcaggttaccagtgcccgaagtattgcattaggattaaacttaagctttccctagacattgtttctcactagtaaatcctctctatccttgcctatcctttgcttggtgtccttagatgaaccagaggaagatctgatcacacacgttcccttggattcgataccctttcgaatactccgtagggggaagtgctacatcggtatatccatgcgcttgcggatttctatctgtgactgtaagaattacctaacagtcagtcagtttgatcctgcaactgacaaggtatgtaaacagcagataaaacagccgatcggctaacaagccgatggagtaattccagccgatagccgacattagccgatgccgattctagccgatgtcgatagggttttgagcaatcggctatatgtccaacatagataatgatacaaagacaatcgactgatgataataagatataataataatataatccaatagaaaccagtcggctaataataatatgataggataagtactgatccgatggttaaaacatacatcggctaaaagtctgatgtcataaaatccaattgatttagataaacagtgaaacctttagtttgtttagtttgtctaatgtgatggatataataaatctatttataacagcattgtgattgtagagatatatcggctaagacagtagatcgggcctaaccaagacagtcccatctaaatcgatgcatctctaaacacaatgcaattagagatagaattgagatatcaggtaggcaaatatatcaaccaaaccagagcaattcaagagatcgaagtgatgtagccttgaacaacaccaatgtagctgatagattcaccagggccgacggaacgtaggacttacccctccgccagagatcgaactgaactgatgctgccccgcgtcaggtgccaaattccgccggttgataagtaaaacctcagaaaagagggtggcgatacgccgagagtagtattgattgagagatagtttacaatgacctcggtgtacatatttatgcccatcggtagatactagtccttgtaggtcaagaaagaaactttcctaaagataaaaggaaacataaagtccttattgaacactaaacacactttcctaaagataaaaggaaactaatagactattcttaattaatagataaacttgccatgacgtatcctccttgaactcggtcacttctggataagcttccctaatagatttatttccttaaccgaatatagcaagaatccgactattagcgacttgataattctcgtcggccgattccaggacaatgaagccaatactgactctaggtcgatgataacttcgggacttaccaaatttccctgttaacaggaaagtggtgttggagcaacaactgtcgttggttgcgatggagctgggtgttgacagtcgttaagtaccactttcgactgccaactagcacaattaataaagggaaattataatttcctacatgtatactaataaaaaataatgtagttgtattgcaattggagaattaacctggatgcaagaattctatatcaaagtgaaggagaaatgcggctagcattgttggtattttttacgatcacagataaatccgcaagcgtacagaataccattgtagcacttcacccatgagtattcccaaagatatcgtattaatatttccacagggaggcggcggtatgaagacatacttatatatatttaatcaatctataattaattcaccatagtctagacaggggttaggataatgatttatagggtagtagacacatacaagagattcacctctaaaagagtgcctagtagtaaatagctaaggatactatgatacaactatacttctaaactaatcatgtctagtacatacttaatatatacatgcttacaacatagaacttagttccaagcacccaagtactaccgagagaccactccctgctggtttgccagcgtggttatggcatttacgcactcttacatcaaacctagacgtggagaaatacaaaggatggacaaggttgtcaccacctgccgcctacatcactttccataggatacacccacatccaacgatatttatctagcctaaacaccacgtttatgctagtaaacaatatcactaactcccctaggactcttacccttcggaagaacaagttggagctagcgcaacctataaaggtcattggaccattaccatagcatggatcgactaccctaggatgaagtagatatacgaagtatatactactcataacaaatatactcaataaagaattatataaaatatgagcataaataaataaagaaaataattatattaattcgactatagtcttacacaaagaagagagtactagagacatattcagaactctgagaagactataggactgaggctcctaagcttatttcctactagaaactatagagaataaagtggaagagagaattgatccttgatgtgtgtgttacaaagtgaagagagctccatttatagcctctcaatagcagttgtatgacggttattggtctgctaaccatgcataaccaccatcaggagttgctgtagagtcaccatgcactacaccatgtcctaaacttagctacatcccttctgtcggcaaatgccacctctagcatcggtggcgggggcaccaagcctggttcggctgaaccctagccaccacctttgatgggaggatgacatgtgggcccctatgacggttccttgtagtttggtctgatccaaagtcggtttgcgctgacttgtggacccattaatcctcttgctcgcacgtgatccaatttttcataaaaaatttttcacattatctcacataaaaaaattcacattacgacagaaaaaatcacataaatataacatatgaaatattcacattatctcacataacaagttttcacattatatcacaaaaaaatttcacattattcacattatctcacataaaatgttttcacattatcagctaaaaatcacataaaataacacttataatcttacattttcgcaaaaactggaggacggtggaaaagaagtccccgagaccgcctacgtggaagatgacctggagaggaggattgccgccccccaggaaggaagtggaaactaaagctgcaaccaacgccgatcaagagacgaccatggggcgctcaacgaaaaggtgcgatggtcgtagagtccgacgaagaggcgacatctggcaacaaagaggtcgcagcctatggcgtgtacaaggcaacctacgcagataggaaagggacaacaaggaggcagtcagtgcggtgagcgacggggacgaggcgatgcaaggtgaggcagcgacagcggcatgggtaatttcagcagcctggcggctagggttcacgggctccaagacttggaagtcttccaagccccgcacccgcctatatagagctagatcatcgcatgcggtccacctaaggatctgcatgcgaatatgatcgttccatgtaggcggcggaaaggaccatatggaatgattattttcacatgcaactgattaagccgacatcttgcacaaagattatctttccatgcgaccacatgcgggtaccacatcaccatggaggaatatttttctacgcacgctcggatgaatctaggtcaacaacctcagtaccaaaggacatgtttctctctttgtaccgacttgtttcacatgttgggcaaccgtccaagtctgcaaattccttatggtacaatacatagtgatttagacaagcgtgaatcttttggacacctagagataatggaaatatgagtttcttcagttgatacgtgttggatgacaaaaagttaggcttaggaagcaaaactctcaagagactcatcaaatcattaaaactactatcggaccatccatgctttgccttccaagtaagtagtttaagcaccgaacgcaacactgtgatgtccttaccacatccattggattcatcgtaaagaagatcttttgatgacttctttaatgactcccaattctctaaacctcgtgctctacgtagtagtagctctggttcaatgtgccatagcatgtcctccagatcgaaaacggcctcaaaatcatcattaccggtggaaccatctacatccatcctttctcaggagacatatatatccatgattgcaaaattatgtctcatccatctggaaattgaactcttcaccgtcatcttcaggagtaggaagtccccttgatagggccaaaccttgtagttgtacatgaatccatgctccactatgtgtgccaataatttctgattcttgcaatcaaagcatggccaaaaactttgcctcatattctccttaaagcatgtgcctttgccaaggcaaaaaaatttggatgcttcattcacgaatgtcggatgagttcttcgaatctcgtacatccatgcccgatccatttatgaaaaatcaaaatcgcagtacgaataaaaatatagcacatgtatttgaaaaaaaaacatgaaaatacatgtatctcctcaaaattaatgcagcattacgattaagtagtatgtaatagcgcttacatcaacaattcgctcatcgaaacattctattcgagctagattttgcaaaaaaaaaaaaaaactcacataaaaatgagaaatttgccgcattgcactgatgaaatttaaaataaatggagataaatgaagaaggaaagcaagtgcgttaccttctatatcaaattcaagcaaagatttcgagttgatatcccccccccctttttgttgcttggtttaggagagagaaactttgagttcaaatgggtgtagcttgaggtaggtggtgatatatgggccatcattgcctgcatgtggtcggcttaagcagacgtatgggataatagtattatggtagtggctgcttaagctgaccatatgcgataatagccgcattatcgcatgcggcatcacatgcggtcccttaggaatgccgcatgcaataatgtggccaatatcgcatgcggaccgtcaaccggcccatggtggggcatgtttttataggcacagctacttataatcacctgcaacctactggggtcttatatggaaaaaacttttatgtagtagtgaccttttactacaaaatcagacaaaaaaaaactcttttaaaggcaatttaattaaaccagttttaataaaagtttttgcaaagctgacatccaaatcatttgtgtactttaattttgatacggcaaccatatactccatccaaactaaaatatatatatagctatttctcatgagtggcatatcaaagatagaataactaagaaaaacatgaataagattgaacgtacagagacatatgtacatcactagctaggactgcgcgcgggtacactgaggcgtcattttataattaagtgcctccggatcctgtgaaactataattttttaatgttttcttaagttgtcacagtgcagattaatattactaatttacatttttactgatgtagatataatagaagaaagcttgctgccggctgactttactgaaaaaaaaatcatattccgtggagtcacctcccagaccactcaagcggccggccgggttccatatcaccggccgcgcgtctccatttgctgattgccggatgtgtgttcagaaattaaacaaggttggtaattgaaaaatgtcattatagtcgtctagatttatcggtgtatttggcttcgccactctggatatgcatagagtggtattaatttaatttagcttaaaaggcagccccatgtatataaggggctaattaattatctctagatataccctaatagtatagccaactactagatccaatttatctatagccaatctaatagctcattcatacaatagttatatactacactattaatacctggtcccacctgtcatacacacactgcgtcttggagtccgtgctagaactggctacaaatctatagcccgctgctcttctttttcctcatttatctccttaaaatatgtttgcagctagcttatagcttgctattgtacctgctctaaacaacatccggaacaagtgtagccacacttataattatgttatccgagtggacttaaatatttaatgctaaatcaagaccttccaccgtggtttacgtcagtaccactagtcactcatatggacgtacacatcaaaaaacatcccttttaaatgatgagattgtcgtagaactatttttttattaagttcattttactcactaaactacatttgccacagaatttaacccggaaccctagctaactattttcaaactcgtaaagtactaaattaagttggcttactttacttcctgtgtcaatatgtttctttatttttgttactgtttgtacatgcaaacatatacgacaacataatgatccaattaagtagtagacgggctaagtgtcaccaaaacaaacataattgcctaaattttatgacgagtaacaatcaatactacaaaatcaatttttgcataagatcaaaatcgattttcgcagatgaccagacggtccacctacaccaggtgtacgtgtatgcgaaaatcccatttttttgcatgcagctagcgtaaccacatgtgagacatgtggtcacctataccgaccgcttgtgaaaataatttcaaaacaccaaatcggctaccctagaccaccaccactagtgtcatcgtgcttgccatagtctaccgccgccgttgtcaacctgctattcgtggttttaggcctgtgatgacaacggcgattttcgcagaggcctgcaatggtcttaagcggccgtccgtgatagtgcatttcgcaggcggccctataaccaatcccgaggggagtaattttttcatgcaggagcagttaatacctgcctgcaacctattgggactagggagccttgtctgcaaaaatctttttatttgatgatatctggtttatatgtatcacgctatacgatatttgtggcagaaagaatgaaaatgcacgaaaaacaccaaaaaaaatgacattgcaaaaaagatgattttagaactaacttaaggatgggtttcattatattttattttcctagagatgaacttctttaattatatactgctggatatggtagcttgatttgaacttctgctagttagtgtgacgaccaaatttggccttactttagatttggaataaatttgaagaaaatttggaaagggttaaagtcttcgtgtaaaggctggtgtgttcagaggtcagaatgggcaattaactgctatctgactgcaggtattaattcgaaatagtgagacatttgatcacaatttaggtattttcgtgtttacttgcttagaggcctgggtttttcgagtctaatacatcacagcctaataggaaatgcattaattaggctctgtttaattaacgaagttccagaaatgtttgaaccatccataaatcgttaaaattaatctattacccctacatctatctcttatttatcatttttcattcatgtcttactcgttgtctcttgcctctacactgttagagacatcttacttgcccctactgagtttaggacaaatcaacgtcgtgcacagtccctagcatatccctctcgtgcacactacttatttcttagttatgtatggtaaacaatttcaaacaaagttctttaattttgttttcgaaaaacaaaggtgatatctgttcatatgcttggcagaacaatatatattcctctatcccattcaccacttgcatgcatattagtcctggactcctagctatagaatccttcagtttagttgtgggccaaaaacaccggcgccaattagctagtcgcctatcagtgtgcacaagctgcaacaggatgtgagcggaacatatatggtcccatttatcaacttatcttgttctattattcgcaagtccaaactcaagtcactttc

SEQ ID NO: 1135 - DNA, 10658 bp, Oryza sativa
tccaccgccgccgtctgccgcggcgggagatgagggcaacggcgagcgtgatgaagatggcgaacacggtggcgaccatcgcggtgaggatccagacgcgcatcttcctatgttggccacataaaagttctatacaaatttccatgttgtgtaaggaggccacataaaagtttttatgtttttttgaaacttctagtgagataaaggttattttgggtatttttggaaagaaggctcaacccaatgttgtattatagaacaattgataaaatcgccggtatattataaaaagggacaatgtcaatggtaaattgttgaactcgaacaaactcagtggtatagaatagattttctccttttttttatacattgaatactacaggtttcggttgtggggtaagaaccggcacgtataatctctatcggtgtcgattccaaaactggcacatataccggacataggtgccaatatatcggtgtcggttgggaaaccgacacctaaggccagttcccaaccggcaactatggaggttaccgtactagtgaaattagcaaaaccaaagtgctaaattaaaattcatccacaccatcatcaaattgttagtttgatgtggttttgcaagaggacaatgaaaaggggcatcatgcatggtaccggaccaccaattttagaaaataaatattcaaattcacctgacattaaatactctctccggtttttaatagatgataccgttgactttggacatgacgtttgaccatatgtcgtattaaaaaaaataaatttgatttattttgttttgaactgtcttatcattaaagaaactttaattatgaaggtaataattttaaaagtcaatcgtgttatctattaaaaaatgaaggtaataattttattttttactgtttctttgtgtgtgtagatttcagaggttaaatgatatgaaaattttgacatatttgccctttcggaaaacttatttagactatcttagattatattgaatgacctatatatgaaaagtagagctgaatgggccggccctctagattgcttcaaacaaattaaaataccttagattatattgaatgacctatatatgtatcacctcccaaacaaactactattataaataaattgagttggattgtgaagtgatttgactaatatattaattgcaaatgtaacttcaacccaaccatccatatatagaacaacacaataataagaatgaaatggtgttcattaaaaaaagatgaaatggtacctatccccacgcaaatttttaccaattttaattacttgtggattatgagaattcatctccacaacctcctccacagctgaactggtacctcatccttttatggtttagggaaagtggcatcaagaggaccatgaccagttagggatagagtgcaatcctatatgctcaagccctaacagctctaggcttgtctctctaatccgttttaatcgtattaagaagtaatgaaaaatcgttaacacaaagcaagatcttatacgcatagcttaatttctaggaattagttctgatatatcacaccaataattacaaggattatacagacattgcacaaaagtacctaatcacttgaaaaaggcgtttataatttcaaacttcaattcaaaataacatttttgtgaactatggccagtaaacaatatcactgaaaaaaactgcagcctatttgctgtacatacacagtgaatttcccttaatcacatgagataggagtgacctaaaactaacagttaattaattaattagctaattgctccacttttagccacctttttgcacccctcttctgaccagacgaaaggtcaagctcatcatcctcgactttttttttcttctctgacacgagggcatctccagcgccgtcggctcgctgatcggatggcccaaggctccccttctcttggaatgttccaccgatgttctatggttggaggcgctgtgattccccgggccccacactacccattcccaatgacaccacccgctgggccccaccttagccgatcgccctggacacgaatccgaacagtagcagccgtcttcttcgtcgccactgtatataagctagccactacctctcccttctccttgcaccaccaccattgctgagctccaaagcttctagctgtgatcaagcaaagaagaattgaaaaaaaacatatatatattatatatatggcaggggtgtgggtgtttgaggatgggatggtgaggagggcagatagcgaggcgccgtcgaaagggctcggtgtctgtggtggaggtgggggagggaaggtgcttgtgcacgtgccgagcagcgaggtggtgacgagctacgaggttctggagaggcggctgcgggagctcgggtgggagaggtacctcaacgacccgtgcctcctccagttccaccagcgctccaccgtccacctcatctccgtgccccgcgacttctcccgcctcaagctcgtccacatgtacgacgtcgtcgtcaagacccgcaacgtcttcgaggtccgtgacgccgccaccactgcttccccgccatgatcgcatcgatgtctatgctttgatcatcatcgatatgaccttcctcgactccgggctcaggccagacacgccgccatggcgcctacaatcgtatgtgtgtattgtatgaatctcaattcaggtaatgaatgattgtatatcatatgatttgtaattctgtacaggtataacgtatgcgtatatacgtacgtgtgcgatcgatcgggtgtgtgtgatatatattaaaataagcgtggctggtttaattgcaagtgagtgtttagttatttaattatacgagagccatgagcacgtgtgtagctagctttggagtcttgtactttgtggtttggagccattgcttgactgattccgtggcacgaatcaatcatccatgcgttatgcagtgacaataaataattagttttgtcacaattaattaatagtatgttgtttgctgtattgattatttatatttccatatgattatgtgtgtgtttctcagatattgtccattcttgtcccacttcacttttctttctttgttagatggcggcgtcagctcaatttgggatcgaacctagtattgaattcatgatattgcctgctacatgctcatgagagagattgaatgacagtgacaatttcaattaatgtaaaatctaatctgatgaggggccggcttattcgatcgtaccaatcaagctagccaatagaaattgtgattctctattattaagttatttcaattcgtcatctattgtgaaaataacactgatgaatgatcatggaaatatttccatttattgtgttaaaggccaaataacaactaggaatattgaaggggtaagatttataaaaactatttattgtaattaaactaatatatccgatataacgtttggtcgcaaatgtaaattattttgatcttatactaaatcacatacacacacacacagggtcatattcgaattttttttctttttgtgatactgcatgtatcatgtatgtgatattcctaattacaaaatcaatacacaaattaaattaatacacacaaaaggataatctaaagcatttttttattaatttctggacttcgcatatagaagaacagattttgctatgcggtggcagataagagaaaatatgagctattcaagataattgcttaaacctttcgttcaaacctaactatattactctacaaactaacttagataggtaatacgtacttagcacaaaaccatgggttcatttttttttcttttgttgcaatatttgtagtagaaaatcaaggcatgacacactttgatactttcatggtctatagattccactgtccaatttcataacactgatatttttcacaatctttaagtacttatatatatatgtggatgcatatatatgtttctccttctatatatttgcattaactaatgtaatttctaacaaaagaagaaattaatatgatgttgttaatggactttctgatgctggggtatatatgagacaaggagaggctaggtctatacatctcagacattcatggaggctgcgtcatgatctctacatgcatattacatatttttctaccaccaaatacagaacatttactcacattatcactgtttagttaatgcataatttgagacagaatgcatatttgtggatatgttgcattgtcaagcacaagaggattagaaatattaatttggattctgcattatttaattatttaaatttgtatttgcataatccttgtaatagagaatcacagatttcattaggacattgagtgcaaacacaagatgaatctgccccttattcgccacagtaattgtcaatctactaaaatcttttttttaacgactcgcacaagacggtgcgaagttctattgatagagcaggagaaaaattacaaaattacaaccctggaaggtcgtaaccaggaaaaggaaaaaaagtatatcaccaccacaaaccgacagcgccaacacacaaaaccagaagaaggctagcaccagcccgacgctaatcgtgactgaccgccgctaggccaacaaagaaacacagccgagatcatccaaaaacccaaccctcacaatcaacacaaggtctcgctctatccaaatcttaagagttagggagagagggtgagagaaaagaatgcaacttctctccccccctaggccctccgacgtggccaacttgtagagactaggacaccgccacaagaggatgaaatctagagtgagcttgcaccaattggttggaggatttcggctaggggatgcgtaaacgatgtcaccaaggagagaagcgacgaaaaaaccgtcgccaccgtctgtcaagatcacagagaggaccgagactaggctttcgcccggcatccacacatgagggatgagtcggcacgacaacgccctcacgagggcaatgatgcttcgagcatgccgggctgggttttcacccgccgctcaccacctccgagtccacgactggcgccccaaagctccaccaccgtacaacttctgctgacatgtgggaccactgcaccgataccccccgccggctagccttagtgcgccgcagaccacaccgcacccaccggcagttcctccacctcgcaccttgcccgcttccgtcactgccggtcgcgcctcgtcgcgccatgctggcctcctccgccgctgcccgcgcctcctcgcgccaagccggcctctcgccgccggccgcgcctcctcgcgtcgtgccggcctccgctgccaccggccgcgcctctacgcgccgatctggcctacgagcactcctcctgctactcccacgccagccaaatgcggtcgtctgccacacctccccggctatccacccatggccgtcaatgcctcgatctccaccggccgacgctcccgcctccgcatccgccaccgtcaccagctgccaccgccgccaccaccacggcggctacatcgccatcttccagcagcagcgaaccgccgccgccgtcagccacagcagccgccaccacggctgctgcctcgccgaccgccagcagcatccagccgccgccgtcactgccaccgtcggcagccgccgccagccatgacctccgcgtcgtccagatctgaccagaggcgtcgccaccaccatcaccgccaactactacaccgccagcgccaccaccggctttggcggcaccccactgcctcacatcgtcagccgcacctccgtgcgtggctaggggagccagctccggccgcaccacccactaggtcgtcgccgcccctgacccgtcgccaaacaccgccgccgagcgctccatgtcaccgccacccctgacacgccgccgaaccccccccccccctcccgggcctgccaggtcgccaccgcccgtcgctgagctctccgccgccgggagcatcagatccagccatggggaaccagatccaggctccatggcactggatctggacgccgtcagaccgtcggtcgcttctcctcggtgccggcaccataccctaagctccagtcttgctggtgtcccgatcgtcttgaccgcgagcgagagagagagccccgccgctgctgtccttgcagccgcctagctttgccggcggcggctcgggcggcggtgaggctttggaggggagaagaagggcgggggcggtgcagcttgttcgcctcccgcgtcgccccgggacagagtgaccgggcgtgaatgtttttcctcaaatctactaaattctgaagtcacacatttttttctgggaattctgaagtcaactcatttgacgattgtgatcagaatgtacagtaatattgagtacgcttgtaaacattttatttagtgttgtggcaagggaacatgtaaaccagtagatccattacctatagaaaagtgtacgggagatcgaaacaaataaaaaactactacctagcaaattgtactgtacatatactagagcttgttgatgagaatttcgaaatgaactgttttgggaaaaagaaaacagaaaggactcaattttcgctttagacactaaccaaaacgcccattgagattgacaaagacagctagctcgaacaacgttttgcgttatgtggctagaatatattagctgactaggataattggacggcgcttggggcatgcttcaaaatcataggatagtgacactagtgacttttttcccaagttgttgcagtgatataaagcgctttaattttcttttcaatatacattaagcaaatgagacatatttagtattgaattaactgaaattttgattcttctgcaattttctttttgcatatatagtgactacaattcttttagaagtgttggtactttgtgatacctccttaaatatgtgccacaaaagttttatttatctgaatttaaaatattccgtctttatgaagaaaaaataatgcctcttgtgaatccattccatatcataatatgtaacaaaattgcacaacatttgctatgttcttattgtctaacaaggagcatatattgaagtcatatgaaataagcagtttgaggagacattcctgtagctacaagaaattaaattagcaccctccactgcaatgggtgtaatatattgtcaaggtacttccaatgctaagcatcaacagttgatgctaattaattaaggtgccataggatcaaaggaatccaaacgtgacaaaataaacttatacgtacgtgagatatacgacatgggaaacatggtatgtctggctttaaattcttaaaagcagctgattaaaatcaagagaatcaatagaatctagaaaaaaatagcttaaaaaaatgagggagctttttgttctataactacagattcggtttctcagaatataaaatataactacagattcggtttctaaatgctactaaaactgatttttgcatttggccggccgcgggtccttaacccgaccgcatgcaaaaacaaaaatatcaccaaaaaaatcaaaaaacccaaaatgcccaccgccggcatcagccagatccatgcggcggcgccgccgccatcgcttgccctcgtcctcgtccttatgagactcatctgtgaaaatcgatttttcatacgggtctcttaaggagtcgtatgcgaaaatggaagctgatttcacagccgctgtcacttacggtccatctataatttaagtagtgtattgatatctacagcacacccattagccaaatatgtataatcacagccataaatacaattgcgcatgaggacccattatgtatgtgcacaattccagtgtgaaccttatatctggcttgagcaaagacgactaattaagcatgtttctctaattatatttgtaaggtgaagcaaagccagcagaaattctctaattatacaaagttgaagcaatatttataacaccaaattaattgtattaaatccatcggttaaataattttgtaatatattttttgtgctacaaattaatactactatattttttcataaacaggtcaaattaatttaattaaaagagtttgatttaagataaatttaaaattgcttgcagggagtatcatatgtgtttgattggatctgtgtgaaggtgcggtgcatgataccataccatgagagcgagacggcaatttcaaatcgttctctcttactcactaaatccagaatccagctagctaaggcactgatgacacacaggacatgcatgcatgtgtagcacgccatatatacatgtgtccatgtgcagtgttcgtcgtgtatttaaatatatcttcttaatttgttgttattaccatcttaattacttgttcattagctcaattaatactcgcacacagtaatattacatgtctgttcatgcagtgctagtctcccaggctcccagcagtgcatggtcacataccccacttgagactctacttgtatggaccagcatgcataggaggctagctacacttaggtcattccgaacccaaaacactagacatgattttcataaactccacattatcaagaaactagtattagaaaccactcttccaatgcaaacactactattccatatttaaatttaatgctccttatctcacatgatatcttggatgttgtgtagaaaccatatctcatacaagacatggtttccttctctttcctcatttattcatttgccatatcattttttatttcaggtggcaccttatttaatatttaatgctatggacactatcttaatcattgggttagaaatggccttagtagaagccaggtgtgtggatttcagtaagctaaagcacatgggaagttgcacaatatgcatattatctatgtcttgtggtccattcgattcactagcttaattagcacatatagccttggggatccattgccataaaaagggtcatctctgactgtacgtactgcgagctagaaaagtatcgacgaccaaattaatttgatatgattctaaattaatttggaatgaatttgggcaaaattaaccatcttaatattcagtacaaatctgaacatctagagtactagaggaggcgctgaacctaaatcagctgaagtaatctgttttttattccaagattaaaatctgaatggaattctggaaagtttccgaattcgtttccgtttccaagaaaaaaaatctgaattcatttatgctttcaaaagtttctagaaaaattccaaccaatttttttgtgcttctgaaagtacgtttggaaatcggtaactttccgaaccattttcattcctacgtgtgtcccctcccgtctccacaccacacagcttgcctccataccaccaccatggatcgcgctcctatgacgtaaagtcaaagggactttgtcactgacatatgggtcccacatgtccttgtgggtcccacatatcagtgacaaagtccttctgactttacgtcatagaagactcatcccgccaccataggtgcacatgaggcatccccgttccatgttgcggaccactccccgcttgggttggcgttcaaacaaacactagagattcatgtttgtgtactaatgtctagcattccatccgttcccagatatgatacagcatctgctttttaatatacaacatcattgattttttaacaacgtttaacgattcatcttattcaatttttttttaaatataaaacaaattaaatcatgctagaagaacatttaatgttgaattaagtcacataaataaatgataattacataatttttttcagatgaatagtcaaacgtatctcaaaaaatcaatggtgtcatatattaaaaaacggagggagtaacttccaatatttaggtcctaaattttcttcacctgcattatcattctaacccatcacaacctttcatattttattttccccactacttactcttctctaccaatcacaatgtttcctccatttttttcatctagttattttacacctatatccaatactaaattatactccattcatttcatatatactataagtcatttgattttttccttaatcaaagttatttaagttttacaaagcttataaacaaatatactcaatgcaacacaaacatattatcaaaattatatttaatgttagatttaatgaaactaattagttgttgtagatgttattaatttttttaaaaaattaatttggtcaaacctaaagaactttgacaaaaaaaaatcaaaccacttataatttgaaactgatgtattattttgtgagggccacatgcgtaaaaatactcgcatcctatgatcattctccctagattaacctgaatatcaatggatgacaaactaatcaatcatattatccctccgtttgacaatataagttattatagcatttttcacattcatattgatactaatgaatctatcgtgcaccgaattgtatccgcttagttttccgcaagatatcacgggggattccataaggataacgccttgacgagaccatggcatcctctccacccaggtgtccgccgcacgccacgcccggcgcgagagcgcacacagacacgcccgcccgccaccgtacaaaacggtcgccgtcccagccgaaacc

SEQ ID NO: 1136 - DNA, 1003 bp, Oryza sativa
gctagctcgctctcgccgcacgtgaagtgccagcgtcggcggcccacggccacgtgaggcgccaccgccgggggcgacaaggtcacgcgcgcgcgcgcgcggcacgtcgccgtccgcacgccgtggcgcgggccgcgcctcccgtctcgtgtcccccgccccgtgcgcggggcgcacgcgcacgcgcacgcgacgacggcgaccgcgtctacagggccctacgggatacggacgcgcgcgccgtcgccgtcgtgatcgcgaacacacgaccccgcgcgcggacgccggccgtcgccaccgcacgtacgctcgtgcgatgacgtcacactgatcgagcactggaggcgtccagttcgtgcgctagccacgtcgccgccagctggatgtgtattttagctgtccttctcctggcatgatttctctcaccgctgtttatacattgatgggggagtttcgtgctaggaatagattcggaccaacttgtagaaaaatataatggagaaaaaggtttactatagatatccacgtcaatacaggtaaacattaataaaaatacgtttttttacacctattaaattatatatctaaactccatccatacacagggccaaaaaaagcacattcagatgtgataaaaaataatcagtgatctctatttgtttttgcagcgattgaagaataaatgtatataagtgttgagtactccctccatcccataataaggcatgattaaacttggcgcagtcttcaaaactaatatttaacttataatttctcatataatataaagttattgcaacaaaattataaccatcttaaagtaaatttaaatgtcaattcaattaattttagcaaataaaatttaatttatattataataattgttgatcaaatgtttttaatgttgaatcttggaatgtgtgcaaggcttatattatgggatagagggaatagtacatatcgaatgtgcagacaccaaattcacactcacatcaatactgag

SEQ ID NO: 1137 - DNA, 417 bp, Oryza sativa
acccctccacggttgtaccaggccagatgcagtttgggtagttggtcacctggttctgcgaggagaggcggactgtgaggttgaacaccgggtccagcgtcgggtggtcgagatcgaggccggagacggccgcgatcgaggcggagtaaaccagatccctggtggacacagctatgaggtaaaacaacccgccgacagcgaggccaacgaacaggagtacgatggcagtgctcacgacacggcaccagtttacaccatggcaaccgcaccgccggcgatgacggggagaccaatggtctgccggcgacgcttccatctgaatcgtcgtcgcagctggcatgcttaattcgttttccgcgcgccctggaagatcgatacgacttggtcagttttatgcggagttttgtgaacgtttga

SEQ ID NO: 1138 - DNA, 596 bp, Oryza sativa
gagtaattaagatcaatggtgatcacctggaggtagggcttgaggatggaccagccggtgccgatgaggatgatgacggtgaagagcaggacgcgcttgaagaagccgaagacgtagaacgccacgtcccagccgtgcggcgtgccggtgcgctccacgtaccacgagtcctccgccgcgcacgccatcttgagcgccttgaacagcagcagcgcgcccatgacggcgtggatccgctccaccgtcgcgcggtgccgcacgcacacgcacgcccacagcgccaggaacgcgaagtacacctccgacacgaccgtgtagatggtcggcagcggccgcaggcccacgggtaggtagtccctgggcccgtcggagatgccgtcccgcacgttgtacatctcggtgtacacgtcgacggtgacctccacgccgtcctggcagttgctgaacacgacggcgtactggtctgggtcgtcgatgctcacggtggtggtgaacgccccgggcgggacgtcgccgagccggagcaccgggagggcgtactcgctcgtcagcacgcagtaactgcccccgccgtcgtcgccgttgtcccccgggtc

SEQ ID NO: 1139 - DNA, 347 bp, Oryza sativa
catctactaaagcaatcttaatccttaattataagagcaaaccaaatactaagcagacaaagctgaactgaccttggtatgagcagttgcagaggaggcggagcacctcccgtgagctacttgggtcgctgtcgcagagcagaatcctcaccttgctccggtccacgaactgctgcccttcccctaccggcggcccgccgacaacgcgatccccctcgccggcgcccaccataccccgacccgtacggattccccccctagccacttgtcaccagctgccgacgcgtccgaatcagcacgaacagcacagcagccagcagcagctgccggcgcctagactagacgac

SEQ ID NO: 1140 - DNA, 647 bp, Oryza sativa
cacatcaaagataacaaaatcacatatactttcatgaagcaaaactgaataatattattgcatatcaacaatgatggatttactggcggaaatgagacatgatagtatgtatacctgaagaaccatggatctctcatattctacatacagacccttctctttgttgctgaaaaatagaatgaatatcagagaaaaatcattaagatgatagaggctaactcaatcactgaatatttaaaatgaactcacaaaaattgtgttgactttatcaccactgtgtgagcaggtaagttgatcccatgtgccaaagtattcggcgtgcaaagaatttgaatatcacccttcaagaaaagtccctcaacgacactcctatcctttaggcaaagaccaccgttgtgataaccaactgaaaagttgaaataagatatgcatcaccaatcagtgtaatgttaggcaacacatcaaaacatgggaaaccattgtaggttgtgaaggtatcgtggggcgagaacaagattcaacatgacctccatgtacgagacaagcctgcaaatgcttgtcgctacaggttagtgcagcctcctttagatgttcatactgctgcatcgatttcataaatggatttgaatagcctagagaactcgcag

SEQ ID NO: 1141 - DNA, 405 bp, Oryza sativa
  unsure (1)..(405): unsure at all n locations
nnnnnnnnnnnnnnnnnnnnnnnnnnnnnnnnnnnnnnnnnnnnnnnnnnnnnnnnnttatggtctgcctacaacttagaggggttctcgttaggtaaaatcgattttgtagtagtgccacccccggcaacggcggtctcggatgagagcggcgatggtgggtccagcgggcaagggcggcagtctcaagcgagagctcgggtggtggcggtggcttgcaaccatgcgaatcccgtcgacggcggcaacagtagtgccggatccagcaccttctccccctcccgtgctgacctcgccgcctctccaatgacgatgacggtggcagcagcagcgacgatagtggatccaggcacgatgacgacgatagtcgatccaggcgtcgcatcggtgatacattctagggtt

SEQ ID NO: 1142 - DNA, 20953 bp, Oryza sativa
  unsure (1)..(20953): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgggtttcattttattgtataatttggttaattcatttctcatagttatgcaatggcttagtttttgttatacaaggattccatatattagagacatacggtgtgactcggcaaatttagcgattaatcaaattaacatgtttgtatgatactgcataaaagattatgcaatctaattattttttctacgacttggtcatgtctatattcaaattcgtagaaaaaaattactatattttgatgacacattagtagatattcatagatgacagcagacaagatatttatgcagtgatgcgcgcccataaggcatggaagtttctagacagttggtgtatgagccgtgctatagctaggatggtgcaaaccaagatgtgcatggtcataatacgttggagtcttgttgcgacgtgctagatgggctacggttatcataacgaggtcagatagtagcaatgatatgtctgtgtcctgttgtattttctgtttcatttgttatttaccacggtgaagaacccatttctcaaaacctcctcgaccaagctagcactacccaaaaaagaggtaagcaatgccggttggaaaactctctaccagtcttcccaaccggtactcaataagcggcacaacagtattaactcactactactacgtcaacgatttattcgtatagtcaaaatcaattttgcagcgggtgggtggttcacctacacccaggtgtctgtgaaagtatcaaaattttgtatacgggtagggcattcacatatgggcacttaagccatccaactgctaaaaaaaaaaaaaaaaaaaaaaaaaaaatttcaaaaccctagaatgtatcaccgatgcgacgcctggatcgactatcgtcgtcatcgtgcctggatccactatcgtcgctgctgctgccaccgtcatcgtcattggagaggcggcgaggtcagcacgggagggggaggaggtgctggatccggcactactgttgccgccgtcgacgggattcgcatggttgcaagccaccgccaccacccgagctctcgcttgagactgccgcccttgcccgctggacccaccatcgccgctctcatccgagaccgccgttgccgggggtggcactactacaaaatcgattttacctaacgagaacccctctaagttgtaggcagaccataattgccctcacatgcaaagatcgctcccctgaggacgcttcaaggaccgcatgcagaaatcaattttcgcgggcgggcatcttaacatgcctaactgcgaaatagacatatttttgcgggcaggcctgttaagaggcccacctaccactagccctccaggtcgagctcctccttaaaatgcataagtcctttcctcatcctcgtcctctactatcctctcctccacttcctttcttcttcaccttatctccctcacctcagcctcctctatctctctctcggcagaagctcggcgtcgacgacagtgcgatgtagaggtgagttcagcagtgaggcacatgttaatgttggtgacaggggtgaccatcggcctcgatggatctaccgttactggtgataggagggtcagatatgcctccactagcctcagatgagcagcaggcctccctagcttctccatttccatcatcgatctagcggatgcggcctcaagaggtgcggatccactgccgttgaactcgggaggggctggcctccctcgcctctccttctccatcgtccatccggcggcggcggcctcaagagggccagatccaccaccggcgcccttgggagcttcatatgcatccagtcaagctggggacggtgggagcagaggcaacgagttcggttgcgatggcgacaatgacgatggcaagtaggacgtcgctgagcagcaaagaccagtccatccactccagcgagggaagcagagaagcgtgctttagtctgtggtgacgttgatagtgacaccgacgacagcagtatggttgggttggctagggtttctagattttgatattttcggaatttttttgccaaattttgttttttgcaaaattcattttcgcatgcggttcagctaggcgcctcgaaaattactaatcttcatagacatctacgagtgggtgagcgctttgcttgcctgcaaaaatgtgttttgactatttggaaaaagggtatatgtagtagtgtggggagaggagagggagagatgccggacttgagtggaggggagacttgaagtgggggagagagagagagaggggaggggagaaaaaagagtgccaagagagaggggtatttttttgatgagggtggacctgttaagacacccggatgcgaaaattgattttcgtaagctgtccttgaacgatccgagggggagcgatttttgcatacggtgataattatagtctgcctacaacctaaaagcggtctcatctgaaaaattgattcggtagtagtgagtaaatcggcacatatgtgatttctgtgagaaaaggtaaattttatagaattatatctaagttactgttggtatttcttaacgacattactagaaatattcattctcagcaatggcgccagaaattgtcctggtatatttatggttacagaagtaatccgcaagcgcacggatataccattgtagcattttacccggaagtattccacggtattgtatttttaatcccaagggaagataataagagtggactatgctaatacactttatacatatgttacttgtaattgtcaaagcctaagcaggggttaattttcatataggggtagaatgacacgaagcaaagctaatcaaatcctcataataaagtaattctaactaagtggaagaagaattagaaagcattcaattcctatacttctagtatacactcaaatcctagtttacatctgctagtatacaatcgtgtggccaataccccctaacagtgccctcctggtacttcgagagaccaccccgggttgctgagttccttacgacaacctatcatgaccgtccaaccggggctaaatacggaggagtaccctccccagaaatttgtcttaggaatatgtactaacgtggaggaatacctgtactgagcaaacacgatttgagtagattgaacctatcttgttcgcttcagcagggtcttgtttggcccaagccaatgacggttactaccgacctcccaatgacggttgtaccggttttggtgcccccaaccgtcattctcaagctataataggacctcccctccttcattttaacacacaccaagaaggattcaagaagaaaaagttctcttagtttactcactttgctctagtgctagtaggattagaattagaatagtcttccttagttcttcgagtctccggagaattcgggtatggcccttgtaagactttatccagtaataaaatattcttctttatatagttttggtccttgttggtatttcttaacgacattactagaaatatgaattcccagcaatgacgccagaaatggtcctagtatatatatggttatagaaggaatcggcaagcgcacggatataccattgtagcatttcacctgggagtattccaaggtatcgtatttatttaatgccaagggaacattgtaagagagaactatgctaataatgtatatatgctacttgtatgatcagagtctaagcaggggttgatatattcataacggtagagtgacacgaagcaaagaactcatatctctcattaaacaatcctacactatgtggaagaagaaatagaaaagcaatcaattcctatacttctatacactcaatcttagtttacatctgctagtatacaactatgtagccaataccccctaacagtgccctcctggtgtttcgagagaccaccccgggttgccgagttccttacgacaacctatcatgaccgtccaaccggggctaaatacggagtagtaccctccccaggaatttctcttaggaatatgtactaacgtggaggaatacctgcattgagctgtcaccatcagaggcccacctctactatcccgcagcatatatccctaattaatgatatttaataatctaagtaccgtgcttacattactaaatactactctacacccgtgcacatgacatagaaactgataaatcagacattaaacccgcaccattgcacctctctggatggctacccacaaaatcggtacaacacagatataaggtaagaacagtactcagactaaacaaagtaccgaagatatataaagaagaatatttcattaaaattgaaagtattacagaaaagaatacaagagctgctagagccataccgaaactctttcgaagactccgaggactccgaatactattctattctactccacttagcactaaaatactaatactaaagtatgaagaggaatttgagctaacttgagtgtgttgagagagtgaatgagctcctccttttatagggccggtatgacggttgtaccaatgcgaattgtgcattttaccctcacaaccgtcattaagagtgcatccggatcgtacacgtggagggccaggctgattgggcaccgccagttcggccgaaacctgggctagcccaacaggcctccagcttcggtacagtctttgacaggtgggtcctattgacggttttgtagttaaggcggtttccaggacggttacacctggcttctgagccctctcatccataagcttgcttaggagtgaggttttctccactttctctttattttatttgataaattcctgcaacatattgttctccaagtataagtggaactatattatttgaaaacaaatatgcattgtaagcatagctaattctccattattttagttatattgacggtcaaaatttgtctgtaacgactgtcaacagttacacaaaatcatagggattttggtgcacgacacaaatccacatcattaaccaattttcacgaaaccacatcattaaccaattttacatactcctcaaaattttaaaatgatttagttacatccatgtaaaatttctatgatggattaaaaaaactcataaatttatcaatttaagatgtaattgtagaactcaaaaggatagatcaaagtaaaatgatcaatagtttggttttgtgcaacttagatcacagtacctagggttaagtgagatttacttttaaaagaacacattaagccagtgttggtatttcttaatgtcacagataaaatctgcaagtgcacggaagataccgatgcagcacttcaactggcagtattccaaggtatctatttccatagggaacgtgtgtgttcagttcctcttcaggttcatccaaggacacaaagaaaatgtaggcaaagggtagagatgatttcctagtgagaaacggtgtctacagaaagctcagtttaatcctaatgcgatacttcaggcactggccagctcgctactcccaaatgtcactctactacatacccgtacatggaggactttagtgtacttgagggctatcaccacctctacaccgatctcaaacctactgtgggatacgaaggaatcaccggaaattaattacccagatactgcgtctattcaattaataactactttagtgctagctaaattctaaagcgatcacaataaattaatggactttagtgaacaatgatcccgcatgctaattagaaaataaccaagaattattcacatgaagtaaatcttaattactcaggaagataattctattaaaccagagtaattaacaatgtacaaaaagtaagaggagattaccgacaactccagaactcgtccgatttcttctaccatactctccctattctatgtgtaaaataaatcatacaaagagcctcttataattcagctcaagctacatcttggtgtgagttggaatgaaggatgaggagtggtatttattggtggaggtgccttcggagtgtggagaccctccatggaatcatatgagcatcttcactctcctcaagccaagcgtctatttggatgacagttggagagccgaaaacggtagaaacccacattggggagcggttgctaccgaactcaacttgggcctgggctagtggcctctgtcagggttgggctgaaccctggccggctccgttggccccgtttttcctcctgagcactaatattgggtacctcattctattggtacggtggttgggcccatttggaggtgtttaattgggtttttggtccgaaactccataagtttgaatatgagtttgattctcctccttcatgtatatttcttctcaacttaggtagtttgtcacctacatctaaatatacaccaacactcgtggaaattattagaaatatatcctaccactattttggatattttatactttcagatattttatactttcagttttatgtaggtattgacggcgagaatttggtatttaacagccgtcaacagccagttcactgcttcgtgccggaatttcaattgttcatccacaaattaacacatcacagattcaatttctatcaagcctaaaattttactaaaattagaagaattatcatctttgcatggctgatctaaacttaaaaatttatcagtcatgaagcgaggcttttggttgttcccctgacgcgccctgaactaagctccctttcttttgcgatccatctggttgcgctgatcctcctgacaaatcaacttgtcaaatagcttctcaaaatcagtataatctccatagatgacctggttggttagttcatcattaagaccaaacataaacttctcttgcctcacggcatcggtgcgcacatcaacaggagagtagcgtgtgaggcgatgtttgtagatccttaagtgtcaaatccgactgccaattcctgcaagaaagaaaattaaagaatataaaattgaatactaaacttagaggtagtggatattactaactagttccacaagtcttggtgaatatttgtatgcatgtgaattatggaggaaaaccgtctgacatgcgatgaaatatactaatcagacgtgaatacacagattggatggcccaaaaatcagagtaaaaccaacatatttaaggccatccaccgtacaccatcatgaagacccactaggcagtgacccaggtgcaaggtggcacgaggcggctcgactaggtttggccgaactagggatggctgttgatatttcttaacaacattactaggaacttagtcccaagcaatgttgtcagaaatattaaacggtaatcgtatgggttaaagaaataattccgcaagcacatggatataccgctatagcatttcacccggaagtacgtccaagatatcgtatttatttaatcccaagggaagatatggtaggatagtaatatgctataaattcttatcatacttatgtagatcaaagtcttatgcagggattaatcaattgaggataaggatagatttgacacataaaaggttcagtttagaatactctcactaaattataagtctaggctaaatagagaagaaattagaacaacatcatttatgcacttctagtatatagtcatttagtatacacttactattgtacaactctgtggctaataactccctaactatgccccccctggtatatcgagaaaccgccccatattgtcgggttccttacgacaatccgtcatggctatccaaccggttaaagatacggaggagtacccacagcaagaacctctcttagccctacctacgcacgtggaggaatacccatactgagctgtcaccatcagcggcctacctctacagatccgtggcatatagcaccacttaatgatatctaataatctaagcaccacgcttacaatactaaatattactctacatctctacagatgacatagagcaactatataaatagacacttagacaatactattgcatatctctggtaagctaactacatatttaatacgagacaagtatgagctaaagttcgtactcgaataattatgcaagtatagtaaaggaccaaaactagataaagaaaagtatttcattatcggataaagtcttacaagagagggaacagatactagatccatacccgaaatctccggaagacttgaagaactagagaagactattataattctaatttctactagcactggagcaaagtaagtaaactagagagcttcttcacctgaatcattcatggtgtgtgttgaaatggaggaggtgaggaccttttatagctgatcaatgacggttaggagcgacaataccggtcacaaccactatagaaaagtcagtagtaccgtaatagccggttgtggctgggccgggacatgccggggtcagcagaacctagaggtccgccgacccctggccagcccccctggctgtggacttcctcttgggccctgacattttactccttggcccagtggcatggtggttgggcccatttgaagatgttctaatgagtttgtggatccatccatccatgtctgccacatgttgggctctgattggttgaacggtgaatttccatcatttctccatttatgaagtaatctactgtattcaaatactttgccaagtacaagtggacttggattatttctaagtaaatatgcatccaagcattgctagttctccattatttccggaagtattaacggtcgaaattggtctataatgactgtcaacaatggctgccctcgtgctcagcttccatgtggtgacagttatcactatcccgaagtcggtggcacaaggctcaacgcaagaaactgccatccaatgacggctggaggacatgtggaggtttgagaggagttggaggagaatatttccatagcatctccactctctcaagtcgtatccacattataagtagcccctctactcctcacttcaaatttgcaccaacaagcagactacaacttcacttatatacataggcattgctctttaagggtaggaatagaatggggaagctcggaaaggagtgcaccaaatttcagacatctctccggggttccggagaagtgccggatatgttggcattcttctaggggagttctggaggagtgccggagtcctgaagatgccggtactccctccgatcttgtacctcgatggatgcttcttttataagtaagtatttgtgatctcctttggtatttaattttatttagttttatcactctgcttaggtagactaccttaatcttctctgtgacgttgggattaggatagtaatcaatagcacagacacgatgtctaggctagagattacctttgtttgatgtgtgctccacgggttgtagaggtagttaacaggtggtgacagtattcgggtacatcatagagccatagccagagtctccttggcagaccaggggtaagccgatgcttgaagcaattgatagagttttatcttaacttgattaagataattaacccataggaatcctctctattcttggcctaccatatagttatttcccttggaagaatctcgttcttagattatacacatacgttgcctgtggatactatatcctggaatactcttggggtgaaggctacgactgtatttgtgcgcttgcggattattctgtcgtcgtaataaataataataggcggttgaactcgtgtaggtactctatagctatcttgtttccctaatgaagcgcatggaactccctcttattttgtgctacagtcccatcgggaacctatgccttcctgaagctacggcaaaattccgcccaagtgacatatgtcacagctgagcgggtgaccatgtagttgtcccaccaagcagaagcgggaccttgaagtttgtacgtggcaaagacaaccttctcctagtcgttccaccggaggaggttcatcttcttctcaatggcatgaagccagtcattggcttccattgggttgatggtgctggagaaagtgggtggcctgacatggagaaactaaagtagtttggactaatgtggtggtggtggaccaaactgctgattcagctgctgcagtgcctgatggtgcatcatctgctattgcatatattggtgttgtttttgcatctgctgcatatcattgtatgatatgcgtctaattggccaacacctgagcgattgttgaattctctagcggtggaggtggaccattgctagttgcaccactggtattggctcctccagtctattcctcactgctgctaccatcacctgttgcatggtcgccattccttgtgttcaccatctgaatggggatggacagaaaaagggggaaaggaaagaatatagactgctaaaaaacctaagctttattacattataatttaagtgcaattgtctaatctgaattaaaacaactacaaagaaaacaattcaactcctaattaaggtagtcataccgcaaccactgttgacggtcgttgtcgatcagtttcgaccatcaatattaccaaattaagagagaactagtgatgcttgcaatgcatatgtttgttagaataataatattccactagtattaggtatattaatcctttgtagagaatgacactaaagtggaggagaatcggcatcaacatagacgataaatcaatcggacaatgtcgagaaccagacttatgtatgaatgggaaaagaactcagaattgacacgatgaattaggccaaaattcacaagtctacgaagtgaagcaatagaggatccccaggcgaagatgggctggtttgggccagcccatggttcggccgaaccagggagttcggccgaacccccatctccactgttgaggccagggtttggcatggacgtccaagattgcaccccaatgacggttggagggtacttcggacaattcctcttccacaaccgtcataaccacctctagataaaggcttcactctcttaacttcaacacacacctcaagcaatagctctctcatttctcttaagtttagtttagtagtacctagctggtggaatagaaatagaataggagtcaggattccgtaagccttcggaagagttcgggtatggctctagtagcttttctcttctcttttgtatgctttgtacttttattagaatactcttctatatatatttatggtattgaaatattctccgagtatatgagtacctactttatattatgttcttattatactaaatatacggctagcttatctaggagatgctttggtgcggatatagtgtttgcttatgcaattactctaggtcatgacgatgatattagagtggtcatgacgatgatattagagtagtatcgggtagtttagacgtggtgtctagattacgggatatcattatttggggttatatattgcggatgagaggtgggccgctgatggcgacagctcaatacgggtattcctccgcgcctatatataatcctaagttaatttcctggggagggtattcctccgtatttagccccggttgtatggtcatgacgggctgtcgtaaggaactcggcagtcaggggtgccttcttgaagtaccaggagggcatcggataaagggtattagctagtatatcagttaactagaatgtatgtatactatatatattagacgtataggaatagatttcctttctcttttctttccacttagcttagatgatatattatgaggatgagtagttaatgcttgtgtgtcactctaccctttgattatcttaacccctgcttaaaatatgattatcacaagtaatatataaattattagttgagttctctctacatgatcttcccacgggataaaataaatacgataccattggaatactctaaggtgaaatgctacaatggtatatccatgcgcttgcggatgaactctgtaaccataatataccagaaatatttctgcgccattgttgggaattatatttcttgtaatgccgttaagaaataccaacaagcaattctggcgccgttggcggggaagattcataatagagattacttgaactaatactttatatttacctctgtataatcatttcctttgcaggctaaccttggttgttttcactttttgttgtgaaaacagagtagtgcatgactggtttcaacttgccggaaaactttaaagaaaatccaaaagctttcttccggagcgttaggccgcgagtcgttgctccgcagaaaactctactgacaaagaaaccagccgtaccagcgccactgaccttcaagacaatagcctgcaagactcttcacgagttcagtactccctctgctgataatgtggccatcgggccgcaagtcaacataggagatgtggatttcgatttgaagtccagcctcatcacgatggcgtaggctagcccgttctgtgccaagcctaatgaggatgccaatgctcatatgcaacagttcctagagatttgtagcacgtacattatcaagggcgtcagtcccgatgccgtcaggctgcggctgtttccgttctcccttctcgagagagcgaagcagtggttctatgccaaccgtgctgctgtcaacacctgggacaaatgctttacggcattcctctcgaaattcttcccgatgggcaaaaccaatgctcttgtggaaggatttccagtttccagcatacaagggacgagtctattccggaagcatgggaacgactgcaggagtatgtggccgcctgtcttcatcatgggatggacgactggctgatcctgcagaatttttacaatggactcaccccaaagtcccgcgatcacctggacgcggcagctagaggagccttcttctctaaaacagttcaaggagccgttgaattaatagagaagatggtctccaatatgggttggagcgaggaacgactccagacccgtcagcgaggcatgtaaaccttcaaggagacggaattacttgctgccaagctgtacctcctcatgaaacgcttggacgaccacgagaaaaggccacaaggcaccgtcaaggccttggactctcacatcacgtgtgaggtctgtggcggcacggatcattctgggaacgactgtccggaaacctgtgaggaggcgatgtacatgggcaacaacaccgggtaccgtccacaaggaggtcaggggtggaaccaaccacgcccatattatcaatgaggtaaaaacaacggtaacttctctaaccagccctccttgaaggatcttgtttttgcgcaagatgaaaccaccgatgcactaagcaaaaagcttgctgctaccgataagatcctagagaacataaaattcaaattagatggctttgcctacgcatttcaaaactagatgagctttaataagatgaaagaaacccagttagctcagttagcatccttagtccctgcaactgaaactgggaggattcttgggcaacccgactcctccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctgtttccccaacggattaggaaaccgtcagtagacgagcagtttgctcgttttgttgaagtaatccaaaagattcacatcaacatgccattgttggacgctatgcaaatgccgacatacacccgttatctcaaggacatactcaacaacaagagaccgctcccaacaacggaggtggtgaagctgacagaacaatgcagcaacgtcgtactccacaagctcccggagaagaagaaagatccgaggtgtcccatgatcacctgctcgattagggcacaacaattcgaccaggccttgtgcgatcttggagctagcgtcagcgtcatgccaaaagccgtcttcgacaagcttaacttcatggtgttgtcaccgacaccgatgcgcctccaactggctgactcgttagtccgttacccggcaaaatattcatgtggtcgaagtggagccacccaagacggacagcctggtgaaattcatgcaaaacttcctggagaaggaaacaacaatgcctaggaaccgctattggaggacgtcggtaaaatcacctgtaccggccaagaagttagagcagccggctcagaagaagccatcttccgcaccaaaatcaaagaaggtgtggaaggaaaagccgaaaacgcccgctccatcacctccagagacgggtagaaaatccgtgaactaaaccgaaaggaggtacggtcttgcacgtcggactttaaatgacgcgaccttcgccaacaggtaaattggtatgtatccgcatatttgctttcaacaatttgaatttttgcatcatcacatatttgaatttcatatttgcatttaggatttttgaattttgaggaaattcttcaaatgaatttttcaaagcaaacaaaaaataaaattttcaacaaaaattgactgtgccacgacaacactgaccgttggaatccaacggccgaaagtggggccggttgggcccaccaggggttcggccgaaccggccaggcaacggtcggctgcctcactttttgaggcaacagctagtgggccccacaggtcagttttgaccgttgtgggtgcactacttaagccaaccgaccgggagaagggacttcaccccatttcaacacattttcatcccctctccaaagtttgctatcaagttcattcaagctttgatagtttccctcaaattcaaaatagtttagttgcatatataaaagttgctttggtgaaactaaccggcgggtgaaactcttatcattcctaacccccgccgagtttgcatatgcaattactctatgttatgacgatgatattatagtagtatctggtagtttaggcgtggtgtctagattacgggatatcattatttggggttatatattgcggatgagaggtgggccgctgatggtgacagctcattacgggtattcctccacaccggtatataatcctaagttaattccctggggagggtatttctccgtatttagccctggttgtatggtcatgacgggctgtcgtaaggaactcgacagtctggggtggcttctcgaagtaccaggagggcatcggatagagggtattagctagtatatcggttaaccagaatgtatgtataccatgtatattagaagtatagaaatagattatatttctcttttctgtccacttagcttagataatatattatgagaatgagtagctaaaacttgtgtgtcactctacccttgtattatcttaaccactgcttagaatatgattatcacaagtaatatataaattatttgtcaagttctctacatgatcttcccatgggataaaataaatacgatacccttggaatactctcggttgaaatgctacaatggtatatccgtgcgcttgcgaatgaactctgtaaccataatatactagaagtattactgcgcaattgctgggaattatatttatagtaatgttaagaaataccaacaacgggcagcgacatgcaaccaccggcgatgggtgctggcgatgcacgagcaatggcgggaggtgcggggcatggtggcgcacgcgggatgctgcggctcatgtagaaacaaaaggggagaggggaaagaggaagtcctgtccagggaaacagcggtgaccagcgcagagcgcgggacgatggcaacgttatgccaaggagcagacgggctacggcgagccgtagaggaggagatgagaagggtcaagaagaagatcacttgcaattgaagaagagtgggttccggcgacggggagcgatgaccgaacggtggccgaggggcagacaggctcgacggtggtggcgacgcagctaggtggtgaccctagcgctgtctagtggacaactggaggagagcgatgagtagtggagctctctcgatccggagtttgaatctcttcattctcgacggacggctgctcaggaaccttttcatcaatcgagctagcagaagtggatggttgagcgagtggcttcatcgttagaggttcctctatcttggacactgatgccttcgactggttttcattggtttgcgtcatgaaggaagtattttctagaatgcgatccaacattattcttccttctgacggtgttttgtgcatgaacgatcctccagtggttatgtgcagatagaatgcagactccttatccaaacccgtatggaaatgttgcataagcacatactcgagtaaggacagggttggtacggactgcactaaattagtgaatctggaccaggctgcactgattgattcgttttcgatctgcttgaaactgagaatttctactcgtagggcagtaatacgggtaactgggaaaaaggcaagacagaatctgtctcgcaacttttcccaactaccgtttacacatccaacggtagaggtgtaccattgctttgctctctcttgaagagagaacgggaacaatttcgaccgcccagtttcttgtttcatgccacgaatcttaaggcatgagcagacttgttcaaagtctcgcagatgattgtagggattttctagatcaaagccagaaaaaggattttccctaaccatactgattagttgtgtaaatgggctccaataaaggaggtggctcatagaattcgccccgaggagcagacagctcaaaaagaggttgctccatggtcgagaagagtgacaggaatacttctctagtatagcaggagcgaaggtagaaataaaaaaaataaaaaggatatgaggatgaactaggttcagaaatgatcagcaaccgttccccggcaacggcgtcagaaatgcttgttggtatttaatacggtcacagataaaatccgcaagcgcacggatataccgatgtagcactttccctacggagtattccaagggtatcgaatccaagggaacgtgtgtggtcaaatctttcttcggttcatccaaggacaccaagcaaatgataggctaggatagagaggatttactagtgagaaacagtgtctagggaaagcttaactttaatcctaatgcaatacttcaggcactggcaacccgctgtttccagatgtcgctctactacgtacccggacagggaggacttaagtgatctcgagggctgtcatcacctctacacccacctcaaacgttctgtgggacatgcagcaattactggataacaattacctaaacaccacatctaagcaattactatctactttagtgtttataactcaccaaagcaatcactatattttagttgattacagtgaacaataatcttgtatgctatttaggaactaaccaagagataattctcacaagataaatctaaatttctcaggaagaatattatattgaattcagagtaataaacagaataaaagaaataggagaagattaccgacaactctggaattcttccgacttcttctactctactttcttcctattctagtatcaatatagtacaatagagcctcttataattcagctcaagcttggagtgtgtgagtgaagtgaagaggtgatgtccttttatagggcagtaatgacggttgtgagaaggggaaatgtccgaactgccccgcaaccgtcattggagagcatttggagcgtccacgccaaaccccagcttggatggttgagattgtggctcggccgaaccccctggttcggccgaacctgggctgggcccaactggcctagctcttggcccatcttctcccctggacctcctctatccatttctcggagttttgggttgatttactggtatttggatcaagttcacaacccctccttgtatagatacatgattctcctcactgtagtctgattttcctcccaacatcggcgtttatcgtctgcatacaaatatataccaacacttgtggaatatatgagagtaagcacctatcactctgttggatgttttattatctgaactttatgcagatgttggcggtatagaattgacatttaacagccgccaacaaggtgatcgatagatgcctactccttattgtcgaccagtcggttgtagaccagttacgtagcagtccccgcgatttgaggtacgactacaactggtcatcgatcagcggcgtaatgattctcccactacgtctgcaatttgttgagtacaactacacactcggtcttcgccttgtgtggtagtcacctcatcaacccatgtcgttcaaattatgtaagtgtttgtatgtgcaatatttgtccgttgatccccttttcttatatcgccctatcttgaagtcgatcctatcattcctttacactattgtcatatgcaaattcaatttattttcaattttcaaattcatattatatcatgttacccttgagcgttcactcgggggctatttgtatctaacaatctattatgtgttttgatttcaggaaagtcagacttcaagactttgtcgcagactctacaactactcgattactcgagaacggttgctggagtttgacaaggattacggaataaagcgatggtgtacctgccgagacgaaatttcttgacttcaatccaaattcttgattacggcaagataaagaattaagtcgtatactccgcaccttctcggtcatccgagaatgtcaagcgagcacggcaattgttattccaaggtcttcggtcgagaacatcaactcattcatttgcattgaagtcaggagctactgttagggttatggataccacatatccaatagtaatcgactaagctcggaagggcccaccatatatcaaatcatatatggaatcatacctcgtatataaaagaagttctagataaggaaggacgagtagagttctatatggaaacaataaggactactcgaatcgtatccatacttgtctccctagttctacttggacaaggggacatctatgggtataaatacacaaccccctatgaggagggaagacaaaaaacagagacaccagtcagaataaacaccaacacacggcgccaaacatcgatattggagatagcctagatggactcaatatggtgcctgcggaggccgacaagaggaatctagtgctatataggatctcgacgagttcgtactcgaggaggaagactaccctatcgtcgactacgtgttggtgatccatgccgccaagttgacgacagctagataggttatcccaattattgtactttgtgtgattcaaatgaataaagagcaacatcggcttcgaccaactggagtagggtcgttaccttcgtgtgaaagggcccgaacctacataaaaatccttatctctatttcttttacctcgacctcgcatataccctggtaccaacgatccccataccatgcaaataccttagttgtgacccaaaacgtcgacagctactttatataaatctgtgatccgttagatcattggtttctcttctttggaacccacctaatgataactatcatgtgttccctttctatgggcaattaggattgctttatatatatatccgggtgaatcatagacccaaaagtgcacacgggtgaatttattcggcctcagtgcatcggcaaaactagccatattaaaatcacattgcctataataaggtttttggattcatatattgatttaatttatttcataaataaatcatgacattacatatgtaaactagcataatcatatcatacaatctttggaagatcggttgcacaacaggaatgactcgcggtatcgggcattgacgacaacaagcaacacccgagagaagaggaagaagagccattgtggaggaacagcaaccagtcacgcaaagcgcttgcaaaaacattattgtcatcttctcctggtgcaggacgtcgaaggcgaaggttctggagagttgctctctcgattgccggtgcacgccagcgagcgggatggagtagactacaagtgacggtgcaatactgaggaggaggcaaaccctatattgattttgtgtgtgttacgtggaggtggcggcgcctgcataatcttcactccgctcctcgcaccagattattcactgtgtttctaaaaacaaaaccgaattttgtgcagcaaaacaaaattacaaaagaatactgtatctgtgcaaaagtgagggaccaattttgacgaaccattcgacacgcatgtcaccacgtatgcgccgcgcttgtgtattcccgttgttctctccacctcacacggtggcggccccagggttttaaacttgtgtattagaaatggggagaggaaaattttttgttcatacacctaaaaacctaataactagcttgtatagtatcacacactaataattatataatatatagcgtatataacataaaattgagtattagttcacacattgatagaattgatcatcatgtgaaattgtttaacatatagaaatactaataataaacatatcaaagtgccaacatatggaatagaaaaatgatagaaaatgataaattgggaagaaatcttactacagttctacaaactaggcaaaaacaattctacaaactaagcaagcaagcaagtacactaaatcaatcaattgcagttttcaatcataagggtaccgagctcgaa

SEQ ID NO: 1143 - DNA, 1586 bp, Oryza sativa
  unsure (1)..(1586): unsure at all n locations
ccatcgctcgagcctggtccggcgaaaggggaaggcggcgcgcccgctcggtcgtcaggcgtcggccgaggtgaaggtggctcggcgtccagccgcccacgccggcacgccccacatgcggacaggccacagtgtcgcgcggcccgtcccttgagtcaacgagccggcgacaccgacgcactgcgcctgctcggccgacagccgctgcgggtgcaatggtgcgcccagccggcggctgcccctgcctggcttgctgccccgcggtcgccggctcgccgccgccgcacgccgcgccagccgccggcttgccgcaacgcacgccgcgcctgccgagtgccgctgcaacgcacgccgccgcctggctccttgcaaatttagggtttgggattggggattttgggagctgcctgggaggggatttttgtttcgaaatgggctcagttgcggcccaagtagaatgcgggccaagtgaaaagggggaaggagtagaaaatttagacccaacacagcagaaatggtaaaacaaggtccaaatgagtagtttaactctttttctttaactttttgcatacatataagaactatatagtatatattctttttgcatacatataaactttttgcatacatataagaactatatagtatatataccaattttttttccaaaaatcttgagtatacatatgaataccgctgaatcatagctagacccgcctctgacctcacatgcctcaagtggctaggagagtatcatcccttataaggagatcttccactcctagaataggtaaggtggtactaaaatccccatgcttactatcccatgagacgaacgttagtgattttttaaagaattaatatttgaataggctaagtcccacctatcaacaagctagggtcacataacaggtttattagattgggttcgaatatatgctagaaagtgcgcaacatatttttttcgattatcagttattaataatttattttttctcttttttttcaggacagaaactgaaagctagcttaggagcctagaggagtggtacccatacgagcgtggtaccaccaataaatctgtggtcagatatataatattaggcaaaatctaatccgcgtgcgctctccgttttgccttatcgcgcaacacgctcatcggccgtccgattccacaagtgctggtgcgtccgtacatagcctggtgattcacggacgtggcatcatctagagggatccaaattggaagccatgtgatgctctacactacgccggctttaaaaataattntctcttaaactaatcatccgatctacgatccgattacaccgttgtgttcgtaagaattgaatctttataacaagatctcacatgattatattttgatgaaaaaatagaaattatttntataatatatctaaaatacttttagatttcactagattacttctcagacacataaaagtatattcaataaagcctaaaagtaatttacatatattatagaagtaacttagaaaaaaagaaagtaccttatcatgacattaaaagtaaatcagttacggaggtaaaaacatgagtctatg

SEQ ID NO: 1144 - DNA, 376 bp, Oryza sativa
ccccctttcctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggaccaccgtggaccgtggggctgacgcgtgggccccacttcccgtggacccggtccgcgcgcccgccccctcggctgacgcaataaacatgattttttaattgaaaatttaatgaagaaattcgcaaatatccatttaaagagcatataa

SEQ ID NO: 1145 - DNA, 516 bp, Oryza sativa
  unsure (1)..(516): unsure at all n locations
nnnnnnnnnnnnnnnnnnnnnnnnnnnnnnnnnnnnnnnnnnnnnnnntgtcggcatgcactaattaacatcgctagtgccaagtatgttcctcaaggcgctaagtattgcattagcggcttgagcattcctgtgctcgttctcgtcgtcctccttcggggatcctcgggtttctacaaaacatagcctttttcgactattctccaaatagatgggttaatagacttcaaatgcatcttcatcttatgtttccaagcgacatagcgcgtatcgttgaagtacggagctttgccgctataggtactcacataagaagtagatgtggatggatagtcataaggaaacgtatctcccttatcaccatctttgccatcccccgtttggcccgacatgatctctccaagcacctaaggctaattaggagattaggctctgataccagttgaaagggtcaattaggcctagagggggggtgaataggcttattaaaactttatgcagaagctaaaactgaat

SEQ ID NO: 1146 - DNA, 571 bp, Oryza sativa
aagcgatgggataaatccagtgttttaaatagcgggctataacatttagcagttgacccttctcaagcagctctagacggagatttaaaacctggataaatctaactcctacaaaatgaccacctgaattctgtagaagctaagacaaatcacatgtacaagccatcgatttgattaattatttggcaggatattcgtggacgagacgccggtgagggtgctgaagaacctgacgagccggggcccggagttcgagttcccggcgaagcctatgcggccgcgggggagcgtgtgggacgcctccgactgggcgacggacggcggccggaccaaggtcgactgggcccgcgcgccattcaccgcggccttccagggcttcgccgtcgacgcctgcgccgccgccgccggcggcggcgtcagctcggacgactgcgggtcgccggacacgtggtggtggaacggcggcgagtacaggaggctgacggcggccagcaggcggcgtacgatggcgtgagggggaacctgacctatgactactgcaccgacaatagcaagaagcgcccagtgccgc

SEQ ID NO: 1147 - DNA, 2531 bp, Oryza sativa
ctcagcgagataagagggagagagagagagagagagacaaaagagggagaagggaataagatagaggatgacagatgagtcccacatgctggctcggtgtttagaataggtcaacgagccacgtcagcgaaacccacccccaaaaccaccgaggaagttattttgtaccggttttaacagttggatgttcaagatatatggtattgcgattgaggggtacatattagattagacatatatttgagggattcaaagtgaacttatttctacacgagtagttcggtaattctggttcgacatgtgatcgattcgggatgtgcctcagttgggcctctagccctccacggaaataggccgaactaggcagcagtacgtagagcttaaagggaaaaaaagtacatacaaggtccctcatcttatcatcagattacaaaatcatccccaccgcaaaatcagatgtatgccatcattttgggtcctcaggcggttttgtccaacgtggtggctgatttatcgcggacccatatggccccgcatttaagggtgaccacgttgtcaccccttctctttcccatattctctcccttccacctctctctcactcttctcataatctgggctggcggggcgagtcgggaaaggaggtctgtcggcgtctgccgtgaggcaccgccgtagcgaccagctatggagggcggcgggtggcaagagtggagctaggagacggcggccggcgggagaggacagccaccatggcctgctgcgggggtgaaggcgagcactgcggcggtgggtcgccacccgtggacgatgcccgtggggaggacctgaactcgctctgagtcgtggctccttagggcggtgacgtcccgcacgaggtcggtggtgggcagcatccttgatgtggcatcgatggaagtgaacaccttgaggaggaagacaagagaggggaggcgcaagatcatggacaagctccgctgccgctcttccctgtcggctgcgccgcgcgcctccagtctccccagctgtcgtccgtcttcgctaccgagcgtcgtcgccgctcttctccgcttcagctgctggtcgcgccgcgcgcctctgattctccccggctgccacccatcttcgccactgaatgctaccgccgctcttctcccccatcggctgccgatcatgccgcgtgccttcagttctcccccggtcgctgcccgtttttgcctcgaactcgacagactcgaaccccggcgccccgacctgctcccacattgcctgttgtcggccgttggaccttgtcctctcccacttcaccccgccggcctcctccccacccgctagctgccttgcccagacgaggaggagaatgagtgagagaggaggaagggagagaaggggggaaagagagagggtgataacgtgatcacccttatttttggggcccacgctaactcaaccatcacgttgaacaaaactagggtcaaaaccgtctgagaacctaaagtgatctggttttataagctgagggatgacatgtatctagttttacggttgtgggatgattttgtcaccaatgacaagaggacgaactatgtactttttccgagcttaaattggcctgtaacgacttcggccatggacaagtcggcccagtgctttatctaaattctaggagcaaaaaagttcactttacgtccatatggcgtctacatagcactaaaagctcgtagatggtttttggctacggaacaccggctttgtaagtttgagtgacgtgttatatactccagtatagtattgcagtttaaggataatttgaactcgacgagtcgacgttaagatgagggacctcaagtgaacttgtacctatatattttctcgatcggtataccggcccaagtggcttccgatgacggctataaataggaaccaattactgggcctctttctccagtagcgcagaaggccctctccctcatctcgaggcgggaaccgctcccgaatattctagaagcttcgggaagggcgtcccccgcgcgtcgcctctctgctctcctctccaccctctcttcatggttgcgtcggcggcggcgggggcgagcggcgagccccagaagaagctcccctcctggccctcgatggtccgcgacttcgccaccgacgagtcccacggcggtaagctagttccgacctgcctcgccgcggggccgccgctgagctaggctgctccagtgtttcgcgtcatcggctaggctgatccgtggcctccgtgcagagcgcggcatgtccgtcctgaagctgcggctcgacggcgtgcgctctgcctacgacgcggccgcggcggagctcgagaccgcgaagcgcgcgcgggaggacgcggagcaggagctcggcgggaaccaggtgcaggtcgccatcgccgtggtgtccatccacgggctcgaggtctctacctctcttcctcatctctcctcgattacggccagtttcgcctgattcgattgggtttatttcgtttcggtgcgtttaggcgacga

SEQ ID NO: 1148 - DNA, 515 bp, Oryza sativa
  unsure (1)..(515): unsure at all n locations
ggtcctcgtacatctttgcgaacgcaagcaaaagcgtgtcggcggcggcttccccgtcgctttcgcgggttgacggtcttaacggcctcgacgtaggtgctacttttctcgcgggggtcctcgtcgacaggcttggccctcgcgtgccacgcctgcacgtcgtgcgggttctgcttgagctgcacgcggttgagcagctccggccggcgttccagaagccgctcgagcctcgcgagcgccatgtcgccgtcgtcgcggtcggccagccagcagccttgaccgagagtgttctcctctgcgtcgccgtgctccccgagctccacgtcaatcatggcgttctcgaagtgcaggtacgcctcgaacaccaaccggaagtccttgacggtggtcgccgtggcgacgccctcctcgaacacgtcccttgccttgccgtggagacccacccgcgcgtagnnnnnnnnnnnnnnnnnnnnnnnnnnnnnnnnnnnnnnnnnnnnnnnnnnnnnnnnnnnnnn

SEQ ID NO: 1149 - DNA, 632 bp, Oryza sativa
cttgtgccaatgcaaatgctccatcatcctgttaggagcataaagggtattgaacatggtggagatctgcatagacccaccaatagaaaatacaaaaagaaaaagacactgcatttagtgtttacttactctaatctcattaaagcccaggtcaagtgaagtcaaagattcattgatgatcttgaaacttcgagccaagcagatagcacccttcaaaaagagaaggatcagaaggcatgggtatgaatcaaagcgcaagttataaataaaattcaacgaagattgtgcatacatcatctccaagtccatttgccctcaaatccaatgtagataatgttgtgttgtacttcaaacaatcagcaacaaattctgcacctgatacacctatctgcaaaatatgtaaccaggctgaagaggatataacttaaatctgcatccgcgattccattcagttatgaagattacctggcaccaaccaagtttaagggtttggattttcccattgaacttgagaacatcacaaagagcctttaccccctctggcccaatcggattatagcttaactccaactacagacaacattcagaattagtgcaagtccgcactaccttcttgtgcagactaaaaaagt

SEQ ID NO: 1150 - DNA, 689 bp, Oryza sativa
  unsure (1)..(689): unsure at all n locations
nnnnnnnnnnnnnnnnnnnnnnnnnnnnnnnnnnnnnnnnnnnnnnnnnnnnnnnnnnnnnnnnnnnnnagatgcggcggagctgccccaatggtggagcctctatagtctctcccctccaccacccgccgcgatgtcttccgctgctccgccgctgccgcgctcaccggcggcgacgcccgactcgacggcgtcaactgcccggacgcgcgtggtccgtgcgccctcacgaccgccgcgggcgccacgccgccggagtgggcggagcgccgccccgccgtgtccgtggactacgaccggggccagcgcgaggcccgcgccgaggtggagggcgtgggcgccgtggcgttccccgcgcgccaccgcctgcgcgtggaggggagccggtggcagcgggactggaaggtgttggaggccgccgcgcgcgtgctcgcgatcccgcgcgccgaggccggcgctgtcgacgccgtgctcaactgctgggccggccgcttcgcccgcggcaacttccctctcctcatccgcgtaagggcatcatcccacgctctgaagtatttcatgaattgaattgctgtgatatacatcgatgtggttgccatggttgcgttcttatgatttgccatcacgcaagttatcgattgcttgaaattacgaaaagcgtcaacaattctatcaatctagctgtgttg

SEQ ID NO: 1151 - DNA, 623 bp, Oryza sativa
  unsure (1)..(623): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttgggtattcgaaattggaagagatatttttttccaacacaaagtctttctaaattgtaagatttcttatcatttttccattttctatgctttataaatttgacatgttttgtcaattaatactttagtactgtactttaaaatatgcttaacatatttaatttatggtcaattctatgaatctatgactttacaactcgttcgctcactacgaagaaacatttcatctagttgacttgaaccccattcaactcaactcgatttcaggttttgaataaatccctgatggacggaagggagcgggagtcagctcccttcctatgaaagacacgcatcatgcttataccattatatattatacannnnnnnnnnnnnnnnnnnnnnnnnnnnnnnnnnnnnnnnnnnnnnnnnnnnnnn

SEQ ID NO: 1152 - DNA, 530 bp, Oryza sativa
  unsure (1)..(530): unsure at all n locations
gcctctcccagaccaagaagcagctgcagacggggacgccggcgcgatggcaagcggcgacggcgcgaactgcggtgccggtggcgggcaggggaagctcccgcggaagcggttctaccgggcgcgcgcgcacagcaacccgctcagcgactcgcacttcccgatcccgatatcgcccgacgaggtagacctctcgcagcactacccgcggtacttcccctccggcgagggcgaggcccgccagggcgacgcggcggtgccacggatccgcttcgcggacgttgggtgtgggttcggcgggctgctcgtcggcctctctacgctcttcccggacaccctcatgatcggcatggagctcagggacaaggtttgttagaatttccccctaaactttgattgggcagtagagatacattcatgtgtgaatggataacagcacaaggtgacactgaagaattcagtgttacatnnnnnnnnnnnnnnnnnnnnnnnnnnnnnnnnnnnnnnnnnnnnnnnnnnnnnnnnnnnnn

SEQ ID NO: 1153 - DNA, 686 bp, Oryza sativa
gtattatcatcgatataagtgatcttaaccgttaatttatcttgttagtacttcctccgtgtcaaaatgtaagtactttttaggttggtacgagtattaagaaagtaggtggaaatgattagagaaagtgtgtgattggttgagaagagaaaaagagatgaaacagaatgtttgtgattgaccccctatcgccgctccttttcatacttgcgattgacccccttcagcgaatccttttcaaggctacagagctcggcgcaatctcgaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcgcccatcagatgcggcggcatcgagttgaatgaggttcttgagggcattcctgtggtgagggcaagttttcccatcaagtacttgggcctccccctagctctgggaagactgtggaaggtggacttgcaacctatctttgacaaaattttcggaagggtagcaagcttgagaggaaaaaatatggcagcggctggaaaaactacgctcgtcaaatatgtgctaacggcgcaaccaatctaccttgtgaccggtctg

SEQ ID NO: 1154 - DNA, 456 bp, Oryza sativa
aacacatttcggctgtatgtgcaaagaaaaacctagctaggacatacaaaaatcgattttatagcagtgatcgatgcatggctgccactactacaacaacgatctttccgtgtgttgcaaactcattttcacgtgcagtagtttcgctcgtctggaacccaacgtctacgaaaatcatgatttttccgtgctcgcacgccgcacggtaaaataaaaaatcaaaaaaagagaaaaaaccaaaaccctaaccataatccagccatcgccccgcgatcgccggcgacggatccagacgctgggagaccggtgccgccactgccatcgtcgtcgcctgccgccgccgagctcgccgccgtgcgcacgccgctctcggtcgccgagcccgctgctcccgcccgccagatccgggcagcttgggaggagggggagagggagatggagatgggaggagggagg

SEQ ID NO: 1155 - DNA, 768 bp, Oryza sativa
gtgaggacgtcgaagagattgaagaaatgggccttgccgtgcttatgggccatgctgaaaagatgatcttggaccaaaacatgaagaatctctttttaaggcttgatcatgctttgtaatggtacatgcccttcccttataattaaagaatagttggttggacagattaggaataaagcacggcctacacctatataattggggattgactggatgggtggattgagaagaaagtaacaatactgcgatggttaagcccaataaaaaggaggacacggtaagaagggaacaaaagcaggaagataaatgtagttccccctgctttgagaaaagagaaaaattattgtacgggataccgtccgaacggaatagtttaatgaagtattctatgacttcctcgatacggacataagtcaacctgatttcgtgcacaatcatacctccagcgacacgcggacatgagcagctaagtgtgttgcaggcctgcaatcctcatgagtactcgtgggcacgtgacacgagcagacatgtcacaccagtatctgagttggtgacaatacaatatgataaagctaggcaaatcagtgtatttatgggtgcatgttcacactgagaagacatgggactttaatagtatttttttaatcgttcgtctctttggaaattgtgctgtctcattccatgaattgtacaagaccataatccgtttggacagaaatatgtatcagttcttgatatcttttaggtatcatgacctaatatctaact

SEQ ID NO: 1156 - DNA, 1774 bp, Oryza sativa
acaagggcacggcttttatcatcatgcgaggcacactgcaacatgaaagatttttctggacgccgaaccctatagttcccaggcggaccatatggggacccgcacatgaaaattgatttttctgtgtgagcgatggcctagcgccggtccccccattttcctgtgcggttccacatatggtccgcctggaaacaaaagggttcggcgtccagaaaaatctttcatgtagtagtgtgcatagcatgatgataaaagcagtgccattgtacaaccatgacaaaaaacccgcggccggtgccggtaagtcttcatttgtagtgaatctgcgagaggcgcagctagcgctacctagagatgaggatgatgtgtcgttcgtcaggctgtgttgggaacatttcacaccgacacgtaaatagagtaatgaattagtacatgattaattaagtactagtaaataaaagtttttaaaatagattattataaatttttacagtaatttttctatagaaaatttttgcaaaatatgtttaacagctcgggaagctaaaaacgatggagtgcagaagttgagaacctagcaaaagaggacgcaaatccactgctgtactgcacctgcagtacgtgtcactgacatgcatgtgggtcccacctataccgggcccacatgtcattggcacttactgcacatgcattacaggagaggatcccaactcagcaaaagaacgttgtttggctggtggttaaacttacaacatcatatctatactaatataaaaaggaggagttgtccccctccaatcctacaggccaaatcacccgaatcaatccctaccgttcatccgcatccgcatcgcctaatccctaatccgcaccgttcaccggcgatttcacccttcccacagcgaccgtgatttcaccctatccatccatcatgattttagctcgcgcgaagactccgcctccgcgctcctcgctcctccttgcttgtccccgttgctgccgcattcctccactactcctgtcgaagcctaggtcgtccccagccgtgttgccgccgccgcactccatcgctgccccgccggaaccgaggtctcccccggctgtcgccgctgttgccgcactccacagctacccccaccgaagaccgagccgtggtcgcccccggccgtagccaccgccacccgccaccgcacctccaccgctgccccctgacgtagccgaggttgtccccagccgccactgccctccatcgctgtccccgccggagccgaggtcgtccctagccgccactaccgccgcgagcgtatgagattgagggaggcggcgccggtgatcgggcacgggcggcatgcgttacgaaaggcggtggcggtggtggtgggccgaggcctgactaccagaggccaaggcggcggcgccacaagagcgcaatgcaactgtgttgtgcgggcagaaagccagcacgtgggtgggcgccgaggagcaatcagctgcctccctagtaagcagcaaacaggaccgcatcagtcggccagcatttgctagctgggcttgggatcctgttttctcttctcatatacttatttgtgatttgcaaattgtaatacctgatttgtggatttgggaattgggaagatggattgaaaaggaagggaaagcatcaacatttcaagaggtagatttggggaattttgatgagtctgtttatattagcacccaaattgaagagctattttaacatattcaagtactccgttgtactgcgccccggtcg

SEQ ID NO: 1157 - DNA, 618 bp, Oryza sativa
ctccgtggaccccggcgccacggtggcgcggcgcatgagccccgccaccgccgccaccgcgccgccgtcgatgagcgcctccctcccctcgccgcagccggcgaggttggccatgaccatcagcgccgggcggcgcagcgcggcgtcccccgcggcgccgacgagggccgccaccgcgccggccgacctcgcgagcctcgaccggttcatctcgtcgagggagaggtagtacagcgccatgccagcgtcgcgccgcgcgcggtcgccgtcggcggcgctcgcgaggaggcgcagcaacggcgggacggcgccgagcacgccgatcgggatccggttcctctcctcgatcgagaggctgtacaccgcgccggcggcgtggtcgcggagctccggggacgccgcggcgagcagcccgacgagcaccggcacgagctccgcgcgcaccagctgcacccggttcgccggctccagcgagaggttgaccacgcacgcggcggcgctgaccctgacgccctcgtggccggaccccatcaggcggcgcagcccgtcgagcaagccgaggcgtgcagagcgcgcgcctcaccccgttctcgccgccgcgcagcgtctgcttcagcg

SEQ ID NO: 1158 - DNA, 642 bp, Oryza sativa
  unsure (1)..(642): unsure at all n locations
nnnnnnnnnnnnnnnnnnnnnnnnnnnnnnnnnnnnnnnnnnnnnnnnnnnnnnnnnnnnnnnnnnnccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgagcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccaactcacgtactcccacgggcacattagggggtaccgagctcgaattcgccctatagt

SEQ ID NO: 1159 - DNA, 932 bp, Oryza sativa
  unsure (1)..(932): unsure at all n locations
ccacctcaccatcatcccagcatgaatggtcctttggttccatcacctcagccattaagttccactgcggccgccgccaccgttggcgctccacaaacacgacaaagaaggggagaacagctctgccattgctcattggccttgtagcagtggtcgtagccattggagatcaccccggtgactgcgaggcaaggaggataagcagcaacacaggggccgccatagccaacgaggccatcgctctcgctagggcctacatccgcgagccttcgcgaggccgagtcactgccaccggttccgaggcaccctggtgggagctcgccgccgctgccgctcccctcgtcttcctgtcgccatcaccgccgctgccctcgtcctcccgacgccatcgccgttgtgcagaagaaggcggaaggggagagactcagcgagataagagggagagagagagagagagagagaaaagagggagaagggaataagatagaggatgacagatgagtcccacatgctggctcggtgtttagactaggtcaacgagccacgtcagcgaaagccaccctcaaaaccaccgaggaagttattttgtaccggttttaacagttggatgttcaagatatatggtattgcgattgaggggtacatattagattagacatatatttgagggattcaaagtgaacttatttctacacgagtagttcggtaattctggttcgacatgtgatcgattcgggatgtgcctcagttgggcctctagccctccacggaaataggccgaactaggcagcagtacgtagagcttaaagggaaaaaaagtacatacaaggtccctcatcttatcatcagattacaaaatcatccccaccgcaaaatnnnnnnnnnnnnnnnnnnnnnnnnnnnnnnnnnnnnnnnnnnnnnnnnnnnnnnnn

SEQ ID NO: 1160 - DNA, 1155 bp, Oryza sativa
  unsure (1)..(1155): unsure at all n locations
nnnnnnnnnnnnnnnnnnnnnnnnnnnnnnnnnnnnnnagtctaaatcaagactaattacctcgtctgaatagaagccaaagcatgtgtaggcaccaattgttcataatttactttccaacttccttaaatcctaattaaaaaaagtgatcatgatataccggtaatcacatgacctgtagcagacaacgtggtatgttcaatttataaaagagcgtatgctataaaatttatgtgtattgctcatgtatcaacccaacgaattcattgtaatctagtaattcaggttcagatgaaagatcaacatattggctattcacttaataaaatagcatcaatatgaataccaggtataggtacataccaagaaaatgttcaggtttgctctgttattccaatttcttacagattttcctacaaaattaaaagaaactgcagtatttagcaccaaacacagccaatgattatgcattaaggaaaaactacataatttacaaatctaacctgaagtagttaatgtaaatcttcattggtcatgagagcaacatcatatttcaaatagcaaacaccatgttcaaaactattatacataaaaatattggtaattggtgcagcccactaattttaggatgattttttaaaaaattacctcaacacaattagaagaaggatcgatgtagactattgtagggtttacgcaaatacatggggtgcttgactgctcgatccaacggttgtggcatggcggttgtgggtaggataatggcattgatgttgtctcggtagcgaccggggcgcagtacaacggagtacttgaatatgttaaaatagctcttcaatttggtgctaatataaacagactcatcaaaattccccaaatctacctcttgaaatgttgatgctttcccttccttttcaatccatcttcccaattcccaaatccacaaatcaggtattacaatttgcaaatcacaaataagtatatgagaagagaaaacaggatcccaagcccagctagcaaatgctggccgactgatgcggtcctgtttgctgcttactagggaggcagctgattgctcctcggcgcccacccacgtgctggctttctgcccgcacaacacagttgcattgcgctcttgtggcgccgccgccttgg

SEQ ID NO: 1161 - DNA, 2103 bp, Oryza sativa
aaactgtttggttgggcttcaactccagaaagataaagcatgagtgcaatggtgggttgttcggtctttttacgatggttggcttttaaaaaaatctgtttatcaaggttaacgatttttatgagaccaaaaatgtttttatgtgatggtgaaggatcactacaagtatgctataacgggatcataagttttttgggtggtttttttatggatcagtttacttgagtttttttgaaacctttctttaaaggagaggaaagagaacgactttgcttttcaaaacagttaaaaagaaaaaaaaaaagagagattattaggctaatagctgctatcactaacatcaaagatatggagtactcctagatgtacctaagagcaggtacaatagcaggctacaagctagctacaaacatattataaagagataaataagaagagagaaaagcagtgggctatagatttgtagccaaatatagcacggactccaagacatagtatgtatatgacatgtgggaccagatattaatagtgtagtactacctccttccctaaatgtttaacgtcgttgactttttaaaatatgtttgaccgttcgtcttattcaaaaacttatgtgaaatatgtaaaactatatgtaaacataaaaatatatttaacaataaatcaaatgataggaaaagaattaataattacttaaattttttgaataagacgaacggtcaaacatatttaaaaaagtcaacggcgtcaaacattttgagatagagggagtatataactattgtatgaatgagctattagattggttatagatgaattagagttagtagttggctatactattaaacttgctctaatgtttcaaagagaaaaatatatactctagtagagaataatggccgctatcactgacaggcgtgcccccacaaggccacaaggccaaggccaggccaaccgctgtcacgtgtacagcgaatggctacaactgacggggcccacactacaccaacacccactgagctgcgggccccacggccccaccacgaggtacacctactatgccacctcttccccccaccaccaccacctcactcccacgcctccctcctcccattttcgccggcctcgctcgccgccgcgtcgcgtcgcgccgccacctcacgccaccgccgggcgggcgcggcttccccttgccttccactccgcctccgcctccgttgctacggcgcgagccagaaggggcggaggtcttcgccgcgacggggatgagggggcggtgagcctgcgcctactgccccggccgcaacagcgcagcagccactgccgccccccaccgctcggcgcgagatccgagcgcgacgcggctgttgctgttgctgctgtgaagagccgggaggggttgacgcggcggcggaggagaggtcagggaggaggcggaggccatggcgggttcgaggttcgggtcgttcaagtcggagaagggggacccggccgccacggcggcgcagaggagggacccgtacgaggtgctcggcgtggggcgcaacgccaccgaccaggagatcaagagcgccttccgccgcatggcgctcaagtgagcactccccgcctcaccctcagattcggccccctcattcgatccttctggcatcctagtcctagatgaacgcgtctcgcgggaattcgtgcgagataagataaattataggagcttatttactgtttagtgaacttttggagggatttgggggcgcatttaatcttgctagccattcttgtgtggagattggttcttctttttttgctttgctatcaatgttgcaatggtttcagaagttttccttgcaaattgaggcaggtaccacccggacaagaatggcgatgatcctgttgcatcagacatgttccaggaagtcacattctcctacaacatcctgtcagatcccgataagaggcggcagtacgacacatcaggatttgaggttagttcttgcatgaactggtaatttttaatctaccatgttatggcaactggtgcaatttgttcaggccatcgaagccgatagccaggaattggagctggacctatcgagtctcaatacc

SEQ ID NO: 1162 - DNA, 723 bp, Oryza sativa
  unsure (1)..(723): unsure at all n locations
nnnnnnnnnnnnnnnnnnnnnnnnnnnnnnnnnnnnnnnnacgatcttattttcagtattaccgtcggtgtgttcgtatttcttctgatgtttggtcgggtgattttcgttttgtcaatcttagcaatcccgatatgttggcggcttccaatgcagttgtggaggggcaatcatctgcatttctggcaggacatactgaaagtaatagctgcagctatctttcttgtttatgtatccctcggttttctcatgaccgtgttctctgtccttgaagttgttctcgcatttttctttgtggagattgaaaatgtcactcctagtagtatagaattttgcagctggcacgggtgtgtgatccaacatggtgacctaattgctttgtaccccagttgaggttttgtgaaaatctcttagcttttctcggctactgctgttgcttttatcagtcgtggttctgtaatacgctgctttgctatcgaactgtagctgtagtcctttgtaacagaatttgtttttcatgctatagaaagctctcctactaggcactactacagagtaccttatcactaataggtgaaaagcatcatcaataatggttccttttacccattacagtatttgtgtcactggcatgggatatatcatccataatggttcatgacccgttacagatccattgatctctaacggttttgttaaaggtttgtgtcaaatatatatata

SEQ ID NO: 1163 - DNA, 13708 bp, Oryza sativa
tgttaggaactcccaacgattatctctcaggaactggaattaatcacgaattgcgcatacaagatttctcaaccccgaaggatcgagccgccgccgcctacgccaccgcgcatattccagttcttagccgccttctacttgttcttcgtttgcgtttatattacatagtttcggctgatctctctctctctcagacagctcatgccagctggttgtttactggacccattggtcacccttgtagcgtggattgggcctccttgctcttggcccaagctggactggtacttgcttcttcttggtcttgaagtctggttttcctccttgttcctgggcatctgcttccttgtcgtcaggctccagcacctcttcctcttctgctccttcttgtatcatctcttctgtatcttctcttgctcttggtggagatggaggcctgacaagcccccattcttggaaaccggcttgcccccaagccggtgcctgaggaaatcttgactgcaagtcctccatgtcctcccatgtagctgcagaagcatcacaacctgtccattgagttagcaattgagtaatgggagtgttacctcttttagtcactctataatcaataaactggtgaggaatctgaaaatgattcagatcaggaggttgattagagtgcactggatgagagaatccctgggctgctttcaattgtgagacatggaatactggatgtatgtgacaggaagcaggtagttgcagtttataagctactgagcccactctggcagagatttgaaaaggtccaaaataacgaaaagataacttgtggttggctctagtagaaactgatgtttggacataaggttgaagtttgaggtaaacccaatcaccaacttgaaattccctgaaactcctcttcttatctgccaagtgtttcatttgttgctgagctctgttcagatgttgttgaagcaggtgttgcataaatttgcgctgctgcaaccattgagacacatctggtatggcacagtcattgaggctgatgccaaagtgactaggtttatagccatacaggacttcaaatggggacttgttcaatgtggaatgataagaagtgttataccagaattctgccaagtataaccattgggaccacttagtcggagtggcatggacaaagcatctcagataaatttcaaggcattggttcaccctttctgtttggccatctgattgaggatgatacgcggagctcatatgcagttttgttccagacctcgcaaaaagttgctcccagaagttactggtaaagactcgatctctatctgaaatgataatgttgggtaacccatgcaacttgtaaacatgtttcaagaattcaagagcaacagttgcggcagaaaatgggtgtgaaagaggaacgaagtgagcatatttagaaaacttgtcgaccaccactaggatgcaattaaaatgatgggacctgggtaaaccctcaatgaaatccatagagatagtatgccaagctgctgcaggaacaggcaggggttgtagcaaacctgggtatttggctctgtctggtttggcctgaatgcatacctgacaggtgttcactctggtctgtatcattcttttcatgccagcccaagcaaaaagcgctttaattcttctgtaagtaacagggaatcctgagtgaccaccaatgggtgcagagtgtagagcatcaataattttggattggaggtcaccattctggccaacccagatcctgcccttgtacattaatatgccttgcttcagtgtaaaatgaggtctggcattgggattgatagacagttctgctagtaattgtgtggagttggaatcagtctcataactttgaatgacatcctgcatccaaagtggtactccttcagatatagcaactagttcagctttaacagtgtcttccttttgagaaagggcatcagcagccgagttgtgaattcctttcctgtaacatattttgtactgcagtcccaacagcttggtataagctttttgttgccaaggtgtgtgtaatctttgctcagacaagtgcttgaggctatgatgatctgtgagaatgagaaattctgcatgctgcaaataaggtctccagtggtccacagctagcagtatggccatatattccttctcataagtagataaccccttagacttgggacccagagccctgctgagaaatgctataggatgattgtcctgtgatagaacagcaccaatgccaaactcactggcatctgtttccagggtaaactgttttgtaaagtcggggagagctagaacaggagcagaccccagagctttcttgatatgttgaaaagcattgacagtgtcctgagtccactgaaatggaacccccttccttagcaattgagtgaggtatttgctaatctctccaaatcccttcacaaattttctgtagtatcctgcaaaccccagaaatccctttagttttttgacagtattgggtacagcccagttaaccacatcttgtatcttcttaggatcagtggaaaccccctcagaaccaatgatgtgacctagataggatatctcttgttgtgcaaaagaacatttggacaatttcaccttccagttgtgttcagatagcagctgaagtacttgtctcaaatgctccagatgtgctgtgagggttggactgtagatgaggatgtcatcaaagaataccagcacaaatttcctcaatacagtggccaaggttgtattcattgcacccaaaaatgtggcaggagctcctgttagtccaaatgacatgactttaaattcataatgacctgagtgtgtttgaaacgctgttttaaattcttccccctcagccatccttatctgatgataccctgctcttaagtccaatttggaaaaccatttggagccagccagttcatccagtaattcctcaataattgggacagggtatttactcttcactgtgacagcattcagctgcctgtagtcaatgcataagcgccaggagccatctttcttcttaactaagagagcaggtgatgaaaaggggctctgactaggttggatcactcctgatttcagcatctccgccacctgtcgttcaatctcatttttaagtgcaggtttgtacctgtatggtcttaagttcactggtttagctcctggaataagtggtatgtgatggtcacaagttcttttaggaggtaagccagtgggttcagtgaagaggtcttgaaattcttgtagcaggggctgaacctcagcaggcacttcactagtttcttgttcagcagtttgaatgagttgcaccatacattctattgaatcagttttagccataccttgcaattggtggacagatatagtatcacactgatccaactgaggaatcagtccctgtaacctggtgagctgctggttatactagaattctaaccatttatgggaccaattgatttgcataggactatgctgctccaaccaatccatgcccaatatcacatcatatgaacccaaaggtaaaagtctgaaatcagtcttaaaactgtgtccctgagtccaccagctacactgtggtataatcctggaacaaggaatctggccaccatctgctacttgcactttcaaaggagactgaagagcttgcaagcctctcatgtgttgacctttttgctcatcaataaaagagtgtgtgctgccagaatccacaagcattaaaagttctctgttttgcacccatcctcttaacttgatagacttagaagattcagaaccatgtaatgcttgtgaagatatggacataagtgtatcttcatctccctcaggaacactgctttgatttgaaataatctcaggatcagcctgaattgcttccaatagttcctcaaccacatgtaactgtattgtagtagcacacttgtgatctctactccatctctctccacaggtaaaacacaatcccttagatcttctgtaagctttcagggctgatatcctatcttctctcactctaggtgattcaatgtttctcttgtcttcaggggattggctgggactggatctgtatgagttaggagaaatgggaggagtagcacttctgggtggggatttcaaataagttccactatcagatctcttgaaactatttggttttgattcagcagcagtttcttcctgaagtagagctaaagaacacgcagtgtccaagtcttgaggcctttgcatcagaaccatggatctaatatcatctctaagaccttccatgaattttgtaacgaagtaaatcggcggaacagcttgctcataagccagtaactaatgcattacacaatcaaaacgctctacatactctccaactgatcccccttgtttcagatgaatccactgtcggattaaggcctgttgtctatcacgcgaaaatcttgcacacaccttctcgcacaaatcagaccaagtaataccaatcagttgattcctcacagattgaagccagaatgccgcattaccacaaaaattcagagtagccacttttacccaattctgcggtaaaactccatagatgtcaaaataaacttcacaatttgctcgccacatctggggattatcaccgttgaactgcggacaagtcatcggaggaacactaccacaaactccagtggacattgcagagaaagtactgtgttgcgcagacgaatcaaagctgaaaggagcagcggagtcaggaggagattcatgcgtaccctgggcagaagccggagtcctgaaccctgcggacgcagccgccacctcttcgttcgtgttcatcacgcgcggcagctgcttctccaaatgctcgaccttggagttcagctttcccagggcagagttcagatcctccacccgcttctctacctggggaaggcgcccctccaccatcgccttgagttccatcagatcttctcgggtccgatcttccgccgccatcctcttcttctcattctcagctatggtcttcaggagtacatcgaactttccttctatatccatggcgctacacactctctcacttgcccctcaaattcccgctccaaattcagctaaccagtcaaggcaagttgccttttcgcggaaattccacctccgaagagacggattccaatccttgaactggaattttacagccgaaccgagagattgtaggaagagtggctcaaatttgcgctctgataccagattgttaggaactcccaacgattatctctcaggaactggaattaatcacgaattgcacatacaagatttctcaaccccgaaggatcgagccgccgccgcctacgccaccgcgcatattccagttcttagccgccttctacttgttcttcgtttgcgtttatattacatagtttcggctgatctctctctctctcagacagctcatgccagctggttgtttactggacccattggtcacccttgtagcgtggattgggcctccttgctcttggcccaagctggactggtacttgcttcttcttggtcttgaagtctggttttcctccttgttcctgggcatctgcttccttgtcgtcaggctccagcacctcttcctcttctgctccttcttgtatcatctcttctgtatcttctcttgctcttggtggagatggaggcctgacaaggcgccgccgccgttatctttctttgtctgctggactggttttcctagcagttgtgggcatggttcttacatttctggtggtaacaactgatctaacattggactctggcaacagctgggacgatcttattttcagtattaccgtcggtgtgttcgtatttcttctgatgtttggtcgggtgattttcgttttgtcaatcttagcaatcccgatatgttggcggcttccaatgcagttgtggaggggcaatcatctgcatttctggcaggacatactgaaagtaatagctgcagctatctttcttgtttatgtatccctcggttttctcatgaccgtgttctctgtccttgaagttgttctcgcatttttctttgtggagattgaaaatgtcactcctagtagtatagaattttgcagctggcacgggtgtgtgatccaacatggtgacctaattgctttgtaccccagttgaggttttgtgaaaatctcttagcttttctcggctactgctgttgcttttatcagtcgtggttctgtaatacgctgctttgctatcgaactgtagctgtagtcctttgtaacagaatttgtttttcatgctatagaaagctctcctactaggcactactacagagtaccttatcactaataggtgaaaagcatcatcaataatggttccttttacccattacagtatttgtgtcactggcatgggatatatcatccataatggttcatgacccgttacagatccattgatctctaacggttttgttaaagtttgtgtcaaatatatatataaagtcggttacaaattaggattaaagttgtattgtattctaatagaagtagagtaatactcttcctaaactctctttaaatagagagacacttgttataaccgcatgacgactgtagcaaatgagggaatgattgaccaatagtgttgtaagtcaaacagtataattgccagttaatggttgttgatacccttatatgtgtaattatgttggattagggaggagcgcctataattagtgtctcggggatataggttccagctgaactttagttaaatatcatggcacgatgtcgccaccacgtttggatcttagtgtatttttgcgtttgattgccaatgtctatttcggtgttggttttataataggttcacaattataaactattatagatgtgaaatattagggggaaatattccgtttacaagttataaaccgataggttatagatgtggattattgagacataaaagaaagaaatggcacactggcggatgtcaacagctcgcccaccgtgcttgtcacaacctcacagaaatcacaaaaggaaatgcataatagaacttatacattctggcaaacatattcagaatcatcaaaaagaattgaatgatgttccgtgaaggaagaatcaaaatattacaatgatcaactcaaaggaaaacaagaatgatatgaaggtgccaagaaagctactaacaagtttcgggggaaaaaaagcagtgtcctcccttcttgatgcagaagacgttcacctgcaacaaacagatcgtcctcatctcatcagcggcaacaatcagttgatcatgcacaacgaaaaaaaatacattttacaccctcgatcaaagcaagtacgatgtgtgtgtacaaaggtgtgtattcgcttatttcttacatctaattaaatgaagatttagctaggttagggtcagcttgaatggactagggtgtgtttagttcacgccaaaattgaaaatttgtttgaaattagaacgatgtaatggaaaagttgaaagtttgtgtgtgtagaaaagttttgatgtgatgaaaaagttggaagtttgaagaaaaagtttggaactaaacaaggactagcttatatggttatacctagacttgaggccctgtttagatcccaccccaaaatttttcaccctgtcatatcgaacatttgaacacctgcatgaagtattaaatataggctaaaaaataactaattacacagattgtgactaatttgcgaaacgaatcttttaagcctatttactctatgatttaacaacgtggtgctacggtaaatatttgctaatgacagattatttaggcttaataattaattcgtctcgcggtttactgacggattctgtaattagtttttttattagtgcccgaacaccctttgcgacaccctatataatacatgaggtgacacgctaaaattttacacccctgcatctaaccaccccctaaatctataagagtactccttagctgaaatgggagtggcttttggagcagctagagagttggactgaagtctaaagttttgggtttctggaacccttccataggcggtaggaactgaatgtggtcagatgatacggtaccaaagataccactataatccactcatcaaatgaattgaagcatgcaaagaccaacaagaagcctatagggttagaacttaaaagagcccttagctttgagccaagctataggccggtctgtggaatatgcctatgcatattcaaaaacattacaatgaactttagtatagtaaaaatttgttacaggacatggcttttgccggtagacattgcaaaattttggatttgctgaaagataatgaaaatttgttgggtgcatactgagcccattaaaatattattttctattgagttagagagagatatttgtatcgaaatattttgctacaaacaaaccccatattcctcttccattttctctctttccccaatctttccttttcatctacacatgatggtgggcagggtgatcatggaggaagtatgccagatgctggtaagttgtaccgtcccaagatctacttggcttcgagctctttggtgttcattcgatctgttcatcatgagccccccgccattagatttgaactcccatgcttggatttgccaatgttgtgactcgatgaagaataggatatgcggtgatatatcttgccggactctggagcttcgtaatatgttccatcttcctagcaccaaggaagataagcttcgtcatgatactctacaccattcctcaagagcatgggaaccaccacttgatctagatggagcaagacatggatcgaaagttgtgaagaatgtcctcttattgcccggctatccatccggacaaacactaggagcctagttgccatatgggcacatgcgaccgtgttttgctcacagaattcatcaaatcattggatttttatcatgccgccaacattgccgctaatctttgcataaaggttttgctctcactaacatgttgttgatacatcagttactctgattcaatgtaattaggaggtatggttcacttacacgagagaagagatagcaaaaacggataacagacgagatgggcaaatattatacatttctctctctaacacaatggtaaatgatatattccagtaggcttaatatacatgagtaatttaccacaatctttccgtccatagtggtctttaatttcccaatcttgggctatgcccaagtgttacaaggcctagggttattaactgttttctaaacacgtaattgctaaatggcatttaacgaaaaatcgagagatatttctcatatattttgaaccaaccgatggtatttaacggaaaatcgagggatatttctcatatattttgaaccaaccgatttgcttggagattcgtgtgcccaactccttctcctctagctccgatgaagctctagcgagtgacgaggtcttgggttggggtaggggtgggatgagaaagaaggagagatcgccgggcttaaagggatggccgtgagaggtagcggctcgatagtgagtagtggacacgggcaggtggtgagacgtcggcggtggtgccgaagccacaaggatggaggagcacggtgggtcggtgttggtggtagggccagagcgaagcgagtggttagaaggcgatagtcgatggtgggggaaccaatgatagggaactgtcggagataggaaagacggcgggacggggcactttactgccgctagcttaaggaggagaagaggaaaggggaaggggcttgccggtgccgttggcgccttctagccagccggtgagggcggggaaggcggacgttgcgacatcgacatccagtgaacgagcattctgtcaagaagagtataaggtgaaaacactatagttgcatgaatcttaaatcaatccgagccattcaaaagtaactgaaaatgagggagggtttttcttgtaaatattatacgtacgtttagcgatcagacggatagcaaaaccgactgagatcagccaaaaaaagtgtcgacatctttttatcaagtccgtttctaaaatacatacaactattttcgaaatgtttatttatctataaagtccaaaagcaaaaagacactgcttgcaaatcaatcagtctttctctctccgattctctgtacccttatcagctcctccatctctatgagacgttcctatcgccggccgggccgcttcagacgacaacaaccctatccgccggaagaaccaagaaaatttggaagagacaattcacaattgacgaagaagggaaaaatcctccgattcctccagtctcccatcgagcggagcacacaaaccaaaccaagaaaaccggtgatgcttccccccgccctcctcctcgtcgtcgccgtcggcgccgcgctcctcctcgccttccgccctccgctgccggccctcgccgcccgccccatcgtcgccgccgccggcggcaagcccgcccccaccgaggccgccgccaccgcgaggtggctcgccgcccagaacacgtggggcgtcctcaggttgtccccctcccaattcctttgccttcttcttgctcgtgatcccctactgtttggggggactgattggttgatgcctcggttctttaggagatgacaatgggtggctcgatcgaaattgggggttcttagcgcggccaagtgttggtagtggctagtaatctaatcgcctgaggctgcttagtattgagaaattgttggtgctcttcccttacttgtgtgacattcagtgtcatgatttacaattgaataggtgttttgctaaattgccgtcctactgtgccaattggataacgaaaacttacagttccatcaaaattcctcgcaaagaaaataaataaatatagacaatattcttcaaattggtgtgaagttggaaacctctggccacgttttaatgtctgcatacatcattaggtcaaatataccagacagatttttatctagtaatgaaaagctatggttttagcatcaaggtcaatatagctttttccccccatattatttagagcataagttactcatatgtgtcatgtattacttgaaattaattgtaaaagtcataaaaagtatgaaagtttcttaactaatattttagtacttgttcaggtgaaaacaaggatattcaagattctaaatagtctttgatttctaagaaaacaaatttcaaattaagcaggcaaaataaaactattgataaaaactaattgattgagtagcggtacagcatttagtggatttagcagagttgtcatagctgccttcgctggtttttacatgatactacaatagcgtagcagtcactgtcaaaaaatacttacgcgagtgcagttggctatttaaaacactattgtatattgttttgactttcttttaataatgtatctgctagatgtccactgattgttcactcacatatgcaatttctttttgcagcacaatatcaagtgatctaagtggagctccttttgggtaatatttcttgttttggtattgaaaacaaccaacgcacatggttacaaaccctttctgattgctgaacttagttccctgcttcctgtacatacagcaatgtagtttcatatagtgatggagtgccaggtgagagccatggaatcccctacttctatctgacaacgctagatcccactgcgagagatgcattggaggatgaaaggacctcctttacccttagcgagttccctcttgggacatgtgggaagattgatcctgaaaacccaacttgtgcaaaacttactcttactggaaaggtacagacaaattgcatccatggtaccatgattattcacttgctgtttatctatctatttctattttgctttggtagtgactgatctggttatcttcttatatctatttttcttggtgctgactggtctaagaatgtacagtagttaatttctttttattaattcatacttaattcagcttgaagttataaattgctgtagagtgaatacttactgctggacttgagtcgtaaccaaacattatcactgttttgtctgccttcaactttatagttttgggcctcaatttcttggcatggggatgagaggttgagagacttcagcaggagagctcaggcttttggaactttggagccttgtggatggtttagcttgtggcattgtagttgtaggctcaatttttacatgttctttgcaagttttcttcacaactaggtggactggtgaccaagttatcgcctagtcttccagttgttgtggagataccctcagtagacaatatgataaccatgatcgagagacaaaacaactatactccattgtcttatagttttttcccccacgttcctaactgtgtccgtcccctctcaaattatctatcatggattcactgtgagcaagaaaacagcagatggtcaagaaatcatggtttataaagttatgtagatgatatttcatcaagaaattatagtttataaaactgttgtgacatgtgagatcaatgaagtaggcaagtagcaggggctataggcacttcatttaatctcagccataagaaccatacatagatgtgatatagttggatcatttcttgacttactaagttgtaatggaaccagtgaattgcatgttttcagttgaagttgattgaccctcaatcatctgaagcagatttggccaaagaagcactttttactaaacatcctgaaatggagggtaaatccaagtatttctttgtgtcttttactaatgtgagattaactggtgattattttatgacaacattcatgtatggctgtttgataggttggccaaagaatcatcatttccaaatcttcaaattggaaatcaaaaacatatttttgattgattggtttgggggtcctaagcctatatcccccactgaataccttgaatatgagaagtgagtatacaacaaacttgcagatatgaacttacaatgtgcatctgatctattgccaagaaaccattttttaacataattatgatttatgcaggaaccgggccttgctgaagtcatcctaagcgacgcaccacgtttatatgtatgttgtaaagataaacagtaaattaattatatatgctatgtacatatttacatactgtgaacacatcttgttcatcttgaataaaaacgttattatgtttgtttatggaaactgagcttctctaattgatctgaatttgttattccaacaatgaccattgatctgataagatagtactagcaaaagaaacatgtaatatgtctattccagtactttgggacatgcctgacaatattggtatatgatacagtgtaaataaatacgaagaaattgttctcacacataacggaaatgtgtatatacaagcttagcaagaaatatggaatcaacaatactatcaccaaataatctaatttccttacactatatacaaatttaagcaaaccatttcttaagcaaaatgagaaaaagatcaaaccgttcgagcacggtacgaaactgacactgggacccacacgttagccgttgggcgcttgcctgagcctgtcgagcgccgtggtgttcgaccgcggcggcgccccgtgcgcgtgcgcgtgctccaccagccgtctcgggaactggggcatcgccatggccttcgacatgacgctcacgtcgtccattcacgg

SEQ ID NO: 1164 - DNA, 3078 bp, Oryza sativa
  unsure (1)..(3078): unsure at all n locations
nnnnnnnnnnnnnnnnnnnnnnnnnnnnnnnnnnnnnnnnnnnnnnnnnnnnnnnnnnnnnnnnnnccgtcgagcagccgcggcgtgcagagcgcgcgcctcaccccgttctcgccgccgcgcagcgtctgcttcagcgcctccagcgcgccctcctgccggctcggctcgtcgtcgagcagcctcaccagaacagcctcctccaaggtcaaccccaacgccgcgaactccggcgaggacgacgacgacgactcgaaccgctcgccgttgactcccccggcgcgaccaggctcccgcatcgccatgaggtggcggacaatgcccctcgcctcctccggcgagacggcgagcggacgcggcaagccgacgcggtcgcagtaggaggagatggccttcctgaggttggcgttcgggatgagcgccggtggcggcgaggcggcgaggtccacggacagtggcagcgccgccggggtgaagcccagcgccacgcaggcctcgacgcagccgcgctcgaaggtctcgccgctggggacgatcaccgggtcggccatgagctcgccggagatcgggcacacgaattccgccggggtggcggcggcgccgccgtcggcgccccccatggcacgtggtcaagtcaacggcgaggcgcacacactggtctggtcgttttggcggttagagagcgtctcacaggacagggttaagttgaatctggacagctggttgaatggtagccttggaaattttctttttacaagatgatttttttttggttgttgttgttcttgtttttattgattaaataatgagtgttattaattaaagtgtgaacaaacaacatgatccttaaactttcgcttaaggatccataaagtctttggtatttcgtattatccaaataagtccctaaactttattatgttatttaatatagtccttggatacaacgtctacatgccgcatcacccgtgcatgcaaattcaacatttgaaacatccatctagctacccttacattctccgtaggaaataaataaaaagaattagtaaaagaaaggcatttggccattggaaaaaagatgttgcattggtaactaaagaatgtggtatttttcttttgttttatgattgctttcttcatgttttttcttttttttctcttttttaaaagaaaatgtaagggtaaaatggatatttagggtttgttcagattgtagccaaaataaacctactgataacattttggcaagttgccaatattaccaaaattttgtcatgatttcttacgtgtttaccaaattaagtttggcaacaaactaaatataggcattttttggtaactttataaaaaaaatgatatgattgaaaataacatcagtccaaataggcccttaaatattgactgtacatgcatgaatgatgtgacatgtcaagtgtgtccaatggctatatttagtcacatgacaatctttagagatttgtttggacaatacaaaacaccatgaactaatttgatccgtgagcaaaagttcaaaattgaattggctattcacccttaatttaacttcataagaaatggaagatctcatggatcaatgaaaatgtataggccacattcgaacctatgacggacggaagattaagtaccaacgcataaaataagagtcactgatgttgaggtttaattattttaaacttgaccaatgaatttatataatattttaaaacaatttttatatagaaaattttctcacaaaatgtatagtttagtattaaaaaatgtgctaaaaaaccaaggtaaaatgtgtaactcaatgggtcatacttcattatccgagccaattaggattatgaatgcctacaactggttacaattaatttattattatgctgttgattacgcgcagttacgtgctggatttatagtctttgcttatgtcaaatgggggatttacgcaagtagctgttgtgtggaacggttcgatgagctgagatgtggtgaagacattgccagagtgccaagagttgacctcttctggagaagtgaagagtcgaaggaagaaggaatggtattgccttaaattctacttctaggcttttggaatataaggattttatagggttccacatgaactctgttttatttacatgtaatttgggaaaagaatgatgcattcaaaatgaggactagctttggtaacagcgctttaaacagtttgtttgtcaaagtttatccaatgaaaagagttctagaaccgtgttcgtctcttaaggttcccaactttaccttctcattttttacacgcacgctttccgaattgctaaacggtgtgtttttcgttaaaaaatttatatgaaagtttctttaaaaattatattaatttatttttaaaattttagttaacaacttaattaatcatgcactaatctactgtttcgtttttcatgctaggacggaaggttcccaaccttaccttaagaacacacccgacatatcaaaagttttgcactgtcgcatactatttgttatagggtgtttagatccactggcaaatttttttccccgtcacatcaaatgtttgaacacatgtacagagtattaaatattgaaaaaaaaactaattacacaatttgcgtgtaaattgcgagacgaatcttttaagtctaattgcaccatgatatgataatgtggtgatacagtaaatatttgctaatgacatattaattaggcttaataaatttgtctcgcagtttacatacggtttatgtaatttgttttattattagattacatttaacactttaaatgtgtgtccatatatttgatggaactaaacacagcattaattgagtttgcattggttgagaagataccgagaaatattatggtttctaatgtaaaatttaatttgtagttggtgacaaccatgaaatgctgagatgatacttgtttccgaacttcagctgaaaccagggttcacaatttcgacgaaaaccggtcgaattccgcgaaatttcgaaatttcgacgaggctcgaaagtagaagccgtctgagattttgataagtttcatcaaatt

SEQ ID NO: 1165 - DNA, 1765 bp, Oryza sativa
tgctgctgctgcacgaggtcgtcgctgtagtagctcctcgtccggacggagcaggccggcggcgggggcggcggcgcctgcgacctcggcggggaagccggtgtcgagggcatgagacggcggacgacgtcgcgctcggtgtcgggggagagaggggcggggtaggggagggagaggcggtcgcaccagttgagtatggcggtgcggagcgcgacgttggggacgaggactagaggggaggaggcggagggcggtagggaggagaggtcggcggcgacggccggcggggagaaggcgagcgcggcgcacgcctggatgcaggcgcgctcgaacgtctgccccggcgggacgaccaccgggtccgccatcagcgtcccggagatcgggcagaggaactccgccggcgggtccgccgtgaacgacgacgacggcgacgacgacgacgaggacggcatcggcggcgaggacggccgccaccgtggccaggcggtggccatggacgcgttcgtcggctgcgtctcgtgtgattggtttgtttgcttggatgcgctgcgcaccgtggtttgtagcgacggctacttgtggtggtcgccaacgccaatcgctacagcgtttcaagacgcgccatttgggagacgatgacttttttagctggaatacttctagtaacaaaaaaaattcttacaaaaatgctttttaacaaaaaaaatcctttttaaatacagtcccaaaaaaattacgctcatattcgcacgcgcaaatcacccatacgattatgatgggttgaaaactcaaagggggataataaggcggtgtttagattaggggtaaaaaaaatttagcttgtcgtatcgaatagacggacacatatttaaagtattaagcgtagactaataataaaataaattacagatttcgcctatgaactgcgagacgaatttattaagcataattaatccatcattagcaaatggttacggtagtattatactgtcaaatcatgtagcaattaggcttaaaagattcgtctcacaatttacacgcaggctgtgtaattagttatttttcgtttatatttaatactccatacatgtatcaaacattcgatgtgacagggtgaaaaattttgccagtggatctatacaggccctaagttgcacaccataacgaggctaaccaatcaagttacgttcactttgttttagacagaattttggttcactagcaaatggtaaatttcatctaagataagggaacatgcaaatttatgtgatatcgtgacttgttgcaacttccaaaaataccttccagtaacataatgcaacagctaggccttgttcgtattatgacgtaaagttttttttttcataactggaaactgaaaacctccattattccatatatattctactagcagctgggcaaaaattaaaaaatagaaataaaaactagcagttgcttctgtccgtaaacgaattgttgtgcacgagctctttgatagcgatagaatttagcgacagctgaggctgagcttatggcatggaaggcacgtcctgggagaaaagcatcaaagaatccatatgatccaaacaaaatcggtcaaacaattcccttcgattttaaactagctttgccttttttaaatttctcgatctccttttggccactttttgcgagtggagtgatggctcaaaactgcaaagtatgcttacacttaactacttaagctgtgtctttgcgacaggatcaggttacaggcaaagaa

SEQ ID NO: 1166 - DNA, 2280 bp, Oryza sativa
  unsure (1)..(2280): unsure at all n locations
nnnnnnnnnnnnnnnnnnnnnnnnnnnnnnnnnnnnnnaagctgagaaattatttaggaggttaagttcttcaaggagatagtctaaaggagtaaaatggactttttctcaacactattaatcttctaatgagtgatcttttgagtttagacaagcactagttgaaaaatatataatcatagccggttaggcgtgctcaaaagcaattgagcattactaagcggcccaagagtggaaatcagggttggttcgtggcaagggccgacggtgctttcaatggttcataccttccgtcttcggctcagatggtccagagtgcagactcaattatactttggaccaccctaacttttatttttctccaactctaacacatcaagaacctcaaacacagcagctcttgcacaccaaggaactctcccatgtgtgccttatgcccacgtggagaagatgttggatgccgattgataaaagagttgagatggtccgtctaaagtacaataatgataaattctaaaaatgaaaatattaagtaaagaatggtccaaaatatacttttttttcaatggtccaaaataaagtttgaagcaaaagatgtcgaccgcaatctagtcttgcctaaatgggttcccatcctctgccgttggggggagaacggcaaaggcgcacagttaaacgtgagggaagctacagtgccgtgcagtctctacagtggaaaatactgtagctacagtgaaaaatatatattaattattttcatcgttactgtagtgtttaaactcttgcatccaaaacttgatccaacgggtataaatgcccccaaaggcatggcactgtagctctctgccgttccagttggaacggcagaggatgcgaagcctgcctgaatgggtagtttggttttctcaagagggagtctagtgcacggcattccgtccgaacaggataattaaatgacacctccacctccccgagcaagatatggataaggatcaaagatggactcggctagcctgacgtatcaatatgcatggctttcacaaaaatctgcacataggaattaatggttggcccccacgtgtatctagcgcttctccttgagtttgtaggtcagaacaagcatgtgtagtgcatcatcaactattttattaccacgctattctactagtactaactagattgagacgatttctaataggtatcatatgatacttgtgagatatcaccggtgatatttatcatgtatcagacgattccaatcaggtttcacgcgatttctaccaggtatcaggtaatacttgtgaggtaccacttgatagatatcacctgataccggttaggtatcaggacatgatacttgaaaaatatcagaacctgatacatgtttttatccaaacggtgatacttattaggtatcagacgattccaatcaggtatcacgctatttctaccgagtatcatataatacttgcgaggtatcactcgatacctgataggtatcacctaataccggttaggtatcaagacaggatacatatttccgtccaaatggtgatacttatcaggtatcagaaactggtattaggactacccgatacatatttctatccaaacggtgatactcatcaggtatcggatgattccaattaggtaccacgcgatttctaccaagtatcaagtaatacttgagaggtatcacctgataccagttagatattaggtcatgatacctaaaagatatcaagaactgatacatatttctgtccaaacgggatatggtcttgtacaattcatggaatgagaacagcacaatttccaaagagacgaacgattaaaaaaatactattaaagtcccatgtcttctcagtgtgaacatgcacccataaatacactgatttgcctagctttatcatattgtattgtcaccaactcagatactggtgtgacatgtctgctcgtgtcacgtgcccacgagtactcatgaggattgcaggcctgcaacacacttagctgctcatgtccgcgtgtcgctggaggtatgattgtgcacgaaatcaggttgacttatgtccgtatcgaggaagtcatagaatacttcattaaactattccgttcggacggtatcccgtacaataatttttctcttttctcaaagcagggggaactacatttatcttcctgcttttgttcccttcttaccgtgtcctcctttttatnnnnnnnnnnnnnnnnnnnnnnnnnnnnnnnnnnnnnnnnnnnnnnnnnnnnnnnnnnnnnnnn

SEQ ID NO: 1167 - DNA, 1250 bp, Oryza sativa
ctttttgccgaccctatacgctagttgtgggtatagatgatcgaattttattataaatgtcaaaaaaatttcatcagaaatagtagttatttttgattgactagtaaaaatagagttataaatataactacattattaagtgggttttatagcgacttactgagcctactttaatgggcatcatcagggcactgttaaatacaatatcaatctagatcctctacagtattatttaatgcagtattgcatactccctccgtccaaaaaaaagataaaccctggtttccgtgctcaacgtttgaccatctgtcttatttgaaaaaattattaaaaaaattaaaaagacaagtcacgcacaaagtattagggcccttttgaatcaaaagatttatgtagaaatttcataggattcaaatcctatagtaaattttcctatttggccctttgattcaaaggattgaagctttccaaatcctatgaaattcctatggaatggcacattgcatgtggattttggaggaaatttagcaagagctccaacctcttgaaaaatttcctttgagtctatctctctcatccgattcctgtgtttttcttgtgctccaatcaaacgaccattcttgtgtttttcttgtgttttgcaatcctctgttttacacttcaattcctgtcagaatcctgtgtttttcctattcctccgttttttctaccatgcgattcaaaggggcccttaatcatttttatcatctaacaacaataaaaatacgaattataaaaaaatttcatataagacggacagttaaagttggacacggaaactcaaggtttatctttttttgggatggagggagtatgtagtagtgctcacttgtatatataggctcgaggatttatgaggctcatatgtatctagcattctagaggacctgcatccatcatatatctttttttaaacaactgtcatatatccttgatcaattggaaatggatcctctgccgtagcaactatctacggaggttttacagtgtccgtgcattaggatgcacgtacacctttcgatcagcaatagatgcagctacagtaaatcgcatcgcccgtgcattggggtgcacgtacaccgttcgatcggcaatatatgtagctacagtaaataatgctatagtggtctaatgttgtatgcacgtttttctgcaccttaacagtacaaatcgaggaaatagatcatgattagctatggtcttagcttcaa

SEQ ID NO: 1168 - DNA, 2976 bp, Oryza sativa
cccgccctcaccctcaaatggggccccctcattcgatccttctggcatcctagtcctagatgaacgcgtctcgcggggattcgtgcgagataagataaattataggagcttatttactgtttagtgaacttttgagggatttgggggcgcatttaatcttgctagccattcttgtgtggagattggttcttctttttttgctttgctatcaatgttgcaatggtttcagaagttttccttgcaaattgaggcaggtaccacccggacaagaatggcgatgatcctgttgcatcagacatgttccaggaagtcacattctcctacaacatcctgtcagatcccgataagaggcggcagtacgacacatcaggatttgaggttagttcttgcatgaactggtaatttttaatctaccatgttatggcaactggtgcaatttgttcaggccatcgaagccgatagccaggaattggagctggacctatcgagtctcaataccgtgaacaccgtgtttgctgctcttttcaggtaaaaacattttactgatgttatatttcttttactgtttgctactagcttgttatgctgctttttttttcttcttaactgtgcgtacgtatgtgcagcaaacttggtgtgccgataaagacaaccgtatcagcaacagttttagaggaggcattgaatggatcggttatggtttctcagctccagcttggaaactctgttcacaggaaggtaggtaatggcaactagctgtccatcatccaatgcttcttttcttgatgttagcaactaaataattgaaagctgcatgtggccaggtggaaaagcaatcagctcatttttattctgttgacataacagaaaaggaagctaaaatggggttagtttgtcgtgtgaaatcaactgatagaagcaaatttaaggttggtttttgttagcaaatgttttatcatgtaacctgtgtttcgtaagtacatttcatgcggttctggtgttgtcagttctgttttaatttattttgatctagacttgttcaagttgtgtacatttatcctgcgtagtgaagctatccttgtttgacaatgagaaaatttgcccttcagttggtgaaatttagatgatttacttttgacatatagtactccctctgtttcatattataagtcgtttgactttttttctaatcaagtttgaccaagtttatagaaaaatatattagtatattcaacacaaaataaacatattatcaaaatatattcaatgttagattttgtgaaactagtttggtattttgaatgttgctaattttttctatgaacttagtcaaacttgactaggaaaaaagtcaaatgacttataatatgaaacggagggagtaataaacaatggtaacctgtcctttaaatgcatgttctgtgtgatcaataagtactggctgtgctgcatatatagaataatcacacctatggtacaaaaaaatattgttttgttgtattcacttttggaagggttctttgagagggctctgataatgaaattattttgatctggcagtttaaatgatggaatacaacatgcatcatccacatgtgtttctgtaataattatgtcagcttttgtttatcctgttatctcatggctttgataaagttgagtcacacaatgcttagcatgtaaaacatttattcaatactattgattgaatacataaaattctcttggtttaatgtccttttcctttacttagacccttaacattgttattcttgcatacaatttcagttgctttactttgagcttgaagaaaatggtggcctgagccttgctttgcaggtaagagtgccagaatcctgttcttctgcacataaatttaatcagctttacatctgagcatgtagaggttttggatagagattaaaaccctgcctacctcaaggggttgcgcgcaatccctatctaaactatccattactaagaaattggtctcgctatttaaacattgtgtgtgcaaaaatgacttaaaagttagcttattatctgcaaaattatcatagtttcaactatgtagcaatataaaatgctgcatagttgtcagtcctgcagattcacaaacaagtttgagtagtcctatactcttgtctattgaattcgctattaaactgtaacaccatgtaatgagcaaaccggtgaatatgtttttgctttgacaacctttgcttcatgcaatatgcaagtggcttaagtttgttttctcttgttccatctgcacaacctttcgcaggaagacagtgtaaagactgggaaggttacttctgctgggatgtattttcttggctttcctgtgtatcgttttgaacaaaacaacctggtgagtttacatatgtgtcatcgttgttgaatcctccaagtgcttctctgtgattcatttctcacaagttccttttaatttcaggcagctgctgcaaaggatcctgatagtgccttctttaaaagattggacagcttccaaccatgtgatataaatgaactaaaaccaggcacacacttctttgctgtctatggtaatcactttgtttgttggtgcagtgtcaattacttaagacagtacgaatccccttaaactctacgcttcactcaggtgacaatttcttcagaagtgtgaactatactatagaggttgtatgtggtgaatctttccctgctgaaaaggagaagctccagagtgttgaggcaaagatactcacaaaacgagcagagctatccaaatttgagaccgagtacagagaagtatgtggttgctgcctttccccttgttttccctcacattctttctatgcactgggcgtcagctgtcaacatttttcatattccgagattcacaggttttggcaaagttcgctgagatgaccagcagatacacacaagaaatgcaagcagtatgaacaatactattgcatagtcatttttgta

SEQ ID NO: 1169 - DNA, 1510 bp, Oryza sativa
catcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacgggacgcaagtgtactttagggatcgatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggatgactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgtaggagaagatgcgtgcggtcatgcgcgtcttctcctgtcgcagcgccgtggacgtcgtacctccagctggtccggtacaactacggcctcgcgcgcctaccgtcggagcaggacctcg

SEQ ID NO: 1170 - DNA, 9966 bp, Oryza sativa
  unsure (1)..(9966): unsure at all n locations
tccatcctcgcaggacctcgtttgccttcgagcgcccctagcttcggatcagtgcgacctacagcaccggtttcgcacggacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgagcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccaactcacgtactcccacgggcacattagggcgcagggtaggagggacaggggtaagaggcctcgtcagtagtgttctacctcttcagtccttatgtgactgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattgataatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaatttcgttgacggccgtcgcccgagagcgaacgggcgtctgccacgtcattttcgccgccctctgggagggcgatttttaaaaatcgccttcccagagggcggtaggcgagtacttccgtcaattttcaaaatggaaaattatttttgtaaaacttttaataaaaaaaataaaaaataaaaaaaattctgcaaataaacgtgtgtgggcattaaaccgaagaaaattttcaaaaataaaaatgtttaatttgttcgaacttggtagatctcataagaaaacttagtaacagaggagctctagctgatgaccgattgctcaaaaaattttagaatacaatataataagtaagcacaatacatatattacaatttgcaaagtccgtagcccctatacatatactagacgccttctcttgcattcctcgtcgaagccgctggcatgatcggcttgctgagcggcacacgcaagcagaggcctcttcggcgccgccaccgccgcgtccatctgttccatggcgtcgtcggcgaggacctgctcggccagctgcgccacggcgccggctccggcgttggcggccgccacggttctcttgacgcggagcatctcccggaacgtgcactcgtcgccgtgacgcacctcgaagtcgttccaccgcctccagaagtcggggtgagccgtcgggtcggtgaagccggaggcgtagacgtacagcgcccgtgcacggtgggcttcgccgaggccaatctcgaggtcggcgaactggaggcagagcaccctggcgtccgcgtccgggaggccgccgccgtggaggatggcctggtggtatatctccctcgccttgagtacgccgaacagcgcggtggcccgtgcgacgtacgcctcgtagacggcgagcttgtcgccgccggggacggcggccgcggcctcctcgtacaccttcaggacacgcttggcgaggccgaagtcctcctcgaacctcgcgtactgcatgtacacgncgcctttctcttccgccggcgcatgccgaacggcgtcgtcgacagtgtccctcaccgtngcggttttgctcgcccggtgcctctcgacgaactntgtcaggtacgcggcccatattgcctcgtcgtgcgggtacttgaacgtcctgacgccgcgctcgtagacacggaacgcgtcctcgaatcgcttgtgctcttggaggagggaagcatggcggagcaccagcagcggcgtgatgatccctagctcgtgcatcctatcgtacacggcgcaggtggattccggcgacccgtgcgtctccatcaggtcggcgtagaagcaccacagcttgagagaccgatgcagctttgtttggacgacggtctcgccgacgccggcggcgacctgcctcctgacctcgagcgacggctctgacgtcgcctgccgaatgagctcgatggccctgttggcattgtgctgtctcagctccatctccgcccactcgcaccaaacggcggcgaggtggtccgccgccttgaagctcgcctgcgtggctctccgcaacacctcccgcgcgctgtcgaggaggccgcggtcctcgtacatcttggcgaacgcgagccagagcgtgtgcggcggcggcttccccgtcgccttcgccgggtcgacggtcttgacggcctcgacgtaggtggctactttcctcgcggggtcctcgtcgaacagcttggccctcgcgtgccacgcctgcacgtcgtgcgggttctgcctgagctgcacgcggttgagcagctccggccggcgttccagaagccgctcgagcctcgcgagcgccatgtcgccgtcgtcgcggtcggccagccagcagccttgaccgagagtgttctcctctgcgtcgccgtgctccccgagctccacgtcaatcatggcgttctcgaagtgcaggtacgcctcgaacaccaaccggaagtccttgacggtggtcgccgtggcgacgccctcctcgaacacgtcccttgccttgccgtggagacccacccgcgcgtagtggccggccaaacacgtccacagcgcgccggcctcgtcggggaacctgcgtacgctgccgcggagtatggcgtcgaccggtagcccggcgacctcctccgggtgctgcgcgagcaggtggcacagatcgagcaggagctggcgcttggtcctgcccttggccgagacgaagcagtcatcgttgacggccgcggcgaggtgatcagcggcttctcgccatcggccagcggagacaaggaaggcgatgaagtgctcggcgtgggcggggtcgaattggaggtggcggcggaggacgcggatggcggtgggaacggggcaaccggggagggaggcgaggcggaggaggagcggccacatgcggtggtgctgcgtgacgggcagcgagcggagcgcgcggtcgagggctcggcgagcgcgggtgaggaggcgctggtcgaggagagccgagaagtacatgtgccacacgcgcggcatccgcgacatgcccgcggcgagcgagcgctcgaaggcggagttgagggcggcgtgggcgcggtgggcgacgggcatggcgcgcgcggcgtcggcgagctccgtgaggtacgcgtgccacagcttgtaggagcccgggagagcccgcagagcgcgctcgtagatgaccgagcgcttcgccagcggcgccgagcggatggccgacaggtagcgcgtccagcaccgtagccggaacggttcgcgcaggacgtcctcctcgtatggaacgtcctccggcgagatcatcatcgccgccaccatctctctaactcttttgactgatgaagggccggtctatcttctcttctcgtctcgtctgatcgttgcgttgcgctggatttggatgggcgattgtcgacgaggcggcacgaaccccagatttatagagaaggatgaccggtacgagcccgagtcggtttccacttccagcattccgcgtgaacgccagaagcccagaagtcggtgcccccctcggggttgcgaacaggagtcgtactccgactcgctggcccatgttccccgttgccccgctcgtcaagtcgtcattgggcagtacaaatatcaaggcaaaagccctgctaatcagctaatgtaaaatcttattttaatcttatcttatcttaatctatacctacacctatacctatacctacttttttaattaaaaaataagctaatttttcatccgtcattaaaacatgggcccacgcgatatttcaccactaagagcaagtttaatagtatagctaactactagctctaattcatttatagccaatctaacagctcatttatacaatagttatatactacactattaatatctggtcccacttgtcatacacacactgcgtcttggagtccgtactacagctagctacaaatctgtagctcgctgcccttctctcttctcatttatctacttaaaatatatttgcagctggcttatagcctgctattgtacttgctctaatccgcgagtccagacacgtgacagcgatctctaagggagtgtttggcaaatgggaaagggaaatgatttcccacccatctttaaatcttaaccattcattctcccttttccatttaatcctaacccttcattcatttcccaatcccaatctcaccccctattttccattatccaaacacatcctaacgctctgcaaataaaaagaggaagctggcaagtagctcggccaaagcagaagcagaccggcccaacaaaaaaacaaacatagcccagcagccagcccacggagcagaggagtagcaacccagcacagtactgcgcgacatgtagcaaccgagcattgtagcacgaataataccacctcacttatctagcttgggcagcactagattaaataggaggtttgccagaggctactaacactgataaagtttggaaccatgctgtcgagcgagcgattgctcggacaacgggcctagatcagtgcatcaaagcaagatgtttttgttgttttccctagatcagctagatcagtgcatcaaagcaatatcagatccctagatcagtgcatcaaagcaagatcggatctgcttgcacggcgtgtacggcgtagaaagataacaaagtagatcagtgcatcaaagcaagatcggatctgcttgcacgcctatgtttttgttgtcttcccaaggtcagtgcacggcgtagaaataaagagatcaaaatatcaaagcaagattggatctgcgggaccctactcctgtgttttgttgtcttccctaaatcaggttttgttgtcttcccttgtgttttgttgtcttccctaaatcaggttttgtccccttccctagatcagtgcacagcgtagaaagagatcaaagcaagattctgtgtttcgttgtcttccctagaacagtgcatggcgtagaaagagatcaaagcaagatcggatctgcgggaccctactcctatgttttgttgtcttcccaagatcagtgcatggcgtagatcagtgcacgacgtagaaagagaagatcagtgcacggcgtagaaagggatcaaagcaagatcctgtgttttgttgtcttccctagatcagtgcacggcgtagaaagagatcaaagcaagatcggatctgcaagaccctactcctgtgttttgttgtcttccctagatcagtacacgacgtagaaagagaagatcattgcacggcgtagaaagagatcaaagcaagatccagtgttttgttgtcttccctagatcagtgcacggcttagaaatgtgttagtgttttgttgtcttccctacatcagtgcacggcgtagaaatgtgttttgttgtcttccctagatcagtgtactcctgtgttttgttgtattccctagatcagtgcacggcgggaccctactcctgtgttttgttgtcttccctagattagtgcatgacgtagaaagagatcaaagcaagatcggatctgcgggacccgagctccgactagggagacacaggaattatgcaggttcagccaaaggtgtaataccctactcctgtgttttatgttggtgtagttgtcttccctagatcagttgaatacaatacaggttcagccagaggtataatattgtactcctgtgtgttttgtattggtttagttgtcttccctagataaggaattatataggttcagccggaggtgtaatgcctagtcctgtgttttgcgttggtgtagttttcttccctagatcagctaaatacaatacaggttcatccaaagatgcaatatcctactcctgtgttttgtaatggtttagttgtcttccctagatcgggaattatataggtttagctagaggtgtaataccctacttgtgtgtttcgtgttggtgtagttgtcttctctagatcagctgaatacaatacaggttcagccagaggtgtaataccctactccatccggctgctttatttaacatgactgggtgtcgtcgcgcgccatcatcggctttgtctatcacccgccagcatgccacgcggagggcgggtccaccatgattcatgggtattcagttgaatacccaaaatttttgacaaaaaaaaattcatatatgtaatatatatttcatatgtatatgaaaaaaaatatgtaaaatagacttgtttcttcagagaagcccgacttagcaccatcccatcccacctccgtcctctcctcggctggtcggcccattggcccaatagcccatatcagcaaaagggaataatgaaaccctaacctctccttcccattcgatcttctccctggcggcctcccgaccctgattcccgactcccgacggcgcacgggcacagcgacagcggactagcggaggcgcgtcggggtcgcagcatcgcctcccaaccccgatggcggcggcgcccagctggctgccaagctgctgcagctccacggctacccagtggccacgcccgcgcccccgggctgccgcctgccgcgaagggcgccatccgcccatcccctatggcgcccacgcgccgccgcccctgtgggctgtggcgcccaagtgcccacgcagccgcgctccgtgctccggcctcctctgtcctctccaccactccaccgcgccaaacgcccagacggctggacccagatgaaggtaaaactggttaggaacattttggtaattaggttcgaataggatttaggagtttcggatttatagttcctagttgaatccaggatggttcattttatttaggatttgaatccagccatacagggatggttcatggtttatggatgaacaattgaactttgaaacttgtgattcactgatttgtgaggctttgtagcagagttagtgcacatatttagcagagttagcatggttaatacttaaattagaagaccgtagtgttgttttgtaggtttgaaacatgaagaggaaagtgaaggataaagacatcgtcacttattttcaaaatatcaagaaacgaaaagtctctctaaattgtaagatttcttatcatttttccattttctatgctttataaatttgacatgttttgtcaattaatactttagtactgtactttaaaatatgcttaacatatttaatttatggtcaattctatgaatctatgactttacaactcgttcgctcactacgaagaaacatttcatctagttgacttgaaccccattcaactcaactcgatttcaggttttgaataaatccctgatggacggaagggagcgggagtcagctcccttcctatgaaagacacgcatcatgcttataccattatatattatacaactattagactttgtgttggaaaaaaatatctcttccaatttcgaatacccaagttgaaaatcctgggcccgccccacgcctgacatcgcgaagtggcgaagatgtgtgtgcagactcaccgaaggagattcgtccctacgttttgccgtttggtgattctctgaggtgacaactgacaacaagtgagtggccctcctgtcacatcggatgtatagacactaatttaaagtattaaatataaactagtaaaaaactaatttcataaatgagagctaatccgcgagacgaattttttaagcctaattaatccataattagcaaatgtttactgtagcatcacataggctaatcatggattaattaggctacgaattagctcaaggttatggaatgtgttttgtaattatctatgtttaatactctaaattagcgtcaaacatccgatgtcacagggccgtatcgaacggaataatgtaccgaggagctaagcaatttcagaaaacaaaaacatgtgcatgacaaaaaggaaataataaattttaagtggcctagcaaaagtgcctgcgcgatgcaacaagaacagatttatgattgcaatcaaactccacatactccaataaattcaggtttctgtaattcttttaggtgatgaaaattcaggtttctgtaattcttttaggtgatgggcagcggcttcagtaattaatcaaactctagacaaaaaagtaaacaaaattcaagcataatcctcacagttaaaaccaaaccgagatcgaagctgtggttgtttatagggacaatttgaaccaagccacacaaattttgcaaaatttgtgatatgccaccctaaccccttgtttataatttataatatattgcagtactggtctattcattccactagagcgaatcaaaagatataaacagtgctgtaactgaatgcaagtttatgtaaggcagacaacttagggttataagaaaaatagcactaaatttcataaaaccccacctaatatgattcaaatctctactattataaaaatcaaagatatttttgccggtattttggtacgtcatccgtgtatgagtcggtttttaaattcgtttgcttttggaaatacatatccgtatttgagtcggtttttaagatcgttcacttttggcaaatacagaagaaatcatataagaaatctgttttaaaaaactcgcatactaacttgagacgatcgaactcctaactacagctcatgattttctaaaaatatatatccaagcgaacttccacagtgaattttatctttactaaaccatataacaataataaaattaaaatagacttcacccgttgcaacgcacgggcattttttttctagttacataaaaccataggaattttgacatgtgacacataactcagggaattatggtcctaaagtttcataaaaccatatcattaactattttgacatatttctatatcaaaattttataaaatagatgtaacattaatacgatggataatttgtcataaatttgagatgtgattgtacaactcaaatatgtattagatcaaatttaaaatgattaatattgtggtttgtgaaactttagtatcatannnnnnnnnnnnnnnnnnnnnnnnnnnnnnnnnnnnnnnnnnnnnnnnnnnnnnnnnnnnnnnn

SEQ ID NO: 1171 - DNA, 4909 bp, Oryza sativa
  unsure (1)..(4909): unsure at all n locations
nnnnnnnnnnnnnnnnnnnnnnnnnnnnnnnnnnnnnnnnnnnnnnnnnnnnnnnnnttttattttattatttttgctaactatgatgccacatcagcgaaaccaggcatatatactatcatgggacctaaattagaccgttttgtatagtttaggggtgaagatttctgattttatggttaaaggacttaaaaaaatcttgctggtaacttgagtaatctccggtgaacttattcctttttttttaaatgcaccggttacacttgcgaaccggtccacttgcgaaacggcttggatcgggccacaccggcccacaccctgcgtccctacctcgcactcgcgcagtctctccaaacccttgcgcccctcatataatgagccacctcccttcccggctactccgcgatggcgattcccgtcgccgtcggccaccgctgctgaatcccctcccgtccccctcactctcgccgacgtgcgctcgcgcccgcctcctcttcctctgagtcctctctcagcatcgccgctagagaagccggatttggccatgctgagccgggatggagatccaggcctgtgctgacttcaacgaggattggaggaccgagcagcaccaagtccaccgctgtgagcagcaacaagaaggcctgcgccacgacttcttgctccttgccatatgcacaagacatgctccgacgtagcggcgaaagaggtggtagtaggggaagtgcgacaagccaacaaatcggtataggaggatgtgctggtagcagatgaataggaggaaaaggaggaggtgctgggccaagatcacatggccattgacgatgacgaacctgcgaaatcaacaactccgtatcaaggcaagactcaattatttcaaatacttccagtttttgctatctcgctgatttcatagatgaatttaaggttgattctttatttcttttcatagatggcttaagatgcaggtcgctgtcacaacgtccggtgtgcgagacgggtaacatgaggtacacgtcttcagtgtaaaactgagacaagtaagaaacaaatatattcataatgctattcgactcaaaaataaacgaatgccactatataagctaaatatgaggatgccaattctccagaggtaatttttggaccataatcttgctgatactaagggaaacaaaatgcatgaactttcaaagtttcatgccaatgcccaggaggtcataagtaggccatgttgcaatgtatatcatgaagacatgatcaaggaagataatcaatatgtttacacggtaaaccaaacaaagaaaatactagatcgcagtttcatcagaaaaaactggacaagaaaagcagtagttgatcagcagttcagcactctattggcatgtccagttatcatcagatagtgcattctcctggattagcactggtcggcttacttagtacatgatacttctttctgttcaatcagcaaacctacaatatagacaagtacatataataagactacaggaacaaagtagttgcctactgatgtgtaaaaccctacaaaagaagacataaacatcctaggattagcaagggagtatcacaattcaaaagaagagtacctacatggcaagtcaataatcatttcagaaggtgaagaaagtaatttggacttatgggacatcaggaagagtactggcatcacttttcccgcttcatttttagctcatgggaatggactctaatactctgttacttttccatcctttgtgtagagcataattcatctgccacaagtgtcaaagtaatcatgccatcttatttttcctaagcatttcaccccaaatagctgctatgcggagcaaataatacaatctggactagtaccatgataatgaaagtgtaacagtttctggcagcaccattatgttttttcactaaggatcacaataaccattggcttcctacacagcataggtacctaatgcagtttgaattaaaacacaacaagaacaaatgattttaccactagcactagagcatcacttctgtatgagacatttcatgtctaatgtgtggattgggaacctatctttctttcttgaagttgatgaatgcagaggagagtaatcataccttttgttacccctgaatgtcttttactgggagttcatatcggcaaactggacaggtatgttgtgccaagagccacttcagtatgcattgcatatggaatacgtgttgacaagggaggcgtgcacatgacatctatattttgtagcaagcgtgcttttgcagatggagcattctgtgtccttctccttgcaaacaaatatcaggggaaggttgagtaggaaactccttgatgttggaaacgtccccattgtcagtaatggctgtccaagagcagctagcattcgaaccatggctctttcctcctcatcaaacaaagtgatgaggcggttcgctttctgatcattggccagtaagatttgaccctctatcatcaactcctcctcctcctctagagcgagcccagtaattggcgcaatcattgcttcccaagaaggacctcctatcacatactcatcctgaatggtatgaagctcaatgtaggacccctgactgctggttgtagctgtatcatcattgtcactttcattggcatcgccatcaatacacaagggaccctttctttggggtatctccaaatcaggaagtggaggtaatgtagatagtggctggtcagaggcatatatattttggccattgttgacagaagtggatgccaccaaaatgcgtgaagtggatggtcctaacggcagtaactctaaaatggtctcatcatcgctaaaagtagagccttcatcgctgctctcaaacttgcctgtggaacggaggaaggtaaagccttttctgtgacattctttgcctgtcacctgcaaccaagccaaaaatactcagtttttttaccaatgcaaaaaacataactccttaagcactagcttcttgattagtgcgagataaagaactactaaaaccctccatctcaataagccaaggctgaaaaataaactacaatgaaaaaaccccaatatcaactctaaaattaagtttcaaacttcaaattttggctgcggttgataagccaacaagcagatgatgagagtccaaatgttctaaaaacccatgttatagcgatttatcagcagatgcataccccagaaagtagtaagtatttttagctccatgttttcaaatgccagatgtggttattcataatcattatttgcatgtacaaagtgttctttgagatatgatgcagcatttgggggaaatagagatgaaccttatcatgatcgtctttttcatattgttcttcaaagagagacctctcagaatcagcattgctcacatttccattcaactcttcgaaactaccttctaactcaatgacctcactccaatccgtgacctgttggcctggaaaggtgaacatctcagtaacaaacttatgtatgcaacttcaaacacaattctgggacatcattatgtatgcatcgtgacttccttgcttaccttctcctgatgacagctcagagcacttcttaccatttaattctacagaaaccatctgctggaacttcctgcacaagacgaatattgtttaccttttgataatcaacaagaaggtcttataagaaaattttcacctagcaaagcaaatgcaaatggacataaaaaagcaaataatcagtgctactgactgttgaattgtttggaagcaccaaaaccaacttggtagtatccttccatataggtagtcaacctccatactaatgagtgctaaccatgccaaaaaagaaaaaaaaagaaacatctgaattctgaaagtaggtgttattaccacgagtcccccagtaacaaaaacctgaagcattttcattcccttatgatccttagttcatgcatatcaggaatttcgagatcgagacaatacatccattgatacccttatccaagccctaaactaaggttttaatacagactaacatatatgtttttagagtatcaagctggctccaagcaaagaagcaagagatgcagcatctgttgtagcaaatccaatgtgcaactatacaacatgcgaaaatcctcacagattcaacggcaggacaaacattgcttaccttatctttgtgtttaactgatccatctggctgatgaactcatccctgcaaggagcaagttgcatgtcttagctgtttgcaaccaagtattcaccaaaatgcattcaatagaccagcagcagggcaatcaacaaaactcccgtactcacctctcaatgtctcccttgcccttttggagacattatatcaaacaccaagagcgcagcaccatttcccaattgcaatgttacagaaacataagcaaatcagcgcgtcacatttaaacaaaaaaaaatcgaacagcgaatattactgcaaaccgcagatgaaaccccaaaatttactgaccttaagcgcgtccagatcagagcgcacctgcgatatttcctcctggaggtgcgagatcgtcgcctaaacgcaccgaaacgaaataaacccaatcgaatcaggcgaaactggccgtaatcgaggagagatgaggaagagaggtagagacctcgagcccgtggatggacaccacggcgatggcgacctgcacctggttcccgccgagctcctgctccgcgtactcccgcgcgcgcttcgcggtctcgagctccgccgcggacgcgtcgtaggcagagcgcacgccgtcgagccgcagcttcaggacggacatgccgcgctctgcacggaggccacggatcagcctaaccgatgacgcgaaacactggagcagcctagctcagcggcgggcccgccgcgaggcaggtcgg

SEQ ID NO: 1172 - DNA, 23167 bp, Oryza sativa
  unsure (1)..(23167): unsure at all n locations
nnnnnnnnnnnnnnnnnnnnnnnnnnnnnnnnnnnnnnnnnnnnnnnnnnnnnnncttcttgttcgtgtttgtggagcgccagcggtggcggcggcggcagtggagctgagtggctgaggtgatggagccaagggaccattcatgcggggatgatggtgaggtggatccagagggtgacatcaagctccactcctctcctccggcttctcgttcttccaggacctagcacacgagaacgacgagggtgacaaagaggtgcagggatggcggtggaggttcctcctcaccggccgctcccaattcaacaccacctcctaggtggccctcgtcggtgtcgacgtgtgccccgtcgagagcctcgactgcgagtacgacgtcactcattttcccttcccaattcgaggcacgcgattcgctacggtcatgacccaggtggcggcaatggcctcctcaagcatcgtagccgttcggcctcctcggttggagatggctctgtctcggtccacgccaacacccaggtcctgttccgtcgaaaccgccgaccgccctcccctgcttgagcttgttggcatcggcatcgtcgcggctacaaatagagcaagaggtggagagagagacagagggtggggggaaaggaggagcaacgaggaaggccgaatgggaaggggggggggggggagatgagagagagggaagaggaggaagaagggaaggagagagaatgacatgtaggccccacatataagtgggtcatataataatttggtgtgaatgataaatgggtcccacgtaaatttttttaattataataccacgtgaacctccaaaaccaccgaggaaatcaaactgttccggttttaatagttgggaaggttgagatatccagtattgtggtttagggatacgaatcagtttcgaccactagttaagagagtaaaaaaagtgaacttattccactcgtgtagatgaagaagggctatgccatttggtagcccggagactggggggcttgttcacttcgttgccgaaatcaaccatattaaattttggtaatgtcacattttagcacatattggcattttcaaattttgatagtgttggctttgatttgatagagttttaagagaggaagcttttagaaatatcaaaatttaataagataataatgattgaagtgtgttgagtttgttgcgttattaaaatttggtaagattgcaagcggcgataaactgaacgggtcctggagtccttgacggcagtgttgccgccttgccggcggccagtgagccggttccaccgacaacactccaactaccttataatatacaatgtccaatctctataggagcgaatttcagattaggttatttaagggctaagttttctgtttgataggctatattctaagttaaaaagattgtatatatcatctagttggatgtagaggctgggtaaaaaatacccttctcacaaagaaaattgatacacattgtctagtggcattcctgtttgggaaatagaaaggacttccgtcttttccagctacaggcaacctttttccttaggccttatttggttgcttgggaaatgatctcaaggggaacctatccagggagggactgagtgaatccctcccatatcactcaatccctgcggggttcgaatccctgcccgtttctaatccctgtcatagaaaccctgctttcgtttagcacggggaaaaataaggcagcagctgtacgttcccaagtaagcaatgaaccaatatgcattctcccagatcaaatccataggacacagtaaaaaaaaacattgtttagcacagggaaaacacacatgtatgctgtacgttcacaaatgcatacatgaaagggtcacaaagtaatcaaaatggttacaattcagttgtttttttagaataaatagaactagccagctaagagctaaactacaaattgaatgcaagtgtttaagcttagcactaatgccaccatgagcttcagtcacccagctgcagtgttcccatctctggaaaaaaaaagggaacaacattggatcaattccaaaaagaaatacaccatatatgttctttcttgtcaaccaaatatcaaattgaattaatgcagagtacagattacagaagagcagacaagtaaagaaaagagccacacttgatatccaaactaaggctgatgcactacatggaatgctaacagtctgatagaacaaaagatgaaaagagacttgaaagttcatgaactaggaagctaacaaaaatacagttaattggcttttgtttttctggaacaagcactactttgtaagtacagctatacaagtgtgctccagtttcacaacaagaaatggagataaaagaagagaaagcagcttgttcatttcttcagttagaccaaaatttacagtgaggactgactgcatttgctgtctgaatctggcgacaacatgatacactacggtgaaaacgatgctcttaataggaaagccctgcaagtttcatcttctatttaagtttcacatatgtaaggttcaccactaaagtatcatcatggttccttgtatcaactaaacaccgtgacattctgaagtttgagcaagagctagctatagataaacacagaggatcctaatccagtacaaatctgattgattaatcaaatatatatcacaataaactaatgactaataaaaaacaactcttattagcacttcagtgctcctgctgatcggcccctagacagatatatgtatgctagtttcactttgatgctattaagcttcctgtatttgttgacaccttattaccagcaaataaaaaaggaaatctctgcactgcaagtctgcaactatatctacatgactctgaatttcttcagattttgcaatcttgagaagaatcaagttcgaaccctgcaactttggaaagtaaaagaaagaagaaactcctctgtactgcacctgcaattgcatgactctgaattccttcagatttcgcaaacctgcaactgcaactacatctacatgactctgaatttcttcagattttgcaatcttgagaagaatcaagttcgaaccctgcaactttggaaagtaaaagaaagaagaaactcctctgtactgcacctgccattacatgactctgaattccttcagatttcgcaaacctgcaactgcaactacatctacatgactctgaatttcatcagggttttggcgagtcttacagagatgctacgggccaagaaccaagaaccctctcctcctccttctcctctcctctccggcgtccaagaaccctcccgtgtcccggcgccgccgccggatctggacaaggacaaggcgccgccgaagccgaagccacccaagcccaagcccaagccgcccaagtcggagccggagctgaacacgcggtcggcgtcggcgtcggcgccggagcacgaccagatggccgggccctacggcacggtgcgtgcgacgacaggaaagggagaagagaaggaaaccctaaccctaaatttgaaagaggaggggaaaggggggaaggaagcgtgctcaccggagagaaggtggcggccggaggagagagctgtgcgcctccggatcgcgccgctcccgccgtcgcgtccgggtcttcgttgcgccgccgctcctctcgaggaatttttccgctcctctggagagtaggtgattttttcccgggcggacagcacagggaaaccccgtggtgggccgggctaaaatttacgctagggcttaaccgaacgtacaatttcatatgggccgagattgtttcctcgccagggtgatccatggggattggaccttgatcccagccgttcccggcccaaccgaacaaggccttacagttttgtaatagcctggaaacagtgctactatggctccgttcaagtttactgcagtaaattaagtacgggcatgaaaagaaaatcattaacatataattaattaaactttagttactttaaacataaaaatagatttatctaatattttaaaaatagcttttatataataaattttctcatgaaatatgccgtttaatataatttaaaaaacgtgctaacgaaaactgaagtaacatctgtatctagccgggcctgtggtctaatcctgaatacgtggacatcacaaaccgatcctcacatggcctcttaaattcagcacagtacaattgaatatagcgtcgtgtatctacatccttgatgatcttgacgacgtcggaaagcgattcttgatactcaagtacgagatttatgaatcctcaattctcatgtcccttgagcagtacgtggacttctgctgttgccgactgaattcttggcattcaattctcaactgatcaacctaattcagctctcacatcaccgccggccacttggagctgcaagttatttttcttctattccacgagctagcttgagctcgatcagtcacatctggtatctcgagtagatggagaaattgtgcgtcgatgggggaaaatgtttatgggaagatccaaaattgccatatgcctgtggctgtgtgtgatttcaggaaatctatatgtagttattgacttttttaggctatagcatataaccatcaattttattgaaataactataaatattatttattttattatttttttgcggggattatttattttattattaaaagtgcttaagtatgagatattttttttcattaaatttacgaaccagatgaatgaccatacgtcatgtctaaaaattaacggcatcatacatattaaaaccattgagagtattttgtatacaatctcatcatttatacacaggagcgttcatacgtagtactattaactagggtcgggatcctggttaaattatttaattctagtatatcactaaataatctatctatttattatattattaaaacagttttgaaagaaggcactacgttcgctgtggggtctagaaactcccacattaatcggagaaaaagagaaaaatatagaccactaaatcatagtaaatctagatctcaagggttaagatttaatgcgtaaaattttggaaatatactgttgttccacataagcactatagaagcggacatgttagtatgatacaactcagattgagtatggcgtatagtagtagcatcaggacaccagactctatttggaaaggaatataacttagcaaaacgaaacagaactagagtaggtttcatgtgaggcagcagtaaaatagttgtaccgcacgcgtataatcctatcattgtttttaacagtgatttacaccttccaataaaaattaacgggcacactaaaaactagcaaaagaacatgtgcattatcaccagatctagattgtttctttcttttgcatacgcgtataatcctatcattgtttttaacagtgatttacaccttccaataaaaattaacgggcacactaaaaactagcaaaagaacatgtgcattatcaccagatctatattgtttctatgtttcttttgcatattcttgaaaaaaatcctttaaattcaaaatacaaatgtaataaaaactcaatccggatgctagaaattaccacattaaccgtaggaaaaaaggaaaatataataaattctgaaattagaaaaaagttgaatacaatttataaataaccaaaatttgtaataaaaaaataaagactattgaaagaagagaccatccagaacacatgacgagattaattaaaaatcagaataacaaataaaataaattttgaaaatagaaaaataactataagagttcaagtaggaatataattttgtaaataaaacatatcggaatgaaaatatgaaattttcaaaataaaaaaataaagtacatatagaacacaacgatgacaaatgacagatgataataaagaggggagaagcaatgtgcatgtaaagagttgagtggtgacggttgattgggcatctaaaaactactaacaaaactctaaatagaatcccaattatgattaaaacgaggaatgatggacaggccgttaaccaacatagtcaaggcggttggcgggacgcctaaaaggtaaaaaataaaagataatgataatcatgtttgattttaatatctcaatgacaacaaagaggggaggcaacgtgcagccatagaggagtacagtggtaaagctgtggatggtttagcgggacttctacaaagtaaaaaaaaaatcccaaaatgataattatgtttaatttttaaaatctcagtaacaataaaaagatgaggcagtggacgggtcataaagaagtatagtagcagcgtgtttgacgggacttctaaatattataaaaatgaaactcaacgagaaagtaaactctaaaaactatatggtccaatttttaaaggttcaaaacttttaaaaagtaaaaaataaaccaataataatcatgttcgattttaaaatctcaatgacaataaagataagaggcagcgggcaagtcacaaaagagtacagtggcaaagccgttaacggtttggcagggcttctagaaagtaaaaaatgaaggcaagcgtttgatttttaaaatgccaataacaataaagagagaaggcagttaacaagatgtagaggagtatagtgacagtatttaacgagatttctaaacattataaaaaccaaaacccaataagacaataaactctaaaagctataatgtccaatttttaaaggttccaaagagaatgaatagaagtagtggtagatcgatcgagcaagcaaataaagaagggatgatagaagtaaaacattagtaactggtgtgacttttaaaaactataaaattagaaacacagagatgataagatttggtctttcaaatcttaagacgatgagatatctatttaataaatttcaagaaaaaacatgttaaaaaatagataattttgtattgatgctagccgcacaattgtgcggaccacccagctagtttagataattaatatgtattggatcctgataatttttgttctgagtttgccctttttttttgacaaattgacccttttcgaaaacttatttcgaaactaaccttgccaaaaactttaaccaaaaataggccgtcggcttagcgcgtgtcagcgccaggcccattggcgctgacctcatgccaccgtggcggccgagccgatcccccaaccgtggcggagaaattgtgcgttgatggggggaaaatgttcatgggaagatccaaaaatgacatatgcctgcggctgtgtgtgatttcaggaaatctagatgtagttattgactttctaggctataacataggaccaattattttattagaataacgatattaagtattatttattttattgtgaattattttttattaaaagtattctcttcatccaaaagtcttattttatttttttacttttttcacataagataaaatatttatagttacatgcatccaaaacttaaatgaagatgttgtcttttcgttttgtagtgctattgatgaaacccgagtagctacatgtatgcgtatagtcctcaatcttctcacgtacatgatgagttaagcatgagaaatatattttgtgtttgcactaaattttcaaaccaaataaatgatcatacgtcatgtctaaaaattaacaacgtcatacaacaagagtatttcgtatacaatctcaacaaaccacatatacttgtactccgagcgatcggtggtggttaaagttttcagagtgaaaccattgacatttgcttcagtacttctgaaatctgacggtaacgcttgtggctgtaagctctggtacagaccgtacagtactaatctgggatggcttcaaagtctttacttgaatgagaaattaagtatactgtttatacgagatgctcgtacaagggaattgttcatgtttagtggacacatttattaattaatcagtattactctgctaagaaaacatcttacacgagagatcgatgctcgtacgagttagagaaatttgacttaaacaaaactaaaacagtttatgatatcgaacagagagagtagaaagtaacaacaactgctatacatatttttaaaacaaacaaaaaatatgattcggtgtttcatatcgatataacgggaaaaaataattacagaactacaggctatactaacagacactactatcaacagccattattatctaaaaaaattattatcaacgaggcgaaaaggcagttccagatatgaggcgccgaaaacggctatttgtatccaagaaaagtaagttaaataatcttcataaagcttcttttattatactacagcaaattgccaacactagatgtcaaatagaaattaaagtagtatctggacacgccatcgccaataacttttcatttgtcttgtgcctttttttcttgctttccgatcaagtgttcttgaaaactgcatgcttggttgttagaccatagaggcatagatcattgataggatgtatgatcaccgaccctttagaaccatcctttgttcttatgcaaaatcttcttccatgacatggaaaagtaaaattttcaagtaaacccaaacaacagtcatgtaaaagagagtaaaagagagggtaactttggttgtggatgtaaaggccgggttattaatctttttttaaaaaagaggttaatgttgaaatgtaaacgatcgaatacgggaaacaacattaacctcttattgtatagctcaaacccaccagagtttatattgtgatgccacaattatacgggatgcgatcctcttatttaagtccctgacaaatggattagagtaaagtcatgcatatgcgccagcatataactatatttctggatgagtaaacaattatagagggctaaaatttgaaaacaaaaaaaaaacttaaacaaaattttgctaagtttgaacaatatttgcctaattaaaaaaaaaaatcaaaactttgtcctcaaaaaacattaaaaaaagtaggacgaaattgtgagcggtaggccgtaaatgacccaccgcgctggcgcggcgacatataaacggtcaccctcctcagttcccaacgcgagcgccaacggcggcatcgcatcgcatcgctctcgtgtcgcgtcgcgtcgcgccaccgcccaccgccggggcccgcgacgaccgtactaccaccagtgcgctctcgccgccacgcggggccgccgctcgccgccagcaaggaggaaggaagttaagctttagttttgttctcggttctcgatggggaactgccaggcggcggaggcggcgacggtggtggtgcagcacccgggcggtcgtgtggagcggctctactgggccaccaccgccgccgaggtcatgcgcgccaacccggcccactacgtcgcgctcgtcaccctccgcgtcgccgaggagaagcggccgccaccgccgccgccgccgccgccggcgcgggccgaacggcgcggcaccggcaccggcacggtgcgggtgacgcgggtgaagctgctcaagccgcgggacacgctgctcctcggccaggcctaccgcctcatcaccgtcgacgaggtcaccagggcgctgcaggcgaagaaggaggagaagtcgaggagggcggcggcgcagcatcatcacctggaatccaagcccgccgccgccgccgccgtcgccgccggagttaggatcaattccggcggcgacgaccacacgcagctcgatgagaatcttgatcaggtttgtcacaatcttcttgctgcaagattttcatcatctcagctgttcttaccatggccaatttactcctataatcctactattcgatcaacttaattatactcctataatggaagcaacaatttgattgatatatgtgctaattgcataagtaaagtatccagaactcaatttctgagcaaaagggacagatttttgtatgtttgaaatttaaatttgtgaatttgcatgttgaattttagctctatgttccaatgcaattaatttctttcttttggttgagtgaacactaggagtctaggagtaggtgagcacatagttggttaacattctaaatttggagtatattatgaggcaagtaagttacttaggctattgctcaacccaactgttatttctatgtttagttggccaccctccttgtgacacactagtacctaaccaactaaccagatccattatagatatcatataatacctgatcatgataccaggaatatgtttagcaataatgtactcttaaacatgatataatggctctgtttagttatgtacttagtggacaaattattcccaaaccaagctttaaacaacaaccttgtgtgccataccatgatttcctcacaccacatggaaaaaggcatggatgggtggtttacttatttttctttcctgtcatctcctaaataaaaacatgcaagtttgacattctcttgtaagatgtcagatacatggggaatatggaacctactagtttacaagatgatagcagaaagtccaagaaaggccagacttttaatagtctaaaatcttgcagctactcctaactcctaaaaattaactattggtcatgaagaatcattcaacactaattctttggattgtaccaatttttgctttatctttaatttgatttgattccaaggtctcctaaactatataaaagattaacaaagtgccatgttctgaattctgattactcatctgccacccatcctattgtggtttgcagcatgacagagacggccaacggagcagctcggcgacacattctaggcatcgtcaatggcgcccatcactgcacagcatcgccgaagtcagaagctgacacgatcgtcagtggccggccagttgaactgatctgtgtttttagagttcatgctcatcatttcatcagaagtgcattttcagctgatgcgatgttcagtttggttgtgttgggttcagcatctctcaacagagaagaagatgatcagtagctctgaatgcatcatattcagagtttcagttagtaggtaccaagtcactgtaagaaatcaccaatcttactcaggccattttactgaggtcaagattgtttctggcttgggaagtaagttggtaccttaatttgcattgcatcttagagttggcacatacagaggggtatttattaatcaaaagcagggtgatgtactattatatattcagtttaagatgcaaagtacatcctttgcagatagctttttaaggattcttgtgtattttactgctgctctttgggtgccgaatttgtgatcattggatcgccgcaatcatagaacacaggagctggaatccgagctttatgtgttggaagcaagcatacatcttcagattcgcggcctattaggcctgcacatttgtatattgtttcctgcagatgcagttggtagtaagacaagtgctagagatttgccaagttaggtgccaacacctgaactcgagttcccctgcaatgaacaaggtttggtagttgaagaactgaaatgattgacagaacagatcatcaaagggacactggagcatcatgccatgtttgtacatgatgcaaatatgttctgttggggataattaccctaatctgaatttattttcctttcttgatgaatcctactctctcatgtcccaaacacaactttggtgtcctaaatcataatgctatcaggaaagcaagttcttttcgagctaaacctactcatacaatttccatttacaaataccaatcctaaaaagtttcagaagcttggatagcacatctgtccaaaacaacatgggtttgtggctgtacaacaaagcaccagaaaaaaaaatcaatcattgctggttggttggccggtacagaattcagtagatagaatgtgaaagaaagagctccaaattccatggcagagtgccacacaaatcaaggcacgtaaaaaaaaaagatgatgatcagtagtgcttgattaccaggttgaccaaaccaaagtcgcttttaactcctttatttttttccctctttttctgacggctgcatttcggaacgttggggagcttgatcgattgccttgccgatcgatcgatcgatggagattcagccaaagctgaaagagccacccattcttcttcagagaacgcacaaatcgatcgaacaatacccgattgattcaggctttcaaagcgtggcatgtggcatactctgctccaccgccactgccatcctccacttccatcaatggcggccggcttccgttcacgaatcttcgttaccaacgctgccgcataaaaacccacttcataattttgtttaccacttactagtataaaatttggaagtaaaaattaactaggaccatgacgagcaggacctttaggtgatgttcgtttctacttaagatgaaaaaatatacactgttctagcagtttggaaatcaaacaaataaaaacgaaaataaaatttacatcttaatcagaaaagaacgggacgttacgttcatcatatcatgactttccaagatcatccaacgagaatggaatggatcaacgacgacgatcgtgtcacgcggctctcgatccagcgcgcactcggggcttcttttgatgggactgacgtactccgcctttctccgggccgaaagggggagggagccggccagacgcatgcatgcagacgcagtgcgtgatgtgcgtgcgtgcgtgtgagatgggcagggacgaaagcgacgagaggagccatggattccactgggaaagaggagaggagggaggatatacgagagtgtgagtccgtcattggtctctttctttctcgtccccatctcttgttctgttgtcgtgcgcgagaggggaggacggaccgtccgtcggcatgcacgcgcgtgtggtagactggtggtgactggtaaaagctgccattgcatgtggaagagcggtttcaatcagcgttttatcagattgtaacgcatgcaaatgtaaaaaatttgaaatttgaaaatggttgattagatccatgcctttaaaaatatcatgttgaagaaaatgttcattatcatttatcaaaccggctgagtccatggatagcttatataccagctctcataatattttttttataaattgatttaaaccctattataataaaagaaatacatatagacccttaagcttcttgtggacccacctgtcagtcaccctcccttttcttttcttttttcctttcctaacccctccccctctgatcagtcccttcttccatatgttcattgacgactcctctcctccattctccggtcgcttctttgtccgcctcacgtcggttgctttaccatactggtgctgtcgtttccttgttctcccgaacacctcaatcaccattgctatcctctcctagtctccaacatctcccttctcagactatgcgcatcgtccatctctacctcaatcgccattgtgtttcctacaatcctactccggccaccgcgctccgagcggactagattccggtggttgagctcctagcaatatggtcatgtgctcattggatcaggtcacgaatatgatcaggccaaatcaaggggcaccgatggtggagtaaccaggttgattacaagacggtggagttgtctgggcaaaggtcctagcaacaaagcagccttgagcaaaggtcgcagtagaacatatcgacgatgagattggaaccacgacggcgagcaatggagctacctgagcatggcttcatcttcggaacgtttttccttgggaagccatccatagcttctctagggcacgcgtggtcatgcggagccactgcttcgcctgacgtgataagttggctcccacatggcctagcaagaccactcctcatgtccccgcattagggtatcctcagtgttaagatacaccataaccataaggtgaaacccacaaccatatatatttttactcgtggtaaatgctataatgtataacatctcttcttcaccttaaggtgtggcccaccaaggaaaacaaattgtattcgtccattttagcatgaagattcaaagccaacatacacattgaaaagatataaattaattttatatttcttatggctagctctaagcttagagcaaggctaataatacagccgacttgttggttataaggttctttgcaattttttcttagcctacaaatataatagttaactatttataattaatatagtgcccatttgtctctctcacagaattttttggttcttgcgtccaagccggctgtaaatttacagcccgcttctcctctctctcctctcttctctccatcacctcagcatttagccgacttacagcctcctattatacttgctcttaaggttagccatagccatatattctcttgtgagtttacttcccaatacataaagttatactacaaatattattttagtgcttaaggttaactttacatgcacattggagatgcccttatgcctttaatttttaaggtcacggtaaattttttgcagaaaaggagagcgcctggccggccaccagctcactgttgcaaatagtagaaactcaacaattttatgaaaaactatactagaaacttgataactgcaccacacctgcacttctcatcttttgcaaattaaataaattatcaccttcagcagttcagttagttttagtactatagcacattgctaagctggatcttaatcaatcagtgtataatcatccatcatcagagataatacctgccaaaggcaaacaccacaatgatacaatctacaaagccccaaactgaacagattacgcaaagatatctctcccatgataatatgatattatgcacagatccatcaaaaccacagtgtcatcacactatctcaatatatcaacaatcattgcctgctttaacactgaccaagattaggttatctttacgcaaagagctttgttttttcatagctagattagtgcagggattaaacgacacctcagcttcagtagcagctggggcaatgcatttgtctgggaaaggagtcgatctcatcgattgttcagatcatcttttaaataaatacatgtgtgtcacgaagctgggcttggctggctgcaggcagcagttcgaaatgcgcatcgagctggtgagcaaatgatctttgccactgtgacgacgacgacgctgctttacataaaggcaggacaaataatctggtaagaatttggggcctctctctgctgcttgccctgaagatagcaactggttgtcgtgttgccataggcaaaatttaagtagcacagtggtttaggtctaactaacacacgcatgcaactataaatatgtaatatgaagtgtcctgaatcttttcaagttcataggatggatggtctcctgaaaaaagaaaattcagagtcctatagttattttgtttacttaaaatgtactctgaataatgaaatgatcgacttacctttatggtgatctcaaacgagtacccctatctactactatttagtattatcatcgatataagtgatcttaaccgttaatttatcttgttagtacttcctccgtgtcaaaatgtaagtactttttaggttggtacgagtattaagaaagtaggtggaaatgattagagaaagtgtgtgattggttgagaagagaaaaagagatgaaacagaatgtttgtgattgaccccctatcgccgctccttttcatacttgcgattgacccccttcagcgaatccttttcaaggctacagagctcggcgcaatctcgaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcgcccatcagatgcggcggcatcgagttgaatgaggttcttgagggcatccctgtggtgagggcaagtttccccatcaagtacttgggcctccccctagctctgggaagactgtggaaggtggacttgcaacctatctttgacaaaatttccggaagggtagcaagctggagaggaaaaaatatggcagcggctggaagaactacgctcgtcaaatatgtgctaacggcgcaaccaatctaccttctgaccgctctgaaaatcacaaaggaatccctcaagcagctagacaagcagcggcgccgcttcctctgggcaggcacaggtgttattaccggagggaaatgcaaggtcaattggacaaagacgtgcatgccgaccagccaaggaggattgggggtcctaaatctggacaaattcacgagggccttgaggttgagatggttgtggcatgaatggaaggaccagaccaaaccttgggtggggctggagacgccatgtgatgaaatagataggaacctcttcgccgcctcaacaaacataacaataggggacggaaacacggtgcgattttgggagtccacgtggattggtgggcgaagacccaaagacctcatgccgcttgtctatgcgatctcaaaaaacagaggaaaaccccttcggcaaggaaaggaggaggacacctgggtgcaagatttgaagcttgattcacaatcatctatcacaatcgaccttgtcgaacagctagccgcactgtgggaagtggtccgaaatgtgcacttagacgttagagaaccagatcagattacttggaagttcacaaacaacgggcactacacggcctcctcggcttaccatgcacagtgctgcggggcgccgagcacaaaattcaattccttgatttggaaagcctgggcgtcggggaaatgcaaatttcatgcttggctcatcattcagaacagagtctggacttcagaccggcttgcgaccaggggatggcagaacaatggttgttgccctctttgccgccgcgagattgagacggcattgcaccttgttgccacttgtagatacaccaagaggatttggcacctcgtctctgcatgggtgggctatcagcagatggacccaacggaatgggaggaagcccagtcagtcaaacagtggtgggagaacattgcaaacacgcctagtgtcccgagaaaaggacttcgatcgctcattctgttagtcgtctgggaaatttggaaagagaggaatcggcggatttttgatcacaaataggtggcaacgaacttcctactaatgaaaatcaaagaggaggcgagcctttggggctttagcaggagctaagtggttgcgtgagttaatctcgcacactatacagctatagtggttctatagtggttctctgttttccttttacccctaggggtttgtattttctcctgctctattcaatgaaaaggcactctagtgctgtttttccgttcaaaaaaaaaaagaatgtttgtgattggatgagaggaagaggtatgtggagaaataactttattttgggacaagatattatgctagaaatagctatattttaaaacagaagtagtataagcatgtcactgaaaatggaggtcctactgtcctaggagtagtcctcctgagcagtgaaaaaaaaagtactactaaataatactaatcaggtttaactagctaaacaaacacaaatctttgacagggctaaacaaggggaggaagcttttgctaatctagtggtagctaacttgatcagccctgcaaagtgcagtgtgcccaatagtccaaagtgtcgtatcgaatgcatcctttgcttcactttcgcatcactttgcagaaagaaatacacacaggttgctgccctattggtccccatcgatttcatcatacaggtgctcctcttttaattttactctttttttttctttgagaaatctttaatcctagtctcgatccccacatttatgttcaaatatgtcatctttctgaattaagctacaaaattatcaaagcttcaacaaccacaaggatgcaaaaataaacaaataaatagctcatccaggaacagaaatcgccgaggaatgtaatataattcagactcaaataaaagaaaagaaaagaaaagaaaagaaagattcaatcttctccaaaatggccatcaagtttgcgccttttgctccgggaagatgaacttgttactgatgaacaagctgcaagtatcatcggatgtcgcttcctcttcctcgcagtagcattcagagctcgctgcagcagctgatagcaactgctgatcctctcctgtaataacaaatataaaaacattttttttaaaaaaaggatcatttcaaagttactgacgaactgacaaagttttgcaaactacaagatctttcaattgatcatgtcgtgggttgggttggtcaggacgtcagagatcaggttacttacctcagtcaggccaatgcaccacgaggcagctgattcagagctgacgctgctcctgtgcgacatggctgcaggcgactcatttactgcgaatagcaccgccgctgccgccattgatgaggcgcagtggttcaggaactcgagctctgttccacggatggcaacaagaagattcttggatcaattagcgagcattggatgcagcgagattcaaggacaagtttagcattagttgggatgtttaaggataattactagcacttaatttcaatatgtaattaatgatgatgagactcatgtagtttttcacagaaaatggtgcaagtactattattttagcagggttaagaaagcatctgatctcttgtcacattgaactgtcaccaggaatccaggatgttacaaatgtgtttggattggcccaggtagtggatgatcatttagccagctaactggttgattgaaatggaaatccaataatctccttcctatgtactacaacagattttggtaaagttgtggtaaagtgtggtcaccatccaaacaccctcttaatcctgacgcaaatagtgctacctagcaaggtccagaataccggtttggcaggaacaggcctggtgaaatttaaatgctaattttgaattcaaatctaaatttagaattttacatgttcccgaacagaatagttctatattcaagttttacaatatgttattttatttatattcgcatccttccgaccggtaactacccggggaactggttgccatccggttattgaccggtaaaaccaacagttttcgggaccatgacattgagtactcactactcacaccataactccagtgattcatcttttcatcaaagagaggggaacaaaaaagtacttcaatagagagtcaaagatgcaatgataatattattcaggcaatgaaaacaacaaattatatttcattgtactattttgcacctcttgacattggcatttagtttacttatgttatgccaccttttactactagtgatagtatggtaataaaattaaaatataatcaacattttgcttattttagatattttaactagactctaacgaaaacaattttgattattcatctagtatattatatggcatgcgaataaatgatcaacctatatgcatcctagagtaaaattttgttttctgttccctcaaaaagaaaacgttagcattaccatgaattgcactgagaattatttggcaagcacgcaatgccaagatccttgagcttcttccagaggagccaaccttacaagcgaagaaatcaacaaaggcgaaaggcgtcactgaccggagcctccaatccaactccacgaggacgatgagctccatcctctggatcgtccgaggttcaaaaatgaatcttgttccttcaatctgtttgcatttgctgaaattcatattcataacaaaagcaaataaagacattgagtactcactattcacatcaagttagttacctgaaggtcaaggaggggtggggcagaggactcctccatcttggcagccagagacaagcaagccacacatagcaattgggatgcccaaccatgatcctgggtgaaagaaatcaaattgcaataataagctagaatcagatgagtagagttcttaagataactggaaattcagctgtctatctctgcattaacaaagaatgcaccgcattctctgagcattgaggaacaagaggagatcgattaaaagaaatcttgttcgaagagaaaaatctgaagtataacatcaaatcacaaaccatgcaactgatcacaatgagaattgatgatggaatagtacaaccaacgacaactctatgtagcaattgcaagtgtggtgtacagagtcattttcagattgatattaactgttatgaacttacgactgacttggattctctaggaatttgcaaataataatgaattcattagtgtaggcggttttcttaagtaatcgatggtgacatattttcacaggcagcctatgaccttacaacggccccaaccttttctatagacgattataaattggagccgtttaagaaaaggaatggctgtggctttctgtagcagagggatcatgataatcatatgcaaaaatatgtagaacgtcgatccatgaaaaagtgccttgtcctacctcttaatcagggtagtgaccatgtagatcggggattgagaccaaatccaaatcaaaatagtgcccctgccaatcataattctcaatcttggtgtggtggcacacctgggcagaaaatggcatcaccggtcacatgcatgttttttgtctactaatgggaaagttaaaattccctgttgaatagacacatcctctgacagagaataatgccctactagccacctaacatagattcagaattccatccctaatgacctcaattaatttgctgctactagttgcatctgccaaaaacattcgttagccttgtgtgctagctagctaggtacttattccctacaatccacaataaaattattattctctcgtcctaaacaatcacaatcatcctttatatatttaattcatacacatgcttcctcagctcattaaactaatcacaattattttccaatttaattttatatatctccttagttactttgaaaaactcaaaaaagtatatatattttgggacggacacacaagttacttagaaattcagtaccattctaacccacatatcatcggcacataactatagtgcaagtgtgctttttttttactgcaaattctgccaactctgtactaagtatgtatgctacagcagcatagtctgatcaattgattcgtaatctgcagctaattctttttttaaggcctaatctctggctctctgcagtgcactgcgcttaatccagtaactagacacagctagagacaaaagtgtgggcggccattgatttaccggcaagctgcgagacgacatgaacctatccatgtagctcacggcgaggtacgccgtcgccggctggaagccgtggactgaccggacctggagaagaaaggcgagtgaaattaagatgtgcaagttaattagattgccatggatcgagctagctagattgcggcggtgctagctatagcttcaccttgaggatccaggagacggactccgaccagccgggccggtggacggctgtcctcggcggcgagcaagcaggcatgacgagctcggcaccgacgggcacgtcgacgtcgtagtcgtagtcgtagcagtgctcctccccgcctggagtcacctgcaccacctcgccatggacgccgtgttcgtcttcgtcttcgtcgtcgtcgtcagcggctgcggcggccgcggcggcgcacgacaatgacgacgacggcgacgacccctgcgccggctcgccctcgcgctccagctcgccggcgtcctcgccgcacagcagcgcgtcgacgtcgtcgtcgacgacatccacgcagcacactacgcccgcggaggacccgcgtgcgtcgtctccgacatgcttgtacatcatcgcgccgacgaacttagctagctagctagcaagaagacatgattgcgtcgtgcgccgccatttcaccggccgcgagagcgagagcgagagcgagctacggccgccacaaggtgcaggctgcgatgcgacggcgcgcgcgcgcgtgtgatggcgtgcgtcgtagcggtggagcagcggatcactgtgggcgatagcaaagctgagaattcgctggatatgagaactggaaatgaaacctgcaggatgcttggttttatttgtctgtcccggcagaacggcactgtacgttggctgagtgctgcctcttgcctcaatcctccttaaaaaggacaataaactcaaggctaaacacaagttatcaaagcctataaaaggagccttcacattcgagggtttaaagattatcctaaatttaatttaaggagtaaagattatacaaggagtcttcacattctagagctttctaaacagaatttcactctttttttggttggacttcagctctaagaaatggagctagagctgaagctgaagcagaaaataaagtggatcgtggagtagtaatagattttagataatggtcctactactccacatagctttttttgggagtagtagtaaaatctaaaccacttttttttctagagctgaagcaggaaatggtcctactactccacatatataactactagatttagactttgtaagttaaaataaagtggtttaaaattttatatatatttcatataaaatatatagaaaagtgtttatccaaatgttattaataacaaatttagatccatatatttctgaagtgtattggctctaaaaaattctgatctaaagttgtgccaaacaaaacttaattcatggagaaaaaaaattcacgctgaccattgatcaatcattgtggtaccaaattataatggcatagattgctcggattaatagatgtagccatgtaggtacaattgtttttatgaaaatagaagctaagatttatatcactgcaatgcagggcccataataaacaaattaatcaaaacaataaatccgaacgtacaacttacaaaactttctgttaaagagcatgcacctacatgtacataaacatgaacatcagggttatcctagcaggtaaagttgtacactccacttaaggccatttcag

SEQ ID NO: 1173 - DNA, 2466 bp, Oryza sativa
tataaaaggagccttcacattcgagggtttaaagattatcctaaatttaatttaaggagtaaagattatacaaggagtcttcacattctagagctttctaaacagaatttcactctttttttggttggacttcagctctaagaaatggagctagagctgaagctgaagcagaaaataaagtggatcgtggagtagtaatagattttagataatggtcctactactccacatagctttttttgggagtagtagtaaaatctaaaccacttttttttctagagctgaagcaggaaatggtcctactactccacatatataactactagatttagactttgtaagttaaaataaagtggtttaaaattttatatatatttcatataaaatatatagaaaagtgtttatccaaatgttattaataacaaatttagatccatatatttctgaagtgtattggctctaaaaaattctgatctaaagttgtgccaaacaaaacttaattcatggagaaaaaaaattcacgctgaccattgatcaatcattgtggtaccaaattataatggcatagattgctcggattaatagatgtagccatgtaggtacaattgtttttatgaaaatagaagctaagatttatatcactgcaatgcagggcccataataaacaaattaatcaaaacaataaatccgaacgtacaacttacaaaactttctgttaaagagcatgcacctacatgtacataaacatgaacatcagggttatccctagcaggtaaagttgtacactcgcacttaaggccatttcagcctttcacaacagtacaatcatttcggtaaacaccaggtttgggcaattggccagacgtacaagcatgtaattaccggctagtcagtacgtactgcccaatgacattagtgtgacggccgtatcaaacatccaaaatccaaattccatcaacttctgcgtacgagatgcaaagtttattggttaattcaagggtgtagctatatttatggcgccatattttttataaaaaaatagtcggcatgtatttacattgtaaatccctaaattacatatgtaattttagtgtatttataatgtaagtcttaaaattacatatgtaagtactaaaattacatactaattacatatgtaagtgactgaaaaaaaatcgattgtagcatatggcgccatatttctagcaactccataattcaatgagcagactgtacataggtgcatgtaaaaggctgcatccgtccatacgcatacaaaagaatgtgctccctccgtttcataatattctataatttagagtagcagtgcatgctttaatttgatcactgatatcttctacttactccgtttcaaaatataggtatttttagagcaggtacaatagcaggctataaaccagctgtaaacatattttaagaagataaatgaggagagagaagagcagcgggctacagatttgtagccagctgtagcacggactccaagacgcagtgtatgtgtgacaggtgggaccatatattaatagtgtagtatgtaactattgtatgaatgagctattagattggctatagatgaattcgagctagtagttagctgtactattaaacttgcttttaaggttggcacgagtattaaaaaagtaggtgggaatgattggaggaggtgtgtgattggttgaaaagaggagataggtgaagaagaatggttgtgattggttgagaggaggaggtagttagagaaatagcttcattctgggacaagatattgtgctagaaatagctatattttaagatagaggaagtaaatcgtttaatcatgatgaacgggattttttatatacttattgtataatatactttattaataatatagtatgttggacactcttacaaatttattcatgaaagtgaagtgagtgtatttagctagaatcctattcacctgggtttaaatctagaaatgacacgggtgtatgactaattgttctttcaatagtaggtaatgtatcattcgacagcgtgccatccgtggtgagttcatcaattttaagatatgctgaaacaattttttgaatgtgcttataggatagggtgtgcgtgtgtaagttcttaggggtgagttgcctcgtgatggcttactcaatttaagatatgccagcctagtttttaggaggtgcttatagaggtatggtatgtgtgagtgtgtttttaagggtgagtgtgtgtttgctggaagcgtttacgtttgtgccatgtttcttttaaaaaaatattcatgaaacaggagtagtcaaaggaaaacaatataatgtcatgaaacaaagtgggtatctatatagtattattttacttttagcgactaatccctttatcctagaatataagaaatttaaatggatagtacacattctagtagtatgaatctagacaatctttatgtttaaa

SEQ ID NO: 1174 - DNA, 1422 bp, Oryza sativa
attaatgcttgtatagtagcatgacgccggctatagctagctggtcgttgcattatgtgcggcgtgtcagtggatctgcaagcatgtgcaaccgtgaaaaatcaccggaggagccaccggtagtacgcttaatcatgtgattaatttttttaaaaatgtatttttacccggcctttatatccaactagattatgcagccatttaaatcagtggcggacacagcataaaaatttagctatggcggatcatcacaccagaacgaatattttaaaaatgaagtagcattttattatacacaaactataatatatgttcgcatttattagaatatatgctattaacgatgattataatcctaaatttgtgatgcaatttttacaactgacactttaaattcgtcgaataacaaacaatgattataatcttaaatttgttatgcagtttttacaactgatgcccttaaattcgccgtataacttttacgactaaactacatttccacgagtgttcccctgttttttaggtgtgtttattcataacaagtagacattcactattatttagcatttgatttttaccgattgttagctagactattcattcatttgtgcagacacaaggcagtcccactataggtctttacctccagttaattagacgaataagcttgtaccaattaaaatacagctaactaatcacataattagcatatgtaatcaaggctgagatggccatatgcttaaataccctatctattttgggcatggcataggtatggccggtgccatcccttgccacaagagaagatccgccactgatttaaatagaaaacttagcccctcaaataatctaatctaaaattcgctcttataaagatttaaactcagcactcttgaagtgctgcttagttcattacaaatactagactgcatgttctttcgcaatcatgtgattacatgtatacacacatgtgtgccatacccatatacatatatacaaatacgccactgtcacgatcgttcatttatgtcatgttaaagaaaatattctgaggaattattgacctggtcatattaaaggaggtattataaggattttagatgaacgccttggttcatctcagtcgaaaattttctatgatattgtttaggtatttttgttaaagaataaagaaacaaaggttttgacacacggatttactaacaaactgtctgcactaatttattcttacaagtggttcctttagagaccgttaacagaaatatattttacttcctccgtttcatactataaatcattctatcattttccacattcatattgatgttaatgaatctgtctagattcattaacatcaatatgaatgtggaaaatgctacaataacttacattatagaacggaggaagtacatatgatctaca

SEQ ID NO: 1175 - DNA, 565 bp, Oryza sativa
  unsure (1)..(565): unsure at all n locations
cgagctcggtacccacaacgccggcagtgtagccggcaggaaccttgatcctcatgtggaagaaccctgagccgtacatcaacttggacctgaatccagcacctgcatgcatgataattaatttgcatgatcacatcaagctagttaagcataaaatagagagagaaaagaagcaaaaactatgatcaagctgatctaaatgctgaatctaacagtgtcatatatataatctatctgtgtgtataccagagctcttgtccagggtgaggctaatctgcgtgccctggttgaccaggtggtagccgtctccaccatatgttgccacgtagttgtcgtcgaacaccgtcgccaccgccggcggcggcgccggcgccggcggcacactatccacggccaggaggaggacggcgatggcgatgaggtggaggaggagcagccatggcggctgcacttggaaaaccatatatatactttagccaatgtttgctagtactaactaattaattaannnnnnnnnnnnnnnnnnnnnnnnnnnnnnnnnnnnnnnnnnnnnnnnnnnnnnnnn

SEQ ID NO: 1176 - DNA, 648 bp, Oryza sativa
  unsure (1)..(648): unsure at all n locations
cccagaattgtgtttgaagttgcatacataagtttgttactgagatgttcacctttccaggccaacaggtcacggattggagtgaggtcattgagttagaaggtagtttcgaagagttgaatggaaatgtgagcaatgctgattctgagaggtctctctttgaagaacaatatgaaaaagacgatcatgataaggttcatctctatttcccccaaatgctgcatcatatctcaaagaacactttgtacatgcaaataatgattatgaataaccacatctggcatttgaaaacatggagctaaaaatacttactactttctggggtatgcatctgctgataaatcgctataacatgggtttttagaacatttggactctcatcatctgcttgttggcttatcaaccgcagccaaaatttgaagtttgaaacttaattttagagttgatattggggttttttcattgtagtttatttttcagccttggcttattgagatggagggttttagtagttctttatctcgcactaatcaagaagctagtgcttaaggagttatgttttttgcattggtaaaaaaactgagtatttttnnnnnnnnnnnnnnnnnnnnnnnnnnnnnnnnnnnnnnnnnnnnnnnnnnnnnnnnn

SEQ ID NO: 1177 - DNA, 955 bp, Oryza sativa
acatgtatacacacatgtgtgccatacccatatacatatatacaaatacgccactgtcacgatcgttcatttatgtcatgttaaagaaaatattctgaggaattattgacctggtcatattaaaggaggtattataaggattttagatgaacgccttggttcatctcagtcgaaaattttctatgatattgtttaggtatttttgttaaagaataaagaaacaaaggttttgacacacggatttactaacaaactgtctgcactaatttattcttacaagtggttcctttagagaccgttaacagaaatatattttacttcctccgtttcatactataaatcattctatcattttccacattcatattgatgttaatgaatctgtctagattcattaacatcaatatgaatgtggaaaatgctacaataacttacattatgaaacggaggaagtacatatgatctacaaacctaaggcgaggctaactatttagctaaacacatttcggctgtatgtgcaaagaaaaacctagctaggacatacaaaaatcgattttatagcagtgatcgatgcatggctgccactactacaacaacgatctttccgtgtgttgcaaactcattttcacgtgcagtagtttcgctcgtctggaacccaacgtctacgaaaatcatgatttttccgtgctcgcacgccgcacggtaaaataaaaaatcaaaaaaagagaaaaaaccaaaaccctaaccataatccagccatcgccccgcgatcgccggcgacggatccagacgctgggagaccggtgccgccactgccatcgtcgtcgcctgccgccgccgagctcgccgccgtgcgcacgccgctctcggtcgccgagcccgctgctcccgcccgccagatccgggcagcttgggaggagggggagagggagatggagatgggaggagggaggag

SEQ ID NO: 1178 - DNA, 13465 bp, Oryza sativa
  unsure (1)..(13465): unsure at all n locations
nnnnnnnnnnnnnnnnnnnnnnnnnnnnnnnnnnnnnnnnnnnnnnnnnnnnnnnnttgaaatatgatgttgctctcatgaccaatgaagatttacattaactacttcaggttagatttgtaaattatgtagtttttccttaatgcataatcattggctgtgtttggtgctaaatactgcagtttcttttaattttgtaggaaaatctgtaagaaattggaataacagagcaaacctgaacattttcttggtatgtacctatacctggtattcatattgatgctattttattaagtgaatagccaatatgttgatctttcatctgaacctgaattactagattacaatgaattcgttgggttgatacatgagcaatacacataaattttatagcatacgctcttttataaattgaacataccacgttgtctgctacaggtcatgtgattaccggtatatcatgatcactttttttaattaggatttaaggaagttggaaagtaaattatgaacaattggtgcctacacatgctttggcttctattcagacgaggtaattagtcttgatttagactaaatataaagggtaccaattataattttctagaagtgaaaatgagctaaagggccaggaaaacaaaatggaaaggatgctaggaggcagttgcaatagtactcgcatcatccctttaccaacaaaatgaggctaattaatttgtattttatcaacatcctgagtgcaaagacaagcagtggaaaccacttttcaaaggtgtggagactgatgaactggagttgctgacaagaagactgaaggaatgctgtgctggactgcaaaatatcagaactggggtgggttagttagagttttttttgctgtctgttactttgtggaggtgttttggaaagctttttgaatcgatgcgcctgctgtatcttcacttatgggtcttgtgttgtccctgctgtctaaaaattggttgtttctctaggccggaggggcctcttttggtcgatgtatgcacattgatgtaagctggaatccccagcaagacaaatttgctttctatataagcagggtcgttcttcgaccttttctctaaaaaaacatcctgcgtgcaaatatcttgcttacagaattaggaatacaatgtgatgtactatcagatgctttaatgatctaaaatatgtatggacaaattcccatagttcacaaattagttttggaggagatgatctatatgattggtggaatgacacaaaaatatctattattttgtttcaatgagaatgagaatgctcgacgtggtgcaaactgcaaagtggattttctaggttttcttttatcgaaataggttcaggattagtgaagtaattatagtttataggcaatattgttaggaaaaaccactaaaattttggcatacttgcctcatgattggttaaacggaaactgcagattgaagcagaaataaatttcttgaaaaatcttggttgttctgtaagtgggatcctagagttgtgacctgacatcaaagttttcattgttaattcacccattgaacatttatacggtgaatttttgcacgtccattgatcctgacaaatctactgttatgttctttttcttctgactgtgcagatgatcagttccactgccaaatggaaacaaatatgttagcattagagttgaggtgcctttacaggtctgctggtacgattgcagatataactttttatttgtacaattgtatatgtgtgatatttttctcagctaaaacttgtgacctatctttattcatgtattaggaatttgtttttggatgatcgattctgcatggctaaatccattgtggatttgttgaggtggtcctccaggtatggcccggggcactcaagttttaacaaaattatgtgcaacacttgggggtgtatctatatggtattgttgtgatgaaaggataataatgtgagtgtggatttataatatatacctcctcttcaaattagattgtaagaatgagtgtgttttctcaattaatattctacatggattcctatgtgcacgaattggttgtttgttcatttatgtttgcatgaaaatagaaatgatgcttgtttcacttctgtttaaatagatttatttcttagctacatggattccagtgtataatagtgggtatttttacacattgaagtgttgctttatttctcaagatgaaccgccaatatttttaagggctcatgctgataaattgtaaaatttagtcgaaacatgttatgatggaaagaacatgtattgcacgtgcatgattactggttttattaaaaggacgaaattgactggctaaacttgaattatcagcggtgttgaaacacggcccgactcctatggaaacaacgtttgggaactttccacaacgggtgaactttaccgttgtatgctccatttttagtaaggtcccttttctgtgctcaagtttttactgacagccccaatattcaacacactggggaggagtatatcacgagctgacactgctgcagtctgcagagccaacgaactactccctatgtctctctctaaatataagcaattttgcttgaatgtggcatatcctgatacaatgaatttggacaggagctgtattagaatatgtcacatccaaccgctcctgtctagattcgttgtattatgatatatcacatccaaccaaaatcctttatatttatggatggagggagtagctagctagctagccatgcattaatcttcactgctaaagcctgtaaagaaatatatgtggccagagatatgctcctgtgaataatactccctccgttgtttctaaatatttaacgctattgactttttaaaatatgtttgactattcatcttattaaaaaaaattagtaattattaattcttttcctatcatttgattcatttttaaatgtacgtatatgtatacatatagataagacgaatggttaaatatgtactaaaaagttaatggtgccaaatatttagaaacggagggagtaatagccgaagatattcttctgaagaaatgataatactatgacgagcatcattatttgatttgaagcggtagatttatacgcagacaagtagacaacttgcatgctgctacatctatatagcttcgcatgcagccgcaatttttcaccaattccacttttttgtgctcttgcaaaactcattctgattatcacttttaacatcaaccaagatataataaaaaaatcatgcgacattacagacgtatttatgatgactaacgtagtgatatactatctccgttttaaaatatcaggtgttctggttttgtcataaatcaaacattatcaagtttaatcaagtttactaaacaaaaatattctaaaaaattatattgaatggtagaattaaataaaataatttgatattgtaatattatcgcagttttaatagatttggtaaaatttgcatagttgataaaggacaaaaccaagaaaaacacacagggagtacttcctatttgtacaaaaccagaaagcaatactgcctcgggatccaatgtgatccggttttgtaaaattcgggatgtgttatatctgctattcagggataataattttaaaaacgataacaagataaggcataagggacctcagctgaactttttccttacgccgaacacccggtgtgctcggggccttcgcggcacttggcccatctcgtcgctgctgggctgcagcttagggcctaaaccaactcgcgcggcccaatccatttcccccgcctcgttccatttccctctccaacatccaagccctaacccgcgcggctcgagactcgctgccaagccagcttccgcccacgacgccgccgccgccgaccggtccggcgaatcccccgctctcccgactcgcgagggctctctctctctccggttcgtactccctccccacccctctcccgcttccctctcccacaacaccgctcgcgtcgagtgacatgctcaccgggtgttcggcgtaatgcctctcccagaccaagaagcagctgcaggcggggacggcggcgcgatggcgagcggcgacggcgcgaacggcggtggcggtggcgggcaggggaagctcccgcggaagcggttctaccgggcgcgcgcgcacagcaacccgctcagcgactcgcacttcccgatcccgatatcgcccgacgaggtagacctctcgcagcactacccgcggtacttcccctccggcgagggcgaggcccgccagggcgacgcggcggtgccacggatccgcttcgcggacgttgggtgtgggttcggcgggctgctcgtcggcctctctacgctcttcccggacaccctcatgatcggcatggagctcagggacaaggtttgttagaatttccccctaaactttgattgggcagtagagatacattcatgtgtgaatggataacagcacaaggtgacactgaagaattcagtgttacattactcatagagaccatttgagctttcctttgtagaatgattagatcgcgcatggcttttacttcatgaatgtttagtgtaccaaatattgggaatttgggttgccttccaatttagattctatagtaaatatggatttctactagacaaaagttgcatagtttagtttgtgatggtattatattatgcaatagacatgtatttctacttaacaaaagaactggaagttttttcttttcaaagctagtacgtatttacttttgattcatttttttcttcgttgtctatatttttcaggtgactgagtatgtcaaagagcggattttggctttaagagcatcgaatccgggaaagtacgacaacatatctgtcgtgcgcaccaattcgatgaaatacattccaaactatttcaggaaggctcagctttcgaaaatgttcttcctgttccctgatcctcacttcaaggagaagaaccaccggcggagggtgatcagcatgcagctgctagatgagtatgcttatgtgatggaagtgggaggaatcatatatacaatcacagatgtggaggagctcggagaatggatgcggtcatgcctggagaaacacccgctgttcgaagctatcccagaggaagagacaaaagcagacccagttgtcaagctactgtctaccgccactgaagaaggtcagaaggttgcaagaaatggaggtcagactttccaggccatctttagacgcatctccttgcaagagtaggcaactcttgaatttactagcctgcagtgccattgcacctattgtatggattttgtgtcatctctacaaatttatgttgcatgaattttgctgtttaaggtgtactagttactcataccatagtaatgatgtgtgaaatgtttgtctaccttacatgctctgtttggaagtttgcagtgacatgttgccaaaccccatgaattactgtagaaacatgtgtcttatctgtagctgtagaaacatgcgcccttactgtagctagtcgtgtgataattgcatgttcagaaaatttgaggtttatgtgcaatcccattctgtttcattgcctagacaggtgcatttctcaactctttctaaacgccaaatgaaatcatctgaggtttaaaacttggcttcgatatgaaaaaaatatatttataattaacgctcgcttatgtatgtggtgatccttacttcttttattaatccaattacaaaacgactgttatgcaatctcagtgagatcattttatggaggtgtcctgtttgcttagccagctttgtattcacatagccgaacggtaacacatcaaacgtttaaaataacgcctctgaggaacctcggtttgcaaataagaaaaagatcatctaaatttggctatttcttccattgtggcattagctttttcgaacccctttacataagttgatcatgaatcaggattagacaacttctctaaaataaacaggttctaaaaatggattgaacaagcaactatagcaaattggaggaatcatcccattaaaaacaataggaggaatgacccaaatcaacagttgctaacatctaaatcttttttttttctctgattcttgtgacagagctgagtcacatttttctatttgccggaacaagtttgacaagctttgccaaatcataagacttgaaatctcttccaaaacacaagcttatatccaaggcagtccttccatcctgtaaccaaatctgagatcagaaagcagtattggcctatagactgtaatacaaagctgatgtccatggaaatacgagcatttgagatgacaatgccatagaagtcaatttctgtgaagcggctaaaaatgacatgaaaatgtatgccaatttgccaaataaaatcaaggctctgagtgcacaagaggcagctgttataggtctaattttttgggataatgcaattccggaaaaaaaaacccagtaaaccataggggcataacataccttggttcttctcgtcttatctgcaccattgacaagcaatatctttgctatatctctatttctactctgtatagctaaatgcaacggtgtccagccatcctgcatgaaacgagacaaaataaaagaaaaatcaatggcactgaaaagggttgaactaataagaaaaaaaaaagcaccatagcacattacattatcagcaacattgacatcaaccctattcttaatcagtaacttcacagtttgcagggcaccaacttgaactgcataatgtaatggtgtggctccatcctgcaaatcagacagatttaattcaagggccaacatgacataaaaaatatctcaaactggagtggaaattgttatgtacttatgttgctagagagagaaaccagatcaatgtgataggcgctaacatcacaaagtttactatattccacatactaatgttattatggaacacataattcatagaaagagattgcagccttgcaaggttaccctatctctgacatgaggatttgcccctcttcgcaggagatggctaatgacggcctcctttttgcctatgacagccttgtgaagtggggtgaaaccatcctgtatcatcagcactcccaaaattaacacggttttctttttcgtgaatgcgcaaaagcttttcacaggcataatccaagatggggtttttcacaggcaccaaaatagaaaatcatgagcatgaaacatgcttcctcaacatgttatgtagaaagaacatactttgtcaagtaaattgatatcgacaccactatcgagcaggctgtccatgagaggtatctgcagcgccaatgcgtaactatgaagtggatgccatttcggctgcacaaaacagtccaatttcaggaattgggaacagttaaaatatcaatggtgtgcacatttccttaatcaagattctgtagcaatgtaacaaatttatgacacaccaaaatataatatctgtcagacatttacagagtgacacttactgatgatattttggtgatatccggggtctcgttctgatccaggatagccatttcttcaggcgtcaagagaagctcgatttctagacagaaaaattcgacagaattaagtgtagaacatgaagcatttcaattcagctgatcaagaaactgaaaaatgaaaaaagaaaatttgatttgtctagcgcatgcagcagatgaaccaatacctcctcgaagctcctcttcttctcgctgctcttgccgccgcgcggcgccgagcctggagaacagcgagggggaagggaacgaggagaagctgctcctccgcccggtggcctcctgccgctcggcctcggcctctgccccatccccatcctcgtcgtcgctcccggagccgccgtcgtccggctcctcccagaacacgtcgccgtgggaagggcgcgcggcgcgcggcgccgccccggggccaaccgagagaagcggcggcggaggaggggaagggtggtgcgggggcggtgggaggcgcggagagcgcgcgcgccggggcatggcgcggaggagcggagccgacgaggccggggaggtggtggccgccgtcgccggcggcggcgcccatgggagcatcgcgcgcgtagcttaggtgttcgtctgggtgcctcttatcgtgaaagaggaggggtgagctggagctggaagctcctggagttgaggttttgggttctaccgtttcaccgtttggaaagggacaaaatctggaaggagatgtgataaaaaaatgaaaaaaacatttttttttcagaaaaaactactccatggatcatggtctctatacagcattaggctagtgatgtttctatggattgttcagattgatgtcattttaaactataccaattttttttaagaaatgtcgttaaagatgtgcatctatttaggaccgttttggattgaagctaaaactgtgccctaccaaaattttggtaatttaaatagtaaatatgctagtttggtttgaagccaaacaattgatagtgcccatactcaatttggacatattctagaatattcttcaccatactactaaaatttggctccatattggtattaaaccaaaagtagtctaattaacttttccctaccaaaaaattggtagtgccaaaatttgcctagattttggcactaccaataaataggtagggtagagaaccaaataagcccttagtttttactccttccgtcccattttaaatgtaaccataagtttccccgcacaaacttgattgtccgtcttatttgaatttttttataattagtatttttgttgttatgtgataataaaacataaatagtactttactcgtgacttatgttttaaaatttttttgaaaaaaaatcaaataaaacggacggtcaaagttgagcgcggaaaatcatggttgcacataaaatgggacggagggagttccaaactttaataaatacataagaaatcatgttaaaacttggcaatattactaagttgccaatgacaaaatttgataaggtttaatttgattacaatctgaactgccttttaactttttagaatccccaatattttacaatattttgaatgtgacttgaaaagggacatatactcggttgtactgagctgttttcttgcacatgaaactgagacatgttattagctactttcgtttcgtattataagttgatttgtcttttgtataattaaacttttttaggttcaaaaaaaattaacaatatctataactttaaatttactttcaataaatgtaacattgaatgtaaatatattgtgatcatataaaacttttgggttgaaaatattactatatttttctataaacttggttaaacttacgaaatgagaaaataaatcaaaagcgacttataatatgaaacagagggagtagtgattaattaagttttaactattacaaaattaaaaaaatggttttatttgaattatttaaaaaaacttatatataaaataattctgtaaaaaaaagcaccattcaattgatgtttagaaagcatgctcacggtgaatggagttgcaaaagttaataaaaaacgaacgaagcattagtgatgaaagcaatgaaaaataattttaatataaatgttagtatatactttcattctcaggctttcatcggttggccaattacggataatgcgccaaacaacatattatcgattaaaaataatttacggttaaaactaataacaacttaaacgttaatgtttaaaaaatacgatgaaaaatctttaaattaactctaaaattaagttttattattcaaattttgacaaaaaaaaatgtgccttttagaattctaaaggtgcagggccgagtggtaagaccaaggaaaatcccactaaattggttatgatatctattttggaaaacaaaaaggagaaaaaatcaatcttactcgctcgaagtatttcatttggatcacttaaccactaaaatatttttctaatttacccctaagtactttttggttcattttgtctctaaactattgaaaatgattcactgtactcactaatagcatttttttcttctttttctttctctttatacctgaaattttttaaaccatagagacaccactatcaaagttcaaataatatttgcaacttttttcatgatcgtttacttgaactttaaaatctcaaagttcaaaattaatcttaggtatttccaacctatgtaaacacctataaaaaatattctaaaaggataataagacataagttgtaaattgttacccatctatcatccaatcaaatttcagtgtgaaatacaacttacatatggagagaaaataccgtgatggagtaaattgaaccccttttttatagttgttgtaatagcaaatcaattttattagggtttaattaaaatgcaccattttttttgcagatgagcataattctttaaaaataagcacacataatctttggcaactacacaagcacaaatggaaaaataaaactttttttttacttaccctccaagccagaaggcccttttaatgtccaaaataaattggagagagtgagcggtcaagcaaaaggaaaccaacacccgcgtgttgtgtgtagaaccaccgcctcgccgcgccgccgccgccggcggagagagagagagaatgctcacccgaaccctcgccggccgcgttcgccccctcctcgctgccgcgggcctccgcggctacgcgccccgcgcggccgccgacctcgtcgtcgtcggcgacgaggagcccccgccgcgcaccgcgttcttcgccttcgccgccgccaccgtttccatcgcggccactgcgcccaccgtcctgcagccgcgcgtgctcatctacgacggcgtctgccacctctgccaccgcggtgagcacatgtacaggcccccaattgtggggggactcatttctacctcgaatcggcgacgaattgggggcatttggttgtgatcgaaatgcggtttggggctttgcattgcaggggtgaagtgggtgatcaaggcggacaagcacgccaagatcaggttctgctgcgtgcagtccaaggccgcggagccgtacctgagactggtcgggatggacagggaggacgtgctgcggcgagtcctcttcatcgaggggcctgaggcctactacgagggatccacaggttagcattgcatctctgatgattcggaaatcggggcaatgttgtgatctttccaagaacatgttggctacttgttagagcaggtacaatagcatactatatgccagctataaatatattttaaagagataaatgaagatagagaagaacagcgggctatagatctgtaaccagctacagcacgaactccaaaacgtaatgtgtgtatgacaggtgggaccagatattaatagtgtaataagcaactattgtatgaattggctattacattggctatagatgatttagagctagtagtgggctatactattaaacttgctctgtatcaacggactagtagattagcaatgctggggatctaagagtggtagaaaaatttgcaaccattggtggatggataccagtgagtgatagttagtaccctgtactcgctggatttgcataccttgtttgaatttgtagcaattttgcatggcatgaggcaaaattcgttgggaaatgcagtggatttctttgtcattttctgcaagaatgccatcatggagggcattggagtttagaggccacttgataaatgctttgggtgattttcagtaccatctagtgtctgtggttatggctttgattttctgaatgggatcacctctgaacttctttctggtgtttatgagttgtgtcaaatgcaggattcaacatttgctaggtttgtgatagataggtgtgcccccttatttaccagtaatgcatgagagcaacatgctttacactctagtattttttttttggatcatgcatttgttcaaccaagttattgcaatgatagccattgctgtgctcctgcaaaaaagtacaaatttctagaggccacagttcctttcataatgtagctcaatcattccctgagacaccaattaatctggcagaatacatagattatagatatggttgtactgtccatatagcagcactaactggaagatcgaaagtactaactgaaggatccttttaatgatactcatttagggaaaaaaaataaacagcaattctttatgtactttttgctgtttaatcatgtcatatttgcccacccttatttcctgtggtaatcagggtactaaatcttccatgttttggttgcagctgctttgaaagttgcatcgtacctgcctcttccctactcagctttgagctccctgctgatcatccccgccccactgcgggatgcaatctacgattacattgcaaagaatcgctacgattggtttggcaaggatgatgaatgcatcgttaccaagaacaaggagcttcttgagcgcttcatcgacagggaggagatgcttggaggtggtcccagcaatagcttctgatgatcacagtttttgctgccctagttccacttcttagttccagttgtaggtttaggcacagagagatgtaaataatcttcacatgatcacatccatgtagggtactacttatggactaaagggttttcttgacttttgagtgtttatgcctacaaatttgacaccactactagtgtccgggatgcagcattatcattagtctgcatgcggaacttggataggcaatgtcaagagaaaggagagttttaggattgtgattattatctcagtgtaacaggttaagaaatgccttttgacctgtcaaatttcacaagaacattcaagatgaaccacattatgcctgaattcttgtatgttttgtgttcattgttgccccgatgggatatggtttaacatcacttctttttttgccgttgtgttatcatgcatggttgcttgatagtttgtgaggccttgcattgttgaatttagaaataatcttgatttgactgaaaaatagacacaactgcggtgcaaactctgcttatgatctttgcaaaccattgtgatgtctgagaggtcataagaaatggatttacaacagagttatatatatactgttgtctgcagttagtacatgccagcaaaagagagtttgaccattgcggcaagtgtcaaagacaaaaacaactctgcttttctgcagtacgagaaaacaaaactataaaaatctagcaaactacatctacatttttcctaatttctacagacaggtttggaaacagccagcctactggcaatagaaagtaggggaaatacaaaaggtatatagctctagcaaactgcattttctacagaaggggttcgacaaaggctagagattacggtcgtgaggttccaaccagggggattcaagtg

SEQ ID NO: 1179 - DNA, 16557 bp, Oryza sativa
  unsure (1)..(16557): unsure at all n locations
tctcatcatacttaaattaaaatcacgtggcatactcaataaccaacaatttttgaaagttttgaagtatacctttcaccatcaggatgagtgatataatattcatgtcaccacaagaagatttttcacgtctgtatgatcccccacatacaattatcacctccaaataaaaaagatcatgtataacaacccaataatcacttaagggaaattattgttctactaaaatcttaaatatatgagctatttgttttcaagaatcaaatcggcctaggatctcgataggatgaccccattcctcatttttgtactggatgtgtactttcagaggatgactggaggaatggtgatgaaccaacccatctagttctccaaacaaaataagtagtcaggttcagactaatagggaactacaaaaaataggtgtaagcaactagctgctacaggaaacaataaccaccgcatatgttgagacaaattgaacatggaactgatgcttcagtattagtttttgaatggcttgtgtagttatatgtaatggagacaaatggttcctttaaatactatatggaacttaccccaggcaagatatcagtcccaacttcttgcaaaagcttctccatctcactaacctagataacaggagagtaaaatacgtgtaatgttagattgtacttcgaatagctagtaataataggaaaagaaaacaattcaatgggcttacagaatacatacctcatgtcggggtattctttgtttgatatcgtcaaagaacttcaggccaatcctctgagcacttgtaagtgaatcgtctttttgaaggtcatccagtgtacgatgtcctttatcatataacttgagagcagttgcaggaccaacaccccaaacttcgccaaataggctgacagttcgaacctttaaggtgatatgcaaatcagtaaatatcagggagtatggctggataatgcttaagagctactcctgttcactgaaaaccaagttaccttctcatcattctcaaagtgctctagcttggaaagctttcctgtatttactatctcattaatctgcatatacaagggtagttagacaatcaaacacctgagatattacatgtagaacgatgaatgtatgaattcatattttccttggaacttctgtggtacttttagaacctgtttgctcaatgaaggtgtgaataaattttcagccctcaacagcaaaacaaaatagaagaccaacatatttttaagaaaacagagttatgacacagttactacatcacccatagaccatagtggataaaaaaatagaatcatgaacttgtacaaaggccaaaaatatatatgttgacttgtaaatcaccaattaatatgaattaatggtagaaaaggattaacatacatggtctttcaatgatttcccaatagcagggaggtctttaacttgatcagcgctttctattttgaatggcaatttctcaatcactggaatagccttgtaatagctaaatgatcttcggtcatctcccagggcttcaagtgaaagggaaggaaatgttatttgtagagaaagtatatgaaatgttaatacaatgaataagaagaatgagaagatttctgtacaatgtccttacctctatatatattgatcagctttccaaaaatctcagttatgttcctgttcaagtctggaggagcatacgttgaggattctccagaagaggcttcctagttatataagcaatgaatcaacactaggaaatataaatcctcagggttcaggagttatatgttgtatggtacagagcaatatatcaccattgagggtgcaaaatagatatacagctgaccaccaaaggtcttaaagttgctacagcagtgttttcatttttgaacagataaaggcaactgcgtacatttttatagcagaagaaaaacagtctcaagtctagtcatgttgaagtcagtgtagatgtaacttagagcttagagtaagctaattacaaaaaggagaagctaaaaagtgtttcctcttttttgtttacatatgttcagaatggagcttgtacgaatttgagcaaaccaaagaggataagtgcagcaaaacaacataacccagactttagagcccagttagtttgtactataatttataagaccatgcttatacctcagctttgaatgcattttgagaagctatggtttccttagaatctccagaggcactttggctacttgtacacgtgctaggcccctttacaacatccgaatcttcatttggatgtgcaattgcatctcgagattctcgattacccccagcagtttccttccgattctcaggaccgtctgatgatattttgctcctctttgcagactgcaacacacctgaacctgcagcaccaccttccttcttcggcttaaattcctcttcgtagttgatagcaaacttgtgctccggtagcctctccccggatttgaggcactcctccagccactcgaatgacaccacgctctgcaatcaaaaaaaaaatcagttcttatagtagtaaatacaatcacttgatgttagccgagatctctctgcaacaaaaatccagtccttatagaaagaaacacaatcacttgatgttagcagaaatctttccatgttatgaaatctctataactcaatgtagtactactactagcagtagatttgggctgtgaaaatgcagatggtagcaaggcacaccaagcttgccgagaggagattagggtttcaagctagggagccaagccgattaccccgcgaaagcggtggagccaggcggcgtcgagctcccggagcagcgccttggcgtcggcggccaggacgtgggtgaccgcgccgccgccgcccttggcggcgagcttctcctggacgcgtccccccatctgcgccagcctctgcttccacacctgcaccgacgacgaaagccaggaaaccctaagcacaggagagagagttggtgggggttgggatggattgctcggtggagccgcgacctcgaggcggcgagactggacggcgtgggggacgacgaaggcggagacgccgcggaacatgccgtcggggtccaacttcgccgccgccgccctcgccggcggcttccgcttcggagccatggagaactcccgccttctcccttcctcgctgacttcagagttcagagccacaggggttttggggaggttttagaatttcttcttcatcagggttcctttaaaaccctaaaatttagaatttactggattttcgtagaatctactagttcagttattttaaaaaccttttaaatttttcccatttcaaagaaggcctgacaggttgtccaagaaattatttctgaaatttgtggatgaattgaaattcaaaccacaagccacaaggcacaatcaagaacagctccacagattatcagagacaaatgagcaaaagcacacagtaatttgcataaatatcatttacatcatccgatgtacaacaaattaatcaagccacacgcaaaatctatattgtaagtatgtaaagctcaaatcctcaatgctgctctcctcctaatattgggaggggcttattgcttgtgagcaaatcaaatcaatacctatagttccttttctgttttccctcaaattttacaactcaagcattgtacaaaacaagaaaacaagcaaaatggcaaaccaaagtatcaacagtagtatccacccatctgggttaaaaactgtgtactgttgctaactaactgtaaccagctcaggcagtttctgtggtgtctgcttctagtgagggtttgtcagtggctgtttctgtgtcaccttgcaatggcgcctcctcaacggcagcatcctccggtgatgacttggtcgcgccatcttcttcctctgatggtttgtgagcctctggcttttcaaggtccatgctatcctctgatggcttggcgctgtcatcatcttccactgatggcttatcaagaaccacactgtcctctgatggcttcgcactcgcctcgtcttcctccaacggtttctcaagaccagcattgtcctgtgttggctccacacttcccttgtcttcctctggttccttctcaagagttacagggtcctctgtctgcttggtgccagcatcatctttctccgatggcttctcaaaggtcgtactgtcttctggtagcttggcactcgcctcatcctcctccaatgttttctcaagagcatcattgccttctgatggctttacacttccctcatcttcctctgatgccttctcaagagttatagtgttctctgatggctccacgctggcgctatcgtcctgcggcggctcctcaagagcactgctgtcttcggatggctttatgctggcctcgtcgtcgtgttttggttcctcgacagctatggcactttctgatggcgtttctatggatgcactgctctgaggtggtgcctcctcagaaacgttgccgtctgcagcttcgctaatgcttatgctactctttggagtgttatgaggcagggtttcagtatctggggtgctttctgatggtttatcatgcacatcatcactttcgatttccggtggcttctcatcctcgacagatgcatcattttcaggctccaatggctgctcagttgacttgtcagaagcttcatcagtttgaggttctgatggaacctcgttagttctatcactttgatgcagcactggtgtctcaactccagtttgagattctgataacacctcagctgacctttcagcagctgcatcaatttgaggttctgctggatcctcggtaaccacatcactttcacgcagtgttgccttctcacctgcagttcgagattctgatggctgctcagccaactgatcagaagcagtatctctttcaggttctgatgactccttggcagttgcatcactattatgctcttgtggattctcttcatatgcttcgtgttgaggttccaatggctgctctgaagctgcagccttttgattttctaatggttgctccgttgcaactttagcaggtgcaacatcttgggactctgatgactggtcagcagctggatcggtgttagcttctaatatctggtcagatgtcttctcggcagatacaatgccttgaggtcctactaactgctcagcagttggcctgatttgagcatctgatgagttcacaccagaagtggcatcactttcaggctcggtaggattcccaacattggcatcaacctgaggtggcttctcaagactgagatcactttgttttgttgtgctttcagcattagcttcattttgaagtggcttctcagcagtctcttcactctcgtgtggctgctcagaaggttcattggtttgcggtagcttctctgcagcatcttctttagatggcttttcggttagagtagcagtttgagatagcttctcaacagccatggtactttctggtaatttatctgtcagtatctccctctcggagatttcctgatgagctgcatcacttggagatggttctgacatggcttctacactttgggtcaggggtagctcgtcagtagcaatatcagtctgtgatggcttctcattttcagcagtgttttctgatggcttcttagatggttcagtgatctgagatgatgctacagcaagtatgtcactttctgacaatttttctgtggaagtatcagcttgcgatttatttgcagtaagtggtagttttttggcactttcacttatttgtgatgaattctctgtggtagcaccattgttctttttatcttgaatgatctgtgatttgttatcagcagtcacattggttttctctgcttcttcagcaagtacacggttttgtaacggtttgttgctagatatatccttctctggctctttttctctagacacgcttctttgccatggctttttcacaaccacgctgctttggagcgggttggtgctagccacactaacttgtgatggtgtcacaaccgacgcaccgctttgcgattgcttttcagttggaacattgcgctgccacaatcttttgcccattcccctgctttcaggtgtctttgcatcagttacactgctctggggctgtttctggaatccgatgttacgttgccattgctttttaaccactgctgcagtgctctctgatggctttacatcatctgcactggtctgtgaaggtttctccgtgattccactgtgttcctgtggcacagtgggtgttgtactggtttctgccagcttcacatcgatagcactgctagatgacttctcagtgtctgtattgttctgcagtggcttctccgtgtctatattgttctgcagtggcttctcattgaccactttgtgctcccatggccttttaattgatgtggtgctttctgatggctttgtatcatttgtcaatgatgacttctcagttggtccactgttctgtatctgcgcctcagcagccacagcacgttgccatggttttctgatcaatttgctgttttctgatggcttcacatcatctgcactggttgatgatggcttatctgatggcgaaatgctctgcggtagattctccgtagctaccctccgttgccatggcctttttaccactgtgctggcagtgctgctttctggctgttttgcatcaaccccattacttggcaatgattcctcaatggcagcactgcttggagttgacttttcagtggttgtgttactcagcaatggcttatctgtgggaagattgcgctgccatggttttcttacggctgcactacttcctgatggctgtaagttaactgcactgctctggaatggcttttctacactgctttccaatggcttcttgctgactacatgactatttgactcacccttggtaaccctttccccttcttctgacctctgaactgttgtgctgctttctgattgttttgggacatcaacgctactttgtgattgcttttcagccacaatatcgtcttgtgacggtttctcaggagtgagttcactttctaaaggtttctcagtgagcccatcaccttgacctgggcctcctggattcttggtagcatcttcatgttctggttgcttctcgatatccacttttgcatttggagtactatcctcaaaattgctgaagtttcccttaaccataaataattgagagtgatgggtcttgcaataaagtttgccttcatgtgtgacattgttggatgggctaagagtacagcctccatgggtgcaacggaagcatgatttatgatatgagctcccgttaagattaacctgcaaaatattaattgaattaatcatttcttatcggttatcctaacattgcattcttctatagcttacataagttagccacagaaaatgactaatgcagtagtatgagggaaaaaagtatataacgcccaaatattgctaaaaatatagcatattggcatgtaataaatgtgttcttaaatattgtcaaaaaataggtcaatgaactgattctacaacattgtgaaaatttgacagcaattcagtattttaggaaagggtatagaagtctccatttggcttagcttgccactctttttgcttgtgagaagaaaattattgatacttaattacaactggaaaactttatcagatgtagtaattctaattattgtggatatattctaataacaagcacgataagatttatcgcattagcagttgccactgaattagtcttgtgatggagcacataagatgatgaggccaactacaatgctcaattgtcaaccatatcataaatagaagagcgcttacatgattaattccctgaacaggagaacagctgttggtttataacatttattgaagttgaacaggggaagattaaataatacagtagtataatactgaccttttcaagagggtacacagtcttgttacaaactacgcacttgtcttgtgtgccaacaaacatgctagagaatctgttcggttgcccctgcagtttggataacataaaagaggaagtggacatgaatgttatgtcctctacatcaaagctgccaaacaatttagatactagggacgtgcttcaaaaacataaaagagcatatcttagaaatatattacgataccttgtttccattcgatttttctgctttagctgattttgatgtccctggcataatatagtcaaaatttagggcaggcctaaaaatcatgagacaatagcaacaatttcgaggtaaagacactagcaataattaaggcatcaagcccagtggatttagttttctcttcagtaccttcaaaacttttctccaaactgccggttgatttcaatatctggtcatagtgaggtttgcaatataggacaccttcgacagaagaatagttactaaactgtaaaagataataaaaaaatattagctggtttcatatatgtagcttagttgcaaacagaacaagataggtgtagttctagctagtatgatgaggcataaagatttagtgtgatcattattattctcaacagaaatataccaaaaccaagaaaaaaacatgctagctgcatttacatccatgatgcattgaggacagcatgattaattccatgttattactttcaaaaggcaggctaatcatacggcactcaccaacagcataataccaacctagcaaatcagccagcactatatttaataggtgaaccagtcagttcaggaatatgatgaacagacaacagttgtaccaaaaaaaacaaacatttatttgctaccctatccattccagtccatccctcatgccacaataacaagaaaaataattgggatatttactaagacgccaagaaattgcgtcgaagatggattaaacaaataaaccgtggttaggcaaatttactgatgcttcgtgggttcgttatcacataaacggatagcaaagtgattggttatccagttagtcaatcacagtcgcaacttgattattgaaatgagcatgcaacctaactcccatcttcgactggtctcgagaaaagaaaaaaagaaaaagaaaaaagcaggccatacagtacagcaacaacaactaaagcattccaagatggatatgatttcaggaagccgatagtactcgcaataatagcatcgacccagattaacaaaaacaaggcataaagccagtacaaaaaaaaaatctggtaattaatggatggatcgagcagagtaggggacgggggacctggagggtggccttgcagtgggtgcagcggaagcacgggcggtggtagacgcggccgtcggcggcgagctcctcgacggggtagaccgtcctcccgcacgagtcgcacttctgcgtcgtgccgccccacgccggccgcggcatnccgggttccccccccccccccctccacctccgcctccgcctccgcctccgcgccgccttggatgcttctcgttctcgccgcgcgcgcgcgaggttgtgtgtgtgtggggagaaaggtggtggggaagagcacgaaggaggaggaggaggcgatgatgattagtgaaggcgaaagcagcggcagcacagctcagcttggggagggggcgggtggaggaaagcgttggcgaataacggggaacggcagcgcagaggagacgggggagtgggtgcggcgtgcgctcaaaaaggagggaaggggaaatgctacgggcactccgacgagaaaaaaaggaataagagcctcatctttccgcttacttatcagctagtaaaatttaaatttttaaccttaaatttaatttaaattgattttaaggtttattttactcgaattttattttttaatctttacttttaaatcgctaagaacacgtttataaaagttttatttacaaattattttttagatcaattttacgtgcggttaataagctcgacctattccccatattaacggggccataattatctgcgagactgcgactgccctactagagacatgcatagtatgatgtgctatgttagtgacactaactacacatgaagttaagcgaaggatcgcctctctctactagcctttaaactttgacctaatattgtctgtgtgattttgaacagaatggaaaacccatagatgaatacatgtgaattgtccaatgcattttatgctttatcagttatagatggtacgcgctagtataaacggttgtccgtgctcatcaatgatccatagcgttatatgtgttggtagtgtttttcattcattgttactatacttctagactgttttataattattttttaacaagttgttcttttatttctcttacatttcaagcagtatgatcacttgcgtgaatagaaaaaaacaactttcccaacgtaaaagaaagtattttttttgtcaaacgtaaaattattgatcgttagacaagaacacatatgcaaataaggcatcttcttttcgcttatacttatgcttataagttaaaatttaaattttcaatcttaaatttggagctgattttgaggttttttcatcgaaatttattttttagctgttgcttttagattgataagaacacgtatataaaagttttattcacgaattattttccatttgcaaataagctgtttcgctggatggctccgtaaatgttgcatcacacgaacacaaggttaaataggaacctgtcatgtcaataaagttagaccgtaagatagcatctactaatattcatttaaccgtttaagaaaatggattattagacatttggtacataaaacatgtactctcagcattatcattgcctactaagggagcatttatttgcacctttaccattccattatccagagcccacccaaacacgagcatgacacgcagaccctacactatcgtgcacccacatgtcaaaaataacaaacaagagtgtgtctgtgtgtgcaacatctccgtgaccgtaccatttcaccccccgactttccccaccgaagtggcccccggcgacgatttctttcttttccttctttcccctctccaaatccgatccagcccgtcgcagccaactcttgccggtgcatatctcctccgcttttttcgtactcaccatgcatgtacctaccctacaagttccactgacagaccccgcctcttggttgaagggcccacctgtcatgcaaaggggtagcctaccacggttgatcggggattgcggattgggcttattatggccgattcgccgaaagtgcaacagggtgtggccccaccgtccggcgccgtcgatgtcatccctcccgacgccgagcggcgccgcgagcgccgtccgtttctggcggagcccgtagggcgctgtcgcccaccagggttcccaattcagccccaatcgtttgtcacgtatataaataaaaaaacttatatatatacgtgttcttaatgatctaaaagtaagactaaaaaataaactatgataaaaaaaatccaaaattaacttttaaatttaaagttgaaaatttaaattttaaatgataagtatgggcgaaaagatgaggctatagagttgatcgcaacagctgcagcaaacctaatataatgtctactactgtagatacaacacgaaaaaaattactaatatacttatttttttcaataatttacgtttatatatctgtattgtaaggatttataaaaatatacccatcctacaacggtcccgcagctctaaaaacacgggagcgacggtcccgtaaatctaaaacgcgggaccgtcacggtcacacgtgaccaaaacgcggcaccgccatagcagcgatttttatcaatgcgttgacactgttcacgcactgttttatactgttcacacactatctggcaatgttactatttggcactgtttgcatgccggttccgcacaatgggtctgcgggactgtaataaacagtgctaaacagtgtttaaaacagtactaaacagtgccgatcggataataaaatcgctctagccgcggtgccgtgttttggtcgcgcgggaccgtcgcggtcccgcattttggatccgtgggaccgtcgtggtgcagcactaccgtcctgtgggaccgtcgcgagataggtatatttttacaatttctttccatgcatatatataatggtaaattattgaaaaaaaaagtatatttacaaattttttccgatacaacacagccacagccatagcttgctgcaaagcagcacaaaagatcagcccctatatcggatcaaaatccactcacaagctgtatcatcagatttcgtggaacctattaacaaaccgataaaatccggcaaattttatcaaaagtttaaaattcactatggatttttgaacttaacggaaaaaaaaagagtggtttgtatttttaatccggttttcacgaaatccaaatcggatctcactcaggcttggttcgatagatgagtttgaagaaagatttccggtgcacgcgaaacaagaaaactcactagcaaatgattaatcaaatattaactattataaatttaaaaaatagatttatttaatttttttaaaaataacttctatgtagaattttttttaaaaaaaaacacacatcatttaacaatttaaaaaaaatatactaatggaaaataagaaagttaaagtttggagtcgaagaaaactgtgaacctgatcgctaccgtcgtatgggtgcggtgccgcacgcccgcacggcgagaggtggctgggctggcgagctattcgagtactcgtatcaaactagacaacggggcgagctttcgggcaaaagaaaaatgcgatggagtgcggccggttttttctgttggctgtaaagcggttggttcttttccgctggcaaaacctttcgttgcggcgcacacggccagccgggcaccgcgcacattctgccgggccgggggcctctcttttgcgggcggactcctggtcgcgaatcatggcgctagctagcttcgtgcacgcacgggcgggcacacggccgcggaaagcgtacgtacgtgctcgccactggagtacgactcaaatcgatcggatatcccgtgcaaatgatggtgtggtgtggtgtcccgggatcgttcgctcggcgggcacagcagcgaggaggagaacgagagctttggctgcgtgccgtggcgggaggtggaatggactaatgggggcgggggcgacggcccggccgaaatagtataggttttggatgcgagaaacggcccaacaatggcagtggtgtctgggcctctctgcctgagggacacacggacgcacagggcactgtcggtgtcaatgagcagccttgcactgcagtggcaatcggcaacttgaattccatcctccttctaacccattggtgtgacctctacaacctcctgcttcttctttttttttaacgtgtcctgtaactcagacttaggccctatttagtttcaaagttttttttcaaacttccaacttttcatcacatcaaaccttttatacacacataacttttctatcacatcgtaccaatttcaaccaaacttccaaacttcagtgtgaactaaacacagcattactaaaatgtgactacaacatataggtatagaaaaaaattttggttgcaaaattgtactagtaagggcttgtgtagttcgcgaacgaaaattttaggctgtgtcacatcagatatatggacaatcatttgaagtattaaacgtagactaataacgaaacgattttgcttggaaactgcgagatgaatctattaagcctaattaatccttcattagcaaatgtttactataacaccacattatcaaatcatggcgtaattaggtttaaaagattcgtcttgcaatttacacgtaatttgtgtaattagtttttttactatatttaatactctatacatgtatccaaacattaaatacatgtatccaaatatttaatgtgacaggtgaaaaattttcgtttcgaaactaaacagggccttaagtcaagaacacaccatatttatatcggaatggctatctgtaatcacaacctttccgaattccaatggatgaacacggggcttaattgctaacatataccagtatactgctgcacctttcatcctcgcaattaattctgctaattttgtgcagtgaatttattcacagttagcttaggtgaagctgcactcgggtggcggcactgggcgcttcttgctattgtcggtgcagtagtcataggtcaggttccccctcacgccatcgtacgccgcctgctgcgccgccgtcagcctcctgtactcgccgccgttccaccaccacgtgtccggcgacccgcagtcgtccgagctgacgccgccgccggcggcggcggcgcaggcgtcgacggcgaagccctggaaggccgcggtgaatggcgcgcgggcccagtcgaccttggtccggccgccgtccgtcgcccagtcggaggcgtcccacacgctcccccgcggccgcataggcttcgccgggaactcgaactccgggccccggctcgtcaggttcttcagcaccctcaccggcgtctcgtccacgaatatcctgccaaataattaatcaaatcgatggcttgtacatgtgatttgtcttagcttctacagaattcaggtggtcattttgtaggagttagatttatccaggttttaaatctccgtctagagctgcttgagaagggtcaactgctaaatgttatagcccgctatttaaaacactggatttatcccatcgcttattgtatgtgcaagtgtttgttggtagagacggaagatgtaactatttctactatttgttttaaaacaaaagtgtatacggccgtcatggtgacattgaactgagcttacacgaggtggaaggggttccagaggatggagtagtcatggaagtcggcagcggggtcgaaccagaggcggaggcgctgctcgcggtcgccgtggccgccgacgaagacgttggtttgaagggtgatggggttgccatccttgtcgccaaggaactcgaagtccacctcgtcctgcacgtcccagtctggctctgacgccagctacccgtgcaatttcagaaataaattaaattaattgttacattcagttaattactggtgcttagtttttagtcaatattaaagaacatgtgataggaattaacacttatataattaagtgaagttgatttagcagtttagcactcacatagtaggctgtcacaacgccggcagtgtagccggcaggaaccttgatcctcatgtggaagaaccctgagccgtacatcaacttggacctgaatccagcacctgcatgcatgataattaatttgcatgatcacatcaagctagttaagcataaaatagagagagaaaagaagcaaaaactatgatcaagctgatctaaatgctgaatctaacagtgtcatatatataatctatctgtgtgtataccagagctcttgtccagggtgaggctaatctgcgtgccctggttgaccaggtggtagccgtctccaccatatgttgccacgtagttgtcgtcgaacaccgtcgccaccgccggcggcggcgccggcgccggcggcacactatccacggccaggaggaggacggcgatggcgatgaggtggaggaggagcagccatggcggctgcacttggaaaaccatatatatactttagccaatgtttgctagtactaactaattaattaactcgattgattattgcaatggagaagttcttgtgtacgtagctcacctagctagctagctagctagcagtccgttatatagtgttgatgtgtcttgatgatgatctgatccgagctagatttgatatatagtagcaatgatcatcagatggagatttttcgatcgacaggaggatgatgatgcatgaaacggattgatttgggaaggtgtgagctgtggagtgtacgttttatctgcctgcctgcctggccctgagagcttctcatggagttcgaacagaagccaacttgattagcgttgtgtgtacatcagcttacttgattagcaaaaacattgcctttgttctatcacctgttcctaagggcaagtgctatggtagatgtgactaccatctccaaatttatctattttattcactcatgaattaagatgcaacacatacaatatatcgtatttggtacacaaatacaaatatttctaatactctcacactcttcttgaaatttgtgtagatgttgcctcttgacttagggatggctcatcttctctctcctcacttctctcctccacctcatcactctatccaatatggtatttttaagggcaacatatggaacattatagtacttgccctaatgacttcatctttgataggtcacaggaaagaaattaaccgacacaaataactaggtcatcttttacgggccgtgtcaagtagtattctcacccgatacggatggggcttatttgtaacgtgcatcttttaattaccacccttcacccatcactgatgtggtcttttagaaaaaaaaatggtttt

SEQ ID NO: 1180 - DNA, 14275 bp, Oryza sativa
  unsure (1)..(14275): unsure at all n locations
nnnnnnnnnnnnnnnnnnnnnnnnnnnnnnnnnnnnnnnnnnnnnnnnnnnnnnnnnnnnnnnntactgaagacacaagccaaactctagctaaactttgccggactaatactatatccgtaaaccactatcactagcatacgaattctcaaatctcaagcccttaatacatatgccagtcctcacaggagacaaccaaataacaataatgaaaccaatgaactagcaccaaatacatgctagttgtaattttcagtgtatggaaatttattccaatgtatgatgagtggtggaatgttccacgatcagtcgatcactatatatatatatatatatatatatatatatatatatatatatatatatatatatatatatatatacatatatatatatatatatatatatatatatatatatatatagagtgatccacggaccggggtacattccaccactcatcatacattggaataaatttccatacactgaaaattacaactagcatgtatttggtgctagttcattggtttcattattgttatttggttgtctcctgtgaggactggcatatgtattaagggcttgagatttgagaattcgtatgctagtgatagtggtttacggatatagtattagtccggcaaagtttagctagagtttggcttgtgtcttcagttccttgaaacacttccaatattaaccaaattattgcacttgatttagagaaatgacagaaatgatatggggaaattggttgctgacaagattccagagaataggcacggtgaaagacaccaatttcgtgatgtcaccaaccaaaccaaaacattcctttgcaactaatgctagttccaatgaaagattttgttcagaattagggttttgaccacggcaggattactagctgaacaaattccgtccaactacaacaaatatcgcctgacacaaacgacaaccaattcaatctgaggactagcctagtaaccaatggcatcgacatctcccatttttagtttaatttgtgtcgaactgtcgatgaacgacacactctagaatatcccaagtagtagtcttaaacagtgctttattacatatgttgaacaagatcactgacaacacgataaattattgtagtagattgcaagaatcattatatgtcacaattggtactttgccatttaagaaattaaacatacaaccacgcaacatcgataggagtaaatttggtttgcatatcaaatacagaaaactgatcaaataagaagaccggcgcatataaaattgttctcccaaaataatttgcatagctttaatacataatgtaaaaagatgtcaaactcagagagcatcgatgaaggcaagtgtgtctgtgccatcaacaattaaacatatgattggcactcgacatatctaagaaatatatgatggaaaattatatagtaatgcagcatgaagcatggtgcttcctaatcttatatgcttcctcatttgagaaagaagcatctgcattaaggaaatcatccaaggaatgcccagcaagggattagcatatttccatggaattataacaattaaacatgaactcagtcaatcccattctacatggatgatcttgcaaatttggatcataacgtgtattctttgtgtgacattcaaagcatgctattgttgtggacagtgtgcccaacaccgacagatgtgaggtctgcataattgaagatcatcacatgtgcacatggatatggcatgagtcaacaggtttaaagaacacaagacgagcacaaaacaaaatccttgggcatgaacgcggttataccgggaagacaggaactcaagtactacaatactctctcctagttctaaaacagacaagctatcgtatgcacaaagtacaataaaggacaaccaatgacacttaaaaagtaaaaaactagcataagagcacttactgctcaaaatccagacatgcaaagagtgaagccattataatataatatataatgttcatcatatggtctatttcaaccaatatgaatgatcaatttgagatcaatgcttccagaaaaaatgcatatggacagttcaatgactaacctacagagttaactagtttaccaaaattttctatgacaagcataaatcatgctctattgctcttccccatgttcttctttcgtttcttcaagtagtgccaaaacaaccatgattgtgtggctaattatgcagaaagtatcccttccaagcagaagtcatggtttaggccattttttcgaagctactttgcaaaaataaacaagaacacctaaaagaaaatgtctatttccttttcgctcatctcatatacatgatcccgtgcctcagacagagcaacctgcattgactcaaccagcatgaataaaacataactcaaatgacaccatgaatagccaactggtacggcaactgacctgtccaaatttagtgaagaagttgtttgcaagatttaatgatgtgactgcaagatcttcattagctttaagtgcttgtgccaatgcaaatgctccatcatcctgttaggagcataaagggtattgaacatggtggagatctgcatagacccaccaatagaaaatacaaaaagaaaaagacactgcatttagtgtttacttactctaatctcattaaagcccaggtcaagtgaagtcaaagattcattgatgatcttgaaacttcgagccaagcagatagcacccttcaaaaagagaaggatcagaaggcatgggtatgaatcaaagcgcaagttataaataaaattcaacgaagattgtgcatacatcatctccaagtccatttgccctcaaatccaatgtagataatgttgtgttgtacttcaaacaatcagcaacaaattctgcacctgatacacctatctgcaaaatatgtaaccaggctgaagaggatataacttaaatctgcatccgcgattccattcagttatgaagattacctggcaccaaccaagtttaagggtttggattttcccattgaacttgagaacatcacaaagagcctttaccccctctggcccaatcggattatagctcaactccaactacagacaacattcagaattagtgcaagtacagcactaccttcttgtgcagactaaaaaagtcagaataagatgacttactgttgtcaccactgaattatccttcagagtttcagctattgcacttacccctttagagtgaatgttattaccaccctgcaaatttaaaaggcttaagacctagagcatgtgtatacctgtttacaagaatatttggaatgctgggacatctaaagaatacagttccttttttccctccaaagttcctctattctgaataaggtttgttgtataggttctacactcactttacaacattagaaaagcaaccctgaaggttatggggaattcaatagtccatggattaagagatactagcatggcagtcccgcacgttgcaactgatccgaataagtattataatatctaatattacaatgaagacaataattaacatcaaatctagaaaatttatagtttactacatggagacgatcaatcacataaatatacagatgtgcaaataatgcagtttctttaagagaatcatgcaaacaaccatatacttgtctacatatatctagccacaaaagatttattgaagtaggactgggtcagtgggtgaactgtagacggtagaacacacaatcaactgaactactctttataaaagaacaaagatataaagaggagaaacctgaaactttgttctgagattatatggtgatattataataataatttacaaaacagagggtagtatatgaaactcttgggtgttattaatagtcaaataggtgcttaccaagtctacagtagaaattgttttattctgtttcagagcatctgcaaccttttcagctccctggtgacattcatattaatttatgttacaaaaccaaacaaaatcaccttccttctctaaaaatgccaaacaaagtaaacataattacataaatgtgtacccatttgatacgttggatcacatgtgaaaaaccatgtatatgaattaagaaaacaagtaaatctcccgctctttgatgtactatggagttaaagagtgatgggggtagcatcgaattataaagtataaaataagaactggagcatcatgtatatgtcaattttacaagaaacaggatttaggcaagaagtttaaacctaagtaactaacagcctaagttctaaagcagtactctatttagctcatagttccataatagcagaaattatatattggtttggcataagcatcattaaatgcttaataaaatcttgcgggtgtttgataagcaaatttctctagcttgatcatgtcctattatatgtagcaatcagaaaatttcagtcactggcataaaacagaacaggtaaatgataacagaagtactacctcatcacttatatcgttcatgtatagactgagccatagtaaagactttgtccttttgatgaactcagcaacatgaagagaaccttcagaggtaatgttgttgttaccaatatccaaaacagtgatcttccctgtagttcatccaagaaggccaaaataggggtaaactaatcccgtaagaagctactagttgatttgtttagtgcagaaaatacctttgtgagcagacaacgctgacatcaatgcacgtactccctcattcccaaaaccattgccatgcaaatgaagttcctaacaaaggtttaaaacaatcaacaatctagttattatggtataatgaatgtgcacctgactaattaagtaagacaggaacaaaataccatacattcgaaaagaaaattgagaaaaatggtaaaacaatagctcatggaaaaatttcctagtttactattgaacaaaaggttgtaacttgcatggattcttaacacattgtttgcttttagtaatacatggtattggtgttgaaggagtttaaggatatcagctaaccaatactccctccgtcccaaaaaaagtgaatctaagactggatgtgacatattatagtacaatgaatctggacagaggtatgtccggattcgtagtactaggatgtgtcacatccaatactatattggttttttatgggacggagggagtatgtgacaaaaatttcatattccaataggagtacaattttccttaaattgagtaaaatttaattaactggcctttaagatgcacgtgttgtgtattgctggcaatttgatccaatttcttacacaacatagagagttcagcacaaaaatgcgggtgcagtacatggacaatcacaactgtgcactgctccccatgattgctgcaaactttaaattcaacgcactttgaaagggtataggatagtacatgtagcttcacatgcctttggagatgcatgtatctattatatgggttccttttttgcttgtaggtatctatgattataagtgcaaaagctagtctaacaatcttatgcatcgtaaaaaagaaaaagagaaggtctaaccatcttgtgccatgcatcctttaatattgagaatgtcacatttttaagtgctcacgttttttaaacatccactcagcatttcaactttaaatttgagaagaaagtcaatatagtacgaaaccatcagaaagaagtaggagagaaatttggttgcatgtgatatcattcatacaaaaaagtacttaccccatcagtaatccaatataaatattgtatgtccctaatataaaataaaaccaaaaagatagaatggcatctggtttgctcacaagatttgcaactttaccaaacattcgaacaatcaaactacactgaagtatttcatcaagtatgtgtggagttgtaccctcaaagttttgttccctagaattccttttgctaggctggatgcaccaagaggaccaccatagttgccactagagtaaatagacaaagtacatgtcagttagttccagaaaatgaactaccaatgtaatcactaccgcagtatctcagcacaacttcatatgcacactcatcatatatcacatataaagccactgggttgtgagcaactaacttgacaaataagctccgtagcacattattctcaaggagtgcttctgcaatacttgcaaaaccctgctccaagaaaaaggagatatagtaaatagcaatccttcaataaacaatcatatggttagtttttcttttctatttgtgattcaagtgcatgtcttcgatgaagtggatacatatacatacgctgtattctattgtgttgttgctgagttgtaaagtacgtatcgtcttgttctttttcaacatatccgaaattgcttttgccccctgaaaagaaaatatcatgttacattgcagtgcacgcgcatgaaacaacacacaaagagtgcaagagagacagagagagggaaggagggagagatacaaacctcgtctccaatatttgtactgttcaataggagcttctggatacctacattctctaccaatatatctgaaagacactgtaagtattcatgagtgttacattcagtcaggaggacttagttaaagttaagtttacatctatacatatcatgctgggtaggttctatcatatttgctcccaatgaatgataatatcagcaagatgagtatttgaataatcgataaactatcacagtgtacaaactccagttaggcataaaggcaaacaataacaatgcaactcgtaaaaggtgctaatgtgaaacagccaaccttttgataacaagttaaaaggtaagtaataacatggttatgtaatcatatgagttcagacttcagaaaatgaaattaagaagagaacattgtctgcatagtatacatcacaccaacaatctacaaaaacaaaatgatacgaagaggcaataagattgagaagaccttagctccttcgtctccaatggcatttccagataagttgagagattttaaggctgtatttatctgaagaatgccatcaaaggcttctatccccacagctgttatcccattgccagaaaagtctacctcttctgcactctgtgaatacagagaacaactcgttttcaaaaagtattcaaaagagctagtatattagtaaggaaaaatcggtaagaaagtaagcatgtactcatgctcatatatggattgcaaccaaaacaatatatgatatatcggatatctgaccttgttataggctaagctttctgctagaaaaaacagaccctcatccccaaattgacgacctgccgagtaagtaaagttttaagtgtacaatatgcaacacaaatctgaaggctcagagcttggtttcagcattttctttcaaatattttaacttaagtacacatagactctagttacctgccatgttaacatttttcagagtcctgatttccttatagaacttatttaaattcttccttgattccttttcagcattaaagcttgcagatgttgacaaattggaaccagcggcaaaggaccacatgatcccagaaggggtagattctccagaactctggtcctttgtcttcccgggaagcaaattctgaaccaccctccatatgactgtcctctgaaacagagagttagtattgattccacacaccgcagaaaaaattacatgctctgtaacataacgtgataaaaatatgaaaagttcggcataataatccctctgtttcattatttcatattataagttgcttcgacttcttttgtaatcaaacatttttaagtttgataaagttttaaaaaaatatatagcaacattattaacacaaaataaacatattatcaaaacatattaaatgttagttttaatgaaactaatttattatctagatgttgataattttgttccataaatttaatcaaacttaaaaaaatgactagaaaaaagtgaaagcggcttataatatgaaatggagaaaatatatagcatctaacggtgtactagtatatccgcgagatataaatgttacaagcccttgagaaattcgcatgagcttgcaactgtggtaattgtgcacatattcagatatattctaccaagtcctgtgaaacgatgccatctaatgtgcagggaacagagctccccacgcatgttggatcaatgggagtcgaattggcgaagcaaaaggatgcgccgcggcgggggagggggaggaggaggaggagaaaacaaggcaaaggccgtaccaaagctcagggcgaggaccgccgcggccgggacgacgtacggcgagacgcccctgaccgccgccgccgccgccgccgccggtggtgcctccccctgctccacgcggtactccctccggcgcgcgcccccgcggccgacccccccggggggcctgtccgcgctgccgtcgaacagctcgcgcgcggcgcgggtcacggcgaacgagtaggacgcgggcgatgcgtggcgggacgaggacgaggaggaggggaggcgccgatgcggcggcgtggggagggagaggtggtgatggtggcggcggcgcggggcggaggggaggaggaccaagggcttgaggaggagggaggactccatgggaggcgggaggggtggtgtctagatggagacgaggaaggggagagtcgaagaggggggaaggtaaggttgtggatcatgtcaggtttttttggttttttttttagtattttggtttatccagtttttagcctggctggccaattcaacctttttttatcttgatttttgattcgttaaaacgatatttatttgagaggaaccaatttaatctatagatttacaaattttgcgtatggagggcactctttgtattaaccactctttcctctcgaagcaaaagtcatccaacataaaccatgagttgacatttggaagaatcctagaagatagccaccaacaatcctgatgagatgatgagatcacttctcttaaactaagggcctatttggtatagctccaactcctaaatttagctccaggagtttggtctggagtggagatgtggagctacctaaacccagttccacaactctagttcattttatgagagagctccacccagctccactcccagttttggtggagctgaaactgtttggctgagctccagctccaggaggggtggagctggagctggagctgtgcgaaacagaccctaatactccctctgtctctaaatataatggattttggtggatgtgacgcattctagtacaacgaatctggataaaacctctgtccctaaatataatggattttggtgggatgtgacatatcctaacacaataaatcttgactagattcgttgtactagaaatgtgtcacatcccaccaaaattccttatatttagggacggagagagtataataggttagagttagagttttctttccccctcaatgtataccaagtgtgttcacaaatcactccccccgacctagtataattacactagtagcatttatcccctaaagggtctatttgtattgaaatcgacaaaggtggatcccacttcatatagactgcactgagccataaagtactgatagatatcttttcagcgttgtatgctcgtttattgctatatgaatattctatctgccctcaaaaaatattctatctgcgggcaccctaggtaatataccgtccagtgtccaacgtgaccatcacatgtatttggataagtaggataaaaatacatttggtgatcacgttggatattggatagtatattacctagggtgccccaacactatccatctctctttccacaatcacatcatgcatatcacaagcacattctaactatctaagctaccaagactaagaaaaaaaagacaaaaacggagcccaaaacaatcatcgaagaagagcttatcgtaaggccgcacaaagtcttcgacttcacgagacaagtgttatcattgccgagcttgtcgcctagcgacatagcagctccaacttcacagctgttacatcatcattgccaaaggtatcgccaaaacgaacaaaacaacaccaactgcttgctttggacatcaacccaagccaaccaagcaccacttcttgcaaacacttcttgcaaacagctaacaccagcacccctagagactacaacgtgttatcgttgccgagctttgttgcaccacaacgaagtagcttcgacttcacctagccgaaacgaagaaagttggatgctcaccacaaccaagacaaaagccagaaggtgaatgccttgccaaacagctaagcctatggagtttcgacactggagtctaccaacgaccattgttgcacaggcaaggttcttgatagtggaggagaaatgacgccaaaacgacgcctccaaggagggaaacaacacctaagggtttcgtcgttgtcaagctagccaaaggctagccaaggctttcaccaacaattttcatccaacaccacacaacccacctgcacaacatcgtcaccagaccatcgcgttgtccctctagctgccaagcctagccacatcacccacagatcaggcaagttcacgccgcccccaatctggccatggcataccatttacgaggattaaaactgtataaaagtttttcttcctgtctctagctacatcttcatttgcatttcatactaaccgattgttccaactctatacatacgaatactgtagcaggaagtggaactttcttcgtcgacaatcaacatttgttagagaacggttttaaatagttacttttaccttgatactacttcatccgtttcacaatataagactttctagcattgtctatattcacatagatattaatgaatctagacacaatgctagaaagttttacattgtgaaacagagggagtagtatttaatttatttgttcgtgccttgataatcgttagaacacagcctaaagtatatgactacgaaatgatttcacttgtgaaagttgattatttccccttttttttcctctctgaacagcaagatattttctttttatacctactaatttgaatttctccgtgttatcttcctgcactaatctaagattagactatcaatgcttcgaggcaccgccgccgccgccgccgccaccgtgcgcgccgcgatcagccgcgcgggccgccgttgtaggcgtcgcaccggcggcgcacctcgccgttggcgccgttcttgacgccgtggtggctgagcctccgggcggcgcgcgcgaagtcggcgaagaacgccgtctcgttggcggcgtaccgctccacgtgcggccgcgtccgcgcgtcgccgtagagctcctggtcggtggcgaggaggccgaggcctcgccggaggttgacgaagtacatgttgtcgaacctccccggcgtcatcacgtcgttgaacgccgcgatggtcgggcccctccggtagtccctgcacgcctcctgcagccgcttcgcgagcgccgggttcatggtcgggtcggcgccgccaccgccgccgccgtagatgcgggcggcgaactccttgcaatgggagaagccgagggtgtgtgcgccggagagcgcgacgaggtcctggacggtgaagcccttggcggcgaacacggcgacgaggcgggagacggtgaggttggcgtgcgggatctcggcgtcgggcgccgacggcgaggaggagagcccgtccttgcggccgaggcggagcgggtagtagggcccccccgtcatggtgacgaggtcgcgcgccgcgacggcgaggaggtcggcgcaggagacgacgcccgggcactccacctccagcgccgccttggcgcgcgccagggcgtcgaaggcgtcacccgggagcgacaggttcacgtcggcgtcgcgctcggagcgcgccgcggcggtggacgcgaccagcacggacgcgtcgcagccgccgacgaagcagtcgtggaagaagaggcggaggacgcccgccgccgtcgtagggttggagatctgcttctgcgccagcacgtcggcgatgatccggtccgcgcgcgggcacgtcttgctgtagtagtccgccgacatcttggcctccgccgcggcggcggcggcgagcaatgccaggacgacgacgaggtgagtgtccatggtcggtttcttggcagcgtgcgatgctacacctaccttttgctagctagcttaccttcaggtatctgagatctcgccatggatggaggaaggattagatggcgggagagcttcttggaggagagcaaatggagggaaagagagtggtagggaatggtctcaggacttggtgtcaacagagttcataaagccgatcgattttcgttaaaccgttagggcttggttcgtaaaaaccgatcgatattaaccgggttctgtacgacattgatcgaaaatcgtcgatttttattggttcttcgttgttgatgaggagcggtttttacttcgaaaatgaaaaggggattttattgtccaatggaaatatggaataatttgaaattatcttatactccctccgtcccataatagcttacgtttttgactttttatttgcaacgtttgaccattcgttttatttaaaaaaattagtgtaaatataaaaaaagataagtcatatgtaaagtacttttgataataaagcaaatgataaacaaaataaataataattccaaaattttttgaataagacgaatgatcaaacattgacaaacaaaaactcaaaaagacaagtaatatggaacggaggtagtaattcaataaaaacaagagttagttgcgttcgataattcctcttcccaatttctactccctcgtttttcgcgcgaacgttttccgaactactaaaacaatatgttttttttaaaaaaaatatagaaaagttgctttaaaaaaccattaatgtatttttcaatttttaatctaatatacttaattaatcatataatagtatgttacctcgttttaatccattttgtaattattgcatgctttgggctgacggcgatcacatgatcaataacattttgggccctcgttttaatccattttgtaattattacatgctttgggctgacggcgatcacatgatcaattacattttgggtccttttggaacgaataaattttgcctgaggatctcaaaggacgctattcagtgctagcaaaatcgttgacaacttgagatgtgaattgcttgttaaaagagagattccatggagttggcatctcctatggctcatggcaacattccatagcttcagaattttgcaaaaacggcaacttagttcgatgcaagaatactttgctccagcttagcatgcatcaacaaactacacatgaatgacaaatccaaaactgggtaaatggtttgtctttcttacacatcaggaatccagacgagggaagaaggtacattatgtacagcaagcatatggtgaaaagaacctatatttacaactgcttacaaagggaatcgaaacaaaactaaacatacgaatatacgatgaaaagaatcataattggacaatggtggctgcacatatgacaagctatggatgcttctatctcacgatcacatcacgagctcggtctcttaattattttgatacagttcgatgagtggccactgaccaaaaggagcttcaaggggatcgaaaaaaatatttctccaaccatctcaggcctgcacccaatctttctagaataaaccagggaggggttctgttatgaatggtcagggccaaaatgctctgtattttggttaaacagtatgatgcagggaattacctgcaaaaaccaaaggtgaaagataagtatactgaggatacttcataagaaaatactaaaaatagcacagcgaagaatatattacatcactcagcatggctttctcctgtcaattttgaaaggaatgtttaaccatttcttctttgggaaccgctctttggttttcttttcgtttgaatcttcatctgcacttctgcatccacccgtgggttggtctttcactttcttttcctttctctgactgttttcctcctcacctttggaaaattttgaaggcgatttagctttactcctgcttgaactcctcttcagtggtgaattgttggtataggacgcatggatttcattcctttccttcagaagattatcgatctacaaaaagaccatgtggactaagaaaatagtagaatactccctccgtcccataatataagggattttag

SEQ ID NO: 1181 - DNA, 2993 bp, Oryza sativa
cctatcatttgatttattgttaaatatatttttatgtttacatatagttttacatatttcacataagtttttgaataagacgaacggtcaaacatattttaaaaagtcaacgacgttaaacatttagggaaggaggtagtactacactattaatatctggtcccacatgtcatatacatactatgtcttggagtccgtgctatatttggctacaaatctatagcccactgcttttctctcttcttatttatctctttataatatgtttgtagctagcttgtagcctgctattgtacctgctcttaggtacatctaggagtactccatatctttgatgttagtgatagcagctattagcctaataatctctctttttttttttctttttaactgttttgaaaagcaaagtcgttctctttcctctcctttaaagaaaggtttcaaaaaaactcaagtaaactgatccataaaaaaaccacccaaaaaacttatgatcccgttatagcatacttgtagtgatcctccaccatcacataaaaacatttttggtctcataaaatccgtaaaccttgataaacagatttctttaaaagccaaccatcgtaaaaagaccgaacaacccaccattgcaactcatgcttcatctctcctggagttgaagcccaaccaaacagtttcagctccacataaactaggagcgaagttggatggaacactatcacaaaatgaactagagaagtggagctaggtttagattgctccataactctactccagacccaacttctatagctaaatttagaagttggagctctaccaaacagagccctataactacatactctctttgttttatattataaattagtttgattaaatacaaaatattttaataatatgtttgttttgtgttagaaatgctatctttttttatgaatttgaaacttaaataaattgaacttgagaaaaggtgaaagtgactcgtaatatgatgaaacagaggaagcatttatgcgaagtgagcgttccgattagatttcttgtggtgaaaccaacccactcagattcaacttagacacaggtgctcggctattttgcggtaggcgacgtatccgtcgataacaaggcacccgtggtgactttgtaaatctcaagatatatcggttcagtcttctggctatgctcataggggtaggatgtgcgtgtgtgtattcataggaggtgagtgtacgcgtgttgtaagcgtcttcgattgcatattgttttaaaaaaaacggaggaggtatgtatgaagtttcagttgccctctcgcccctggcatgtggggcccgtgtttttgattgatgagccgggcccaatgaggctgttgccgaccggagtgactccttttgttgcatttgcacggttgctcacgcctttagactttatcaaatgatgatacttaataagcaaacataagtagtgaacgcttacatgttcttgtagtttaaaactgtcatgatctgttaaagtttatgttttaggctgcagcttatatagacagagacaatgtaatagtaccgttgttaggtaacatcatcacggttttctttatgcgaggataacaccaaaagctttagacctaacctaaccacttccgtcaaagaaatgacaccaccccataaatttctttgggcttgagctaaataaattagcccagtgaataggcttcagatcacaccactgattctcgaaaaaccgctgagtagcagaagtgagatttttttagaaaaaactccgagaaaatggtcaatttatcatattattttcattttaattacgctctagcctacttacttagcgggtcaaccgatcaatttccctaaagttaacgatttcttaggtttgggacttttgagctaaacagattttaagcatttggggattattcttagaatctgtttggaatgcattttttgctacggcttataagcgaagatacgttgcaacctccatgaattctattcttatatattatgttcatgtaataaaatcagctgtgttgctatatatttttgtgtacatgtgtactcactaactttagttttgtgctttacaatttcattttcactgaattagatggatagtataaatatatgataaaatgtttcttcgaaagaaaatccaatttcaccttgtcgcatcgcattattttcttgctgtctatactcattacatagagatgacattaacaccatcaatttaaaatcctagatctgaccctcgtagtttatactttataggcctacccctccgtctcaaaataattcaaaggttgagttattttggaacgaagagagtacacgagtatgactggtcgatccaaatacttcaaaactataagttaagacacgtgatctaggatttgaggcaacgaaaactaattttaggatatgacttatacttttacgtttaacattttcaaaagtcatggctgaaaaaagaaaaacactaaagttaattctaaaattaaaatttggctatggatcattagagcttaagctatattgacaggcgcgatgttactacagctcctttagttgatgacatgatcaatatttgaagctaagaccatagctaatcatgatctatttcctcgatttgtactgttaaggtgcagaaaaacgtgcatacaacattagaccactatagcattatttactgtagctacatatattgccgatcgaacggtgtacgtgcaccccaatgcacgggcgatgcgatttactgtagctgcatctattgctgatcgaaaggtgtacgtgcatcctaatgcacggacactgtaaaacctccgtagatagttgctacggcagaggatccatttccaattgatcaaggatatatgacagttgtttaaaaaaagatatatgatggatgcaggtcctctagaatgctagatacatatgagcctcataaatcctcgagcctatatatacaagtgagcactacta

SEQ ID NO: 1182 - DNA, 3604 bp, Oryza sativa
ccataggaatttcataggatttggaaagcttcaatcctttgaatcaaagggccaaataggaaaatttactataggatttgaatcctatgaaatttctacataaatcttttgattcaaaagggccctaatactttgtgcgtgacttgtctttttaatttttttaataattttttcaaataagacagatggtcaaacgttgagcacggaaaccagggtttatcttttttttggacggagggagtatgcaatactgcattaaataatactgtagaggatctagattgatattgtatttaacagtgccctgatgatgcccattaagtaggctcagtaagtcgctataaaacccacttaataatgtagttatatttataactctatttttactagtcaatcaaaaataaactactatttctgatgaaatttttttgacatttataataaaattcgatcatctatacccacaactagcgtatagggtcggcaaaaagtgcgagaagactttaccttttttttaagccacacaggcaagtcctcacacaagataaatacgagaattaaatacccttattatggaatatttcatcgctctatctctatgatatattaattaatagtaataacttctcttagaggctttaaaaatatatattaacttttttttaaaaaaaatccgttgcaatgcataggtattatgctagtacttttaaaattcagacaattaataatttcccaaatgcttagttctaaaacaaaacaaagggtatacgtagatttgctaaaaagtgctttcatgatcataaaacttagattttataaagttctacaaattgatggttggaatcttaaaagtttaaacagatcttttcctaaacattgaatatttatgacaagagggagtagtatgctagtttttttttttcagccagtggtacagcccacttgtatctctgttagcgttaagacagatcaataactgtaaaaggcacttgactttcactccagatgttcccattaagacaagcctctcaggttaacttgacagagtgcattgcaacctaaccaaagatcaaatcaaatgattcgcagtactaaacttcgtgtaaagcaagaagcaaactgcccagctgctccatcacatcacatggcagcacattgctctactccaaagcatacggtaccaaatgtgcatcaaggtccagtacgttgtcaatcaagattttcaaaagcgactacagttaagtttagtactgaaacctggttgcacaattgcccgtcccattggggcaggtggggtggcgagactcagatgggattgcactgatggtgaccgagaacatatgctgaatctaagtgacataccagaatctttagctcaccgtcagccactgcttgcctggaaatcacaagcctccttgtcaggcacaagacatcatgtgcaccagaaaagtcgaggatacctggtgcatacaattggttttggttgtggtctgttggtgcctttttctctgtttagcgcactttagagcaaaaatgttaggattcctttggtcagtgtaatcaatgagatatgtatcgattaagtcgatattcccccagtgttttgcttctcatccaaagttccaaactaaattccctagctagtgtcacttacatggtagaaatgagttcatatcatacaactgaagcctggaagctctctagtctctactgataaaacaagaaaccgaacctgaggtttccatcagatgagacatttcagcgcataaatccttttaccattagcattgttgggaggttatgacaccaccttcagaaaatatcaataaccacaaacaattcctacatttgcaaaagattatgtcatgaatgattgggtggagactggaacagcgattaggtatcatattttacatcattcagagtgcttttgccagtaagaaagtagctgcaagcaaggtcatatgattaacttacaatatcccaacacaataaagagggcatgattcccataggcaaataacacagtagaattttcattgaataaatttcatgacaccagaataaaacagcattgtaaaaactcagcatgttacccatgaagtataactctctttatttttgacataccaactataactctcttttaaacataggtacttccttaataagcaagaagcaagtaatagttgacctctctaggataaattttgggcctatattatgcactttaagatgtgcagcagaagtgtagtgcttacgaaaattctaaagttgagaaaccagctcatgatctaactttcgaataataaaacagctagttgaagaacatttactggagagcacaatatagttggcacgcagcatatacatatcatttcgaaatgggaccaagtagcttaccttggctattggcctattgcttcatcttttcttcagtgcaacaataacttgctagggggcacatagaatttgaaccggtggttttctggcctcctaactttttggaacatgattgacagagctttccatgagttacaaatagacaattcagatcaaattttagatcatcaggaattttgctgttcagatgaagatatgccctctctctgctagctgttgcaggaacccaaccaatagcgtttgtaatacggagtacctattatagaaatgtatgttattacatatacgccatacacactaaactgacttcttggtatggacaagaaccacataaagttacacatacatgagtatctactggaaaatcatccttctgaagatagaacatcagcacacacgccacctgtcataacatgcataattgcatatattagaaagatcatcagctatatgcacacttactcaagcagccaatatagtattaagcaagcaatcaaagagcgtaaaaagatattataaacattcacaagtaaggtcccttctttgatttgggaatgctgtttgaattccactgtcaatcataattgcaaaagtttccattgacaactccagccatgattgtaactaccacccttagtagaaggaaaatagttggacaattgcactccgaatacaagaatctagaagaagctccatgccattgcacggaggctaccaggcacctgtttctgttagccattcattgcaaagcaaaactggttgttggtgactaacacccatccataatcacacagcaatatttaagtataaccgacacaagcatatgatttcagtcacaagggcatactttctctaatttccttttcatacaacttagtaccaacactactgttagccaaaatactttgcaggcttttgcggaaacttgagttcaggctgtattaacttacatggcaacaagaaaagcaacttgctttgcttttgatcattatctaccatcatgcaaactacaactacttctcactagtcacattttatcaattcctcatccttcacaacaaaatcaatactagcattctctacattacgatgaaatccaacaggacgaaaaccaaattcgctgaagaaacaggagaagagagagatggaactcacagtctttggcccgatccctttgaaccgagatagctcagtcttcacc

SEQ ID NO: 1183 - DNA, 2097 bp, Oryza sativa
atggcgtcagtggtgttatgagacagcagggtcgtgaagaggccgtcaagcacggtgggcggcggagacgaatcgccatccgtgtcctcttccgggtcccggggatgtgtagagccctaggcggcggcggcgctggcggaaaggcgtgaactcgtcgggaaagccgtgtaaggcgaggagggcgtcgcggacggcgaggcattggccggggtaagggaaggggtggtcgtggtacggctccggcgagggcggaggcttccgcttgggcttccgggtcatctcgctggcctgcgcggcttggccggcggcgccgtgaaggtggcggttgccggcgacaaggtgtggtgtgggcgtgtggccgtcaataggtgaacaaatgggccgaacgtcatggcccggcccagccacgattaggcatggctcctgtagcgggccgtaccgtgcaggcccatgtgctaaggcgtcggcccaagcacggtccatggaaaatacgggcagtgccggcacgggcccaaatatgacatgtgggccggtataggcccattatcacgtttggcccacagaatttgaatacgaggccgaaaaaagagaaataagataaaaaggaaaattaaaagaaaaaaaaagaaaggacctgtttactttgatgaaaaaaaccttaccaaaatttgccaaaaattttggcaggatttcttatatagttaccaaatttggtagcaaactaaatgtatccactattttggcaactttattaaaatttggtaaggttgaaaatgtcatcaaagtgaacaggcctaaaattatggggaaaaactagaaaaaatgacaaaaatagtgggaaaaagaaaagaacatatggaaaatttgggaaaatgagagaaaatagacaaaatatattttaaaaataggaaaaatggaaaaaacagatgaaaaattatggggaaaatttggtggggcgatcgaccatgcgatttttttcatttttaaatttatttttttaatatttacagaaatattatatcggcgaaaagatttacaaaaatagacactaatgctctccatttgggtggcaagctgacgtggcacacggacgcatgacggtctttttagggggctgggaattttgggcgtggcccccttaccgccctctgtttgggcggcaagaggcctccgtgcaaaattcgcaagggcggcaaaggtctcatatgcaaaaagaaccatccaattgcttttttggcagcgcaaaaattgcatttagccccttaccgtccttacagagggctgcaaagagtctaaatgcaaaatgcgcacacgacaccgttacgacgccgtgtgccacgtcagcttgccacccaaatggagggcggaagggtctatttttgtaaatcaatccgccgatataatatttctgtaaatattaaacaaataaatttaaaaatgaaaaaattccgaccatgctcgtacttgggccgtagcgtgctagcccaatggaaatcgtgtcatcctgtgccagcccatggactcaagcgtcgctccaagcacgacacggctaaatgggtcgtgccggaacaacccacgagtggccgtgcttgggccgactatagtgctgtcttgtcaggccggtatgcctcggcccggtccatatggccacctagccgtgttggtggttggagtgggcaggtttgaggtgaggacgtcgaagagattgaagaaatgggccttgccgtgcttatgggccatgctgaaaagatgatcttggaccaaaacatgaagaatctctttttaaggcttgatcatgctttgtaatggtacatgcccttcccttataattaaagaatagttggttggacagattaggaataaagcacggcctacacctatataattggggattgactggatgggtggattgagaagaaagtaacaatactgcgatggttaagcccaataaaaaggaggacacggtaagaaggaacaaaagcaggaagataaatgtagttccccctgctttgagaaaagaggaaaattattgtacgggataccgtccgaacggaatagtttaatgaagtattctatgacttcctcgatacggacata

SEQ ID NO: 1184 - DNA, 3562 bp, Oryza sativa
agttccttggtgtgcaagagctgctgtgtttgaggttcttgatgtgttagagttggagaaaaataaaagttagggtggtccaaagtataattgagtctgcactctggaccatctgagccgaagacggaaggtatgaaccattgaaagcaccgtcggcccttgccacgaaccaaccctgatttccactcttgggccgcttagtaatgctcaattgcttttgagcacgcctaaccggctatgattatatatttttcaactagtgcttgtctaaactcaaaagatcactcattagaagattaatagtgttgagaaaaagtccattttactcctttagactatctccttgaagaacttaacctcctaaataatttctcagcttattttacaccgagaattattgaaaatggttcacttacttcgtaatagtatttcctgttgtattcttcaactccaaacttcaacttcctcattttccgttagcacatttttcaaattgttaaatgatgtgtattttaaaaaatagtttctatataaaagttgttttcaaaaaagcaactaaatctatttttcaaatttataatagttaatacttaattaatcatgtgctaatgaggtttctcgttttgcaatgaaatttagcaggaggattgatagatgtgttataacttacctctcaacaaattttctttagaaatgctttatcattgtttatatatgttgaaagcgtctgagactggtttaaacatcgagatttccgaatagtcatgataacttttgaaactattttggtattctgatatggtgttatttatggctctataaaatttcagcttaaaatatcactcgcataaagagaaacaaagaggagaactgttattaaagtaaagtgaacatttttaatagtttagtggtaaaatgagaaaaaaatatatttttagtggttaaatgattcaatgaaatagtttggagaagtaaaataattttttttattagtgtttcttgaatattcgacttcttttttacgttgaatgtaagacatgatttgatcacgtcaatatggattatcaaaaaaaagaaaaactatagctatgaatttaggagattcgaaattgttgtagctaggtcgacatggcgctcgagaactttgttcatgaagctatatctagctagccttgcacctttaatttctcggtactgaccaattcatttcttgcctttccagcgcattcaaaaaccagaaggatagtactgatactgatgctggagtattatttgaacctttcccgcagctcaacccattctcctttctcatctcgaaaacaaaaagacagggcaaaaaggaaaagcgatgaatctacaggttgaactttgccgtgcttttgctcctctcttctctttcatggagtaaataaagcactgaagaattttgaactctgaactatgctaaacaaaatgttctttctcatctctgaataaagcagtgaagtttgtacaaaaatcagaaatctgtctgattacacactggctaggatcattagctgccccattcttggcatcgtccgcagcagcatcagatacgtaattccagctggtagcaacctacaggctcatgagctgtaccagaaattctctctcgagggagagaggagcagcaaactaaattggaacacgaaagtcaagaaattcttataaacaacagtgctccattcagacagcaaattagttgagcttaataagttagcgttatcttaatcactgggacacatcccgtattttccgtatcagtctggcatcatctcgtccagcagataagaaaaacgccattgacattctctatgttgacccaagtattgggaggaagctatgaagccaattattgcagttcttctagctaatagctatacatgggtatttctgcatacataatatgtttttgtacatgtgcatttctgaagttcttcgttgtagattcagtattgcaaaatcttagtacatgtgtaatttttgcatacataatatgatttgtgttggtaagttgcttcatatttttcttgaagctttgtgtgtgtgtgtgtgtgtgtgtgtgttggatttaccccaaatttgacgttgattcaatagtactgtatgttctttaaatattgtcagttattcttgagaaaagaaaacactctccttaaacatagacagctccaaggtacaactaactgataaaatgctatttaatcggcatcatcagagagagccaacacatagatctcgccacgataagttgccggatcaaaacttcaaaagaacattatatttttatgagccagcaaggaacagaattcagaatctgtctgttgatcataaacaaatcgagagagatcagagcagtaccaattcctatttcctaagccacaaatcccaaattattttaaccaaagagcagccaactcagcacatcttttgtcaacgagaagcctattagccttgtcttatccgtcattagaaaaaaaaagttccatcatgctgttctaaacaacgatttgctctcttctctgtgccgtaccaccattagctgctcgatcgagacaagtgtaaaacgcacactaataattctacatgacctcctaacaaccgtgtgtttgtgcagaaatgatcaaacaatatcacacgattcaactctctccatgtggcaggatgactggatccaacctgataggtgacagcagcaaccgttaattggtgaggtcagtgctgattgctgaacaaatcgtactgtaaaataattttccgagaacagctgtttcagaacttcagagatcttcaggccagtaggtaggccaatctctttcctccacagatcatgccacaagttgtctcttactagtagtaaacattgttcagagatctttaattaatctctcatcctggtgcagttaatagtcatttccatgccttaattacgaggggagctatcaaggaaagaggcgtgacactgacactagcacagacaatgacactgaagccaggctgaggcacagttactgaatgggatccggattccctatcttaagttacacaacttttacatagcaaagtatagagaaaattttcctgggtacccgtgaaacttcacctaatcccttttatgcccctgagatttgttcattccctatcatacccttaaatttcagtttggatcccttttataccccttccattagttgaccgttagttgacagttaaatttatattataaagcccattttgccttttgatataagaaaatataaatttatgaagtatattgatggagggtataaatttattgtatgcgactattatatgcataagtttattttgtgagatattatttaacaaaagtaatattttagtttcgcatcgcaaagggaaaacaaaataatttttatctatgataaaatctattttagataaaacaaaaaaataatattctttaccattgaaaacggtatatataacatattttgttatactagtacggatttttaaaagataaatcttgttatgcgagataaaagttatttttgttaaa

SEQ ID NO: 1185 - DNA, 1473 bp, Oryza sativa
  unsure (1)..(1473): unsure at all n locations
nnnnnnnnnnnnnnnnnnnnnnnnnnnnnnnnnnnnnnncggcggccgccgccgcgccggagcagctacggcgccggggcgtccgggtcaaacaccacgcagttctgaaaagtcaaagtcttcgcttctcttcttttatttctttcttttttatttctttttttttttgctggctcttgttgaagtatttggaactgtatttgccataggccccaaaaaatctggtggttaactacttctgatgaatggtgttggtgtaattggatggtggattcttttgttggaattaagctgtaatttaattggatctttgcacatgttaaattctttatgactgaatagtggaacctagaactgtgacacctatccaaattaggtctgtacattaatccatcggttctcttagaaggtatgtatgtatgtatgtgttactgggatttctgagttctttttcctgttcttgtgaaatatttgggatgtcggtgttctttttttctaaaaataatatttggaagttgtagcatgtaaaaattctcagaatgcatctacttgtttagcttccatgattgagtttgattagcacgagatggtttcatctacggtttacgattccgagatggccttccgtttcgggatctggcggaattacggttttcgcgaaattcggtgtaaagccggtagattctgaataaatttcataaaccaaaatttgaatacaaattctctgagtttacggataagcttgcgaaaaccggtcggctttgacgaaattccgagtgaaatcatcgaaatttcaatcggtaactagaaaaagaggtaaactgaaagtgttcccctctttttaattcattattattttatttcccattataaatttcactaaatacatggaatacatcattttttaaaataatatatcccaataggttctatgaatatcatactatttataagattttatttattttttcctttttatcaattcaaatttgaatttgatgaaacttatcaaaatctcagacggcttctactttcgagcctcgtcgaaatttcgaaatttcgcggaattcgaccggttttcgtcgaaattgtgaaccctggtttcagctgaagttcggaaacaagtatcatctcagcatttcatggttgtcaccaactacaaattaaattttacattagaaaccataatatttctcggtatcttctcaaccaatgcaaactcaattaatgctgtgtttagttccatcaaatatatggacacacatttaaagtgttaaatgtaatctaataataaaacaaattacataaaccgtatggaaactgcgagacaaatttattaagcctaattaatatgtcattagcaaatatttactgtatcaccacattatcatatcatggtgcaattagacttaaaagattcgtctcgcaatttacannnnnnnnnnnnnnnnnnnnnnnnnnnnnnnnnnnnnn

SEQ ID NO: 1186 - DNA, 464 bp, Oryza sativa
  unsure (1)..(464): unsure at all n locations
cgagctcggtaccctctactctggtcgcaatacccatatcatcggatcgattcgctacacgaataagccgagctttatcggaactagccagtcgactctggacactgcaaataagaatgccgacatgctcggactcgctgcgaacggatcgatcatgatgggcgacgtcacgcaatttacgaatacgaccttgcagtacatgacgccaccattcacacatggtcgttacgatgacactggcaactggattcccgctttcgacgcgaccgtggccgactcgacggggaccctgaaatacaagtccgtggtcggtgatacgacgatttcgaacttggctgagggtatcaaccagatcgacgcgatcatgtacacgaacttcgttggcgggggaaatctcggtaccagcggagnnnnnnnnnnnnnnnnnnnnnnnnnnnnnnnnnnnnnnnnnnnnnnnnnnnnnn

SEQ ID NO: 1187 - DNA, 718 bp, Oryza sativa
  unsure (1)..(718): unsure at all n locations
nnnnnnnnnnnnnnnnnnnnnnnnnnnnnnnnnnnnnnnnnnnnnnctgaatttcttcagattttgcaatcttgagaagaatcaagttcgaaccctgcaactttggaaagtaaaagaaagaagaaactcctctgtactgcacctgccattacatgactctgaattccttcagatttcgcaaacctgcaactgcaactacatctacatgactctgaatttcatcagggttttggcgagtcttacagagatgctacgggccaagaaccaagaaccctctcctcctccttctcctctcctctccggcgtccaagaaccctcccgtgttccggcgccgccgccggatctggacaaggacaaggcgccgccgaagccgaagccacccaagcccaagcccaagccgcccaagtcggagccggagctgaacacgcggtcggcgtcggcgtcggcgccggagcacgaccagatggccgggccctacggcacggtgcgtgcgacgacaggaaagggagaagagaaggaaaccctaaccctaaatttgaaagaggaggggaaaggggggaaggaagcgtgctcacccgaaagaaggtggccgcccgaggagagagctgtgcccctccggatcgcgccgatcccgccgtcgcgtccgggtcttggtgcgccggcgctcctctggggaattttcccctcctctggagagatagggatttttcccgggcgg

SEQ ID NO: 1188 - DNA, 900 bp, Oryza sativa
ccctcgcgagtcgggagaggggggatttcccggaccggtcgccgcggcggcgtcgtggcgagaatctggcttggcagcgagtctcgagccgcgcgggttagggcttggatgttggagagggaaatggaacgaggcgggggaaatggattgggccgcgcgagttggtttaggccttaagctgcagcccagcagcgacgagatgggccaagtgccgcgaaggccccgagcacaccgggtgttcggcgtaaggaaaaagttcagctgaggtcccttatgccttatcttgttatcgtttttaaaattattatccctgaatagcagatataacacatcccgaattttacaaaaccggatcacattggatcccgaggcagtattgcttctggttttgtacaaataggaagtactccctgtgtgtttttcttggttttgtcctttatcaaactatgcaaattttaccaaatctattaaaactgcgataatattacaatatcaaattattttatttaattctaccattcaatataattttttagaatatttttgtttagtaaacttgattaaacttgataatgtttgatttatgacaaaaccagaacacctgatattttaaaacggagatagtatatcactacgttagtcatcataaatacgtctgtaatgtcgcatgatttttttattatatcttggttgatgttaaaagtgataatcagaatgagttttgcaagagcacaaaaaagtggaattggtgaaaaattgcggctgcatgcgaagctatatagatgtagcagcatgcaagttgtctacttgtctgcgtataaatctaccgcttcaaatcaaataatgatgctcgtcatagtattatcatttcttcagaagaatatcttcggctattactcc

SEQ ID NO: 1189 - DNA, 1532 bp, Oryza sativa
  unsure (1)..(1532): unsure at all n locations
cttgaaggctttttaagatcaaaatatatcttataaaaatcgatggaagtagtacctttttaacatcttgagaaattgtgtaagaagatttgaacgaactggcattgctcatctcaatgcagggaactgattgtggagttgacacatattttggtctttgcacatatcctgggcgtgagctgcgccatcgcatcgacctcaaggtataatattattccagcaggagtaatttggttcatgtcatcttcatttgacaggatttgtttcttattgattaaaactaaacaaatttcaatgttccttttgctgtttgcatctccagtgtcttcaatagtcttggtcttatgttcgtgacacatcaacaaagcactgctttgttctttgtccttttatttatggcattggcatgaatgtgattataaacttacaatccttcatcttggtaaataaaacaacatttatagtgatttccccatcgactatgccatgcaatatatgctgcataacattcatgtaccaactcatgctgataaaatggtgacaattcgatgttagaaggtatacccaaggaacagacatgcatttgggctgcttgcttggactggcaatgatgttctgaatcgacggtatgcatttgagctctttagtcatacacgttatcatgatcaggaatgcaagaccacagcttttttttacaagtttcgtaattgaaacatgcagattaagaatactagcagattccaaaggctacattcttgacgacactggtttgtatcttgctacaccgggcagtggtggaaagcgtgtatgtacatgtgatttttcattccaaatccatacaagttgtttgctttgctccattcattgtgagtttttgcaggggggaagatcagatgctataattaattgtgacaccgagaaggatgtgttcgatacacttggattcccctggttggaacctcacgaacgtaatctctagcctttgtcgaaacccttctgtagaaaatgcagtttgctagagctatataccttttgtatttcccctactttctattgccagtaggctggctgtttccaaacctgtctgtagaaattaggaaaaatgtagatgtagtttgctagatttttatagttttgttttctcgtactgcagaaaagcagagttgtttttgtctttgacacttgccgcaatggtcaaactctcttttgctggcatgtactaactgcagacaacagtatatatataactctgttgtaaatccatttcttatgacctctcagacatcacaatggtttgcaaagatcataagcagagtttgcaccgcagttgtgtctatttttcagtcaaatcaagattatttctaaattcaacaatgcaaggcctcacaaactatcaagcaaccatgcatgataacacaacggcaaaaaaagaagtgatgttaaaccatatcccatcggggcaacaatgaannnnnnnnnnnnnnnnnnnnnnnnnnnnnnnnnnnnnnnnnnnnnnnnnnnnnnnnnnnnnn

SEQ ID NO: 1190 - DNA, 786 bp, Oryza sativa
acccgagctccgactagggagacacaggaattatgcaggttcagccaaaggtgtaataccctactcctgtgttttatgttggtgtagttgtcttccctagatcagttgaatacaatacaggttcagccagaggtataatattgtactcctgtgtgttttgtattggtttagttgtcttccctagataaggaattatataggttcagccggaggtgtaatgcctagtcctgtgttttgcgttggtgtagttttcttccctagatcagctaaatacaatacaggttcatccaaagatgcaatatcctactcctgtgttttgtaatggtttagttgtcttccctagatcgggaattatataggtttagctagaggtgtaataccctacttgtgtgtttcgtgttggtgtagttgtcttctctagatcagctgaatacaatacaggttcagccagaggtgtaataccctactccatccggctgctttatttaacatgactgggtgtcgtcgcgcgccatcatcggctttgtctatcacccgccagcatgccacgcggagggcgggtccaccatgattcatgggtattcagttgaatacccaaaatttttgacaaaaaaaaattcatatatgtaatatatatttcatatgtatatgaaaaaaaatatgtaaaatagacttgtttcttcagagaagcccgacttagcaccatcccatcccacctccgtcctctcctcggctggtcggcccattggcccaatagcccatatcagcaaaagggaataatgaaac

SEQ ID NO: 1191 - DNA, 606 bp, Oryza sativa
attacaccaacaccattcatcagaagtagttaaccaccagattttttggggcctatggcaaatacagttccaaatacttcaacaagagccagcaaaaaaaaaaagaaataaaaaagaaagaaataaaagaagagaagcgaagactttgacttttcagaactgcgtggtgtttgacccggacgccccggcgccgtagctgctccggcgcggcggcggccgccggatcgacacgagcccctccgacacgacgctcccgtcgtcccactgccggccgagcagccccgtggccgtgaccgccgcctcgtcgtcctccccgcgcatcgcccggagcgtccgccgcgccatgtcccggcccacgccgccggcgccctcggccaccggcgtgagcgcggcctcgacgccggcggcgcgcgcgagccctcggaacctcaggctcccccggctcatcccgtacagcgacgagatgcagtactcctcctccgcgctccccggcgcggcggagccgctgctcatcagcctcaccacggcgggcaccgcgccgccgtccatcagcgcggtcctcccgtccgggcagccggcgaggttcgcgaggatcatcacggcgat

SEQ ID NO: 1192 - DNA, 258 bp, Oryza sativa
actgattccaactccacacaattactagcagaactgtctatcaatcccaatgccagacctcattttacactgaagcaaggcatattaatgtacaaggccagaatctgggttggccagaatggtgacctccaatccaaaattattgatgctgtacactctgcacccattggtggtcactcagcattccctgttacttacagaagaattaaagcgctttttgcttgggctggcatgaaaagaatgattcagcccagagtg

SEQ ID NO: 1193 - DNA, 695 bp, Oryza sativa
aacagcgattaggtatcatattttacatcattcagagtgcttttgccagtaagaaagtagctgcaagcaaggtcatatgattaacttacaatatcccaacacaataaagagggcatgattcccataggcaaataacacagtagaattttcattgaataaatttcatgacaccagaataaaacagcattgtaaaaactcagcatgttacccatgaagtataactctctttatttttgacataccaactataactctcttttaaacataggtacttccttaataagcaagaagcaagtaatagttgacctctctaggataaattttgggcctatattatgcactttaagatgtgcagcagaagtgtagtgcttacgaaaattctaaagttgagaaaccagctcatgatctaactttcgaataataaaacagctagttgaagaacatttactggagagcacaatatagttggcacgcagcatatacatatcatttcgaaatgggaccaagtagcttaccttggctattggcctattgcttcatcttttcttcagtgcaacaataacttgctagggggcacatagaatttgaaccggtggttttctggccttctaactttttggaacatgattgacagagcttttcatgagttacaaatagacaattcagatcaaattctagatcatcacgaaatttgc

SEQ ID NO: 1194 - DNA, 775 bp, Oryza sativa
  unsure (1)..(775): unsure at all n locations
nnnnnnnnnnnnnnnnnnnnnnnnnnnnnnnnnnnnnnnnnnnnnnnnnnnnnnnnnnnnntcttgctgttcagagaggaaaaaaaaggggaaataatcaactttcacaagtgaaatcatttcgtagtcatatactttaggctgtgttctaacgattatcaaggcacgaacaaataaattaaatactactccctctgtttcacaatgtaaaactttctagcattgtgtctagattcattaatatctatgtgaatatagacaatgctagaaagtcttatattgtgaaacggatgaagtagtatcaaggtaaaagtaactatttaaaaccgttctctaacaaatgttgattgtcgacgaagaaagttccacttcctgctacagtattcgtatgtatagagttggaacaatcggttagtatgaaatgcaaatgaagatgtagctagagacaggaagaaaaacttttatacagttttaatcctcgtaaatggtatgccatggccagattgggggcggcgtgaacttgcctgatctgtgggtgatgtggctaggcttggcagctagagggacaacgcgatggtctggtgacgatgttgtgcaagtgggttgtgtggtgttggatgaaaattgttggtgaaagccttggctagcctttggctagcttgacaacgacgaaacccttaggtgttgtttcccttcttggaggcgtcgttttggcgtcatttcttcttcactatcaagaaccttgcctgtgcaacaatggtcgttggtagactcc

SEQ ID NO: 1195 - DNA, 906 bp, Oryza sativa
  unsure (1)..(906): unsure at all n locations
acattttttttaaaaaaaggatcatttcaaagttactgacgaactgacaaagttttgcaaactacaagatctttcaattgatcatgtcgtgggttgggttggtcaggacgtcagagatcaggttacttacctcagtcaggccaatgcaccacgaggcagctgattcagagctgacgctgctcctgtgcgacatggctgcaggcgactcatttactgcgaatagcaccgccgctgccgccattgatgaggcgcagtggttcaggaactcgagctctgttccacggatggcaacaagaagattcttggatcaattagcgagcattggatgcagcgagattcaaggacaagtttagcattagttgggatgtttaaggataattactagcacttaatttcaatatgtaattaatgatgatgagactcatgtagtttttcacagaaaatggtgcaagtactattattttagcagggttaagaaagcatctgatctcttgtcacattgaactgtcaccaggaatccaggatgttacaaatgtgtttggattggcccaggtagtggatgatcatttagccagctaactggttgattgaaatggaaatccaataatctccttcctatgtactacaacagattttggtaaagttgtggtaaagtgtggtcaccatccaaacaccctcttaatcctgacgcaaatagtgctacctagcaaggttcagaataccggtttggcaggaacaggcctggtgaaatttaaatgctaattttgaattcaaatctaaatttagaattttacatgttcccgaacagaatagttctatattcaagttttacaatatgttattttatttatnnnnnnnnnnnnnnnnnnnnnnnnnnnnnnnnnnnnnnnnnnnnnnnnnnnnnnn

SEQ ID NO: 1196 - DNA, 696 bp, Oryza sativa
  unsure (1)..(696): unsure at all n locations
nnnnnnnnnnnnnnnnnnnnnnnnnnnnnnnnnnnnnnnnnntctttggtttgctcaaattcgtacaagctccattctgaacatatgtaaacaaaaaagaggaaacactttttagcttctcctttttgtaattagcttactctaagctctaagttacatctacactgacttcaacatgactagacttgagactgtttttcttctgctataaaaatgtacgcagttgcctttatctgttcaaaaatgaaaacactgctgtagcaactttaagacctttggtggtcagctgtatatctattttgcaccctcaatggtgatatattgctctgtaccatacaacatataactcctgaaccctgaggatttatatttcctagtgttgattcattgcttatataactaggaagcctcttctggagaatcctcaacgtatgctcctccagacttgaacaggaacataactgagattttggaaaagctgatcaatatatatagagggtaggacattgtacagaaatcttctcattcttcttattcatggnattaacatttcatatactttctctacaaataacaatttcttccttntcacttgaagccctgggagatgaccgaagatcatttagctattacaaggctattccagtgattgagaaattgccatcaaaatagaaagcgctgatcaaggtaaagacc

SEQ ID NO: 1197 - DNA, 1009 bp, Oryza sativa
  unsure (1)..(1009): unsure at all n locations
nnnnnnnnnnnnnnnnnnnnnnnnnnnnnnnnnnnnnnctttagctgattttgatgtccctggcataatatagtcaaaatttagggcaggcctaaaaatcatgagacaatagcaacaatttcgaggtaaagacactagcaataattaaggcatcaagcccagtggatttagttttctcttcagtaccttcaaaacttttctccaaactgccggttgatttcaatatctggtcatagtgaggtttgcaatataggacaccttcgacagaagaatagttactaaactgtaaaagataataaaaaaatattagctggtttcatatatgtagcttagttgcaaacagaacaagataggtgtagttctagctagtatgatgaggcataaagatttagtgtgatcattattattctcaacagaaatataccaaaaccaagaaaaaaacatgctagctgcatttacatccatgatgcattgaggacagcatgattaattccatgttattactttcaaaaggcaggctaatcatacggcactcaccaacagcataataccaacctagcaaatcagccagcactatatttaataggtgaaccagtcagttcaggaatatgatgaacagacaacagttgtaccaaaaaaaacaaacatttatttgctaccctatccattccagtccatccctcatgccacaataacaagaaaaataattgggatatttactaagacgccaagaaattgcgtcgaagatggattaaacaaataaaccgtggttaggcaaatttactgatgcttcgtgggttcgttatcacataaacggatagcaaagtgattggttatccagttagtcaatcacagtcgcaacttgattattgaaatgagcatgcaacctaactcccatcttcgactggtctcgagaaaagaaaaaaagaaaaagaaaaaagcaggccatacagtacagcaacaacaactaaagcattccaagatggatatgatttcaggaagccgatag

SEQ ID NO: 1198 - DNA, 623 bp, Oryza sativa
  unsure (1)..(623): unsure at all n locations
nnnnnnnnnnnnnnnnnnnnnnnnnnnnnnnnnnnnnnnnatcataacgtgtattctttgtgtgacattcaaagcatgctattgttgtggacagtgtgcccaacaccgacagatgtgaggtctgcataattgaagatcatcacatgtgcacatggatatggcatgagtcaacaggtttaaagaacacaagacgagcacaaaacaaaatccttgggcatgaacgcggttataccgggaagacaggaactcaagtactacaatactctctcctagttctaaaacagacaagctatcgtatgcacaaagtacaataaaggacaaccaatgacacttaaaaagtaaaaaactagcataagagcacttactgctcaaaatccagacatgcaaagagtgaagccattataatataatatataatgttcatcatatggtctatttcaaccatatgaatgatcaatttgagatcaatgctttcagaaaaaatgcatatggacagtaaatgacctacctacagaggtaactagtttaccaaaattttcttagacaagcataaatcatgccttattgctcttccccatgttcttcttttgtttcttcaagtagtgcccaaaaccaccatgaat

SEQ ID NO: 1199 - DNA, 780 bp, Oryza sativa
  unsure (1)..(780): unsure at all n locations
nnnnnnnnnnnnnnnnnnnnnnnnnnnnnnnnnnnnnnnnnnnnnnnnnnnnnnnnnnagtatattttttttaaattgttaaatgatgtgtgtttttttttaaaaaaaattctacatagaagttatttttaaaaaaattaaataaatctattttttaaatttataatagttaatatttgattaatcatttgctagtgagttttcttgtttcgcgtgcaccggaaatctttcttcaaactcatctatcgaaccaagcctgagtgagatccgatttggatttcgtgaaaaccggattaaaaatacaaaccactctttttttttccgttaagttcaaaaatccatagtgaattttaaacttttgataaaatttgccggattttatcggtttgttaataggttccacgaaatctgatgatacagcttgtgagtggattttgatccgatataggggctgatcttttgtgctgctttgcaacaagctatggctgtggctgggttgtatcggaaaaaatttgtaaatatactttttttttcaataatttaccattatatatatgcatggaaagaaattgtaaaatatacctatctcgcgacggtcccacaggacggtagtgctgcaccacgacggtcccacggatccaaaatgcgggaccgcgacggtcccgcgcgacaaaacacggacccgcggttagagcgattttattatccgatcggcactggttagtactggtttaaacactgtttagcactgtttattacagtcccgcagacccattgtgc

SEQ ID NO: 1200 - DNA, 434 bp, Oryza sativa
  unsure (1)..(434): unsure at all n locations
nnnnnnnnnnnnnnnnnnnnnnnnnnnnnnnnnnnnnncaccaatgacaagaggacgaactatgtactttttccgagcttaaattggcctgtaacgacttcggccatggacaagtcggcccagtgctttatctaaattctaggagcaaaaaagttcactttacgtccatatggcgtctacatagcactaaaagctcgtagatggtttttggctacggaacaccggctttgtaagtttgagtgacgtgttatatactccagtatagtattgcagtttaaggataatttgaactcgacgagtcgacgttaagatgagggaccttaagtgaacttgtacctatatattttctcgatcggataccggcccaagtggcttccgatgacggtaataataggaaccaattacctgggcctttttttcaatagcgcagaagg

SEQ ID NO: 1201 - DNA, 448 bp, Oryza sativa
  unsure (1)..(448): unsure at all n locations
nnnnnnnnnnnnnnnnnnnnnnnnnnnnnnnnnnnnnnaaattgatatcgacaccactattgagcaggctgtccatgagaggtatctggagggccaatgcgtaactatgaagtggatgccattacggctgcacaaaacagtccaatttcaggaattgggaacagttaaaatatcaatggtgtgcacatttccttaatcaagattctgtagcaatgtaacaaatttatgacacaccaaaatataatatctgtcagacatttacagagtgacacttactgatgatattttggtgatatccggggtctcgttctgatccaggaaaaccatttcttcaggcgacaaaagaagctcgatttttaaacagaaaaaatcgacggaataaagggagaaaatgaagcatttcaattcagctggacaagaaaccggaaaatgaaaaaagaaaaatcga

SEQ ID NO: 1202 - DNA, 574 bp, Oryza sativa
cggactcacactctcgtatatcctccctcctctcctctttcccagtggaatccatggctcctctcgtcgctttcgtccctgcccatctacacgcacgcacgcacatcacgcactgcgtctgcatgcatgcgtctggccggctccctccccctttcggcccggagaaaggcggagtacgtcagtcccatcaaaagaagccccgagtgcgcgctggatcgagagccgcgtgacacgatcgtcgtcgttgatccattccattctcgttggatgatcttggaaagtcatgatatgatgaacgtaacgtcccgttcttttctgattaagatgtaaattttattttcgtttttatttgtttgatttccaaactgctagaacagtgtatattttttcatcttaagtagaaacgaacatcacctaaaggtcctgctcgtcatggtcctagttaatttttacttccaaattttatactagtaagtggtaaacaaaattatgaagtgggtttttatgcggcagcgttggtaacgaagattcgtgaacggaagccggccgccattgatggaagtggaggatggca

SEQ ID NO: 1203 - DNA, 740 bp, Oryza sativa
  unsure (1)..(740): unsure at all n locations
cggcgtcgcgctcgaagcgcgccccggcggtggacgcgacaagcacgnacgcgtcgcagccgccgacgaagcagtcgtggaagaagagacgaagtacgccccccgccgtcgtagggttgaagatctgcttctgcgccagcacgtcgtcgatgatccggtccgcgcgcgggcacgtcttgctgtagtagtccgccgacatcttggcctccgccgcggcggcggcggcgagcaatgccaggacgacgacgaggtgagtgtccatggtcggtttcttggcagcgtgcgatgctacacctaccttttgctagctagcttaccttcaggtatctgagatctcgccatggatggaggaaggattagatggcgggagagcttcttggaggagagcaaatggagggaaagagagtggtagggaatggtctcaggacttggtgtcaacagagttcataaagccgatcgattttcgttaaaccgttaggtcttggttcgtaaaaaccgatcgatattaaccgggttctgtacgacattgatcgaaaatcgtcgatttttattggttcttcgttgttgatgaggagcggtttttacttcgaaaatgaaaaggggattttattgtccaatggaaatatggaataatttgaaattatcttatactccctccgtcccataatagcttacgtttttgactnnnnnnnnnnnnnnnnnnnnnnnnnnnnnnnnnnnnnnnnnnnnnnnnnnnnnnn

SEQ ID NO: 1204 - DNA, 594 bp, Oryza sativa
tcctcgcaattaattctgctaattttgtgcagtgaatttattcacagttagcttaggtgaagctgcactcgggtggcggcactgggcgcttcttgctattgtcggtgcagtagtcataggtcaggttccccctcacgccatcgtacgccgcctgctgcgccgccgtcagcctcctgtactcgccgccgttccaccaccacgtgtccggcgacccgcagtcgtccgagctgacgccgccgccggcggcggcggcgcaggcgtcgacggcgaaaccctggaaggccgcggtgaatggcgcgcgggcccagtcgaccttggtccggccgccgttcgtcgcccagtcggaggcgtcccacacgctcccccgcggccgcataggcttcgccgggaactcgaactccgggccccggctcgtcaggttcttcagcaccctcaccgcgtctcgtccacgaatattctgccaaataattaatcaaatcgatggcttgacatgtgatttgtcttaacttctacagaattcaggtggccattttgtagagttagatttatccaggtttaaaatctccgtctagagctgcttgaaagggtcaactg

SEQ ID NO: 1205 - DNA, 382 bp, Oryza sativa
  unsure (1)..(382): unsure at all n locations
nnnnnnnnnnnnnnnnnnnnnnnnnnnnnnnnnnnnnnnnnnnnnnnnnnnnnnnnnnnnnnnnttcgacgtcctcacctcaaacctgcccactccaaccaccaacacggctaggtggccatatggaccgggccgaggcataccggcctgacaagacagcactatagtcggccaagcacggccactcgtgggttgttccggcacgacccatttagccgtgtcgtgcttggagcgacgcttgagtccatgggctggcacaagatgacacgatttccattgggctagcacgctacggcccaagtacgagcatggtcggaattttttcatttttaaatttatttggttaatatttacagaaatattatatcggcggattgattta

SEQ ID NO: 1206 - DNA, 683 bp, Oryza sativa
aatcttcataactgaatggaatcgcggatgcagatttaagttatatcctcttcagcctggttacatattttgcagataggtgtatcaggtgcagaatttgttgctgattgtttgaagtacaacacaacattatctacattggatttgagggcaaatggacttggagatgatgtatgcacaatcttcgttgaattttatttataacttgcgctttgattcatacccatgccttctgatccttctctttttgaagggtgctatctgcttggctcgaagtttcaagatcatcaatgaatctttgacttcacttgacctgggctttaatgagattagagtaagtaaacactaaatgcagtgtctttttctttttgtattttctattggtgggtctatgcagatctccaccatgttcaataccctttatgctcctaacaggatgatggagcatttgcattggcacaagcacttaaagctaatgaagatcttgcagtcacatcattaaatcttgcaaacaacttcttcactaaatttggacaggtcagttgccgtaccagttggctattcatggtgtcatttgagttatgttttattcatgctggttgagtcaatgcaggttgctctgtctgaggcacgggatcatgtatatgagatgagcgaaaaggaatagacattttcttttaggt

SEQ ID NO: 1207 - DNA, 627 bp, Oryza sativa
  unsure (1)..(627): unsure at all n locations
ctcggtacccatcagcagtatacgaagtggcgaaacttgaatcaacgaccacccacccccaacctacccagcccaatcagtgcttcagccagcccattagtaagagagaacaatgagagatcgagataggcagctagggggccacaacaccacggtttcttcatgacacctctgcccaatgccgattagtgatcatgtcttgtcgttgaccatcgtggcgttgtcgagtctgaccaagctgccgcccacaggagccagggagtaaattctgaccattctaataccctaaatccttaaacaacacttttactagttcctaatctggagactatagtcaaatactcaattttgcgtataaagggatttggcagcaaggattagttccaatgaaattattaaggcctttgatcaacctggtatccgtagagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1208 - DNA, 654 bp, Oryza sativa
caggtcgactctagaggatccccactctccgcttttgacagatctgcatatcctcgggccaacttatccagtactccgtagtttgccgatttattcacccgccagaacaccgcctcacctgcatcggcaagccggggggaaaactgataccccagtagccagaacagaccgaaaataatatcgctgctacccgcagtgtctgtcatgatttcaactggattcagccctgtctgctgctcaagaagtccttccagtacaaaaatcgaatcccgtaatgtaccgggtaccacaatgccatggaacccagagtactgatcagatacgaagttataccaggtgatgcctcgtccagaaccaaaatattttctgttagatcctgagttgatggtcttcactggtgtgacaaagcgcatgccgtcagctgatgccacttctccacctccccaacgaccagcaagctccagtgtggactgaaaatcaaccaggcgggcattggcgctgaccagcgtttctgcacgaaggtaattctgtttcacccaactgagccgatggcgggtcagtgctggtatattgtgctttatcagcggttccagtccgatattacaggcttcagccatcaataccgcacataaactgatgtgcaaatcttgcgct

SEQ ID NO: 1209 - DNA, 744 bp, Oryza sativa
atatataaacagatcatatgtattcgatacaaactctagcaaatcaatataaagtaatatatgcaagcctaactaaccaagaacgggaggatgaagtgtagtctgcacttcaattattatggagaaatgagcgaatgaatcacaaatactaacaggataaggatcgaacaagctgacatattaggtgcgcttaagtggtcactgtactggcgaccaattttaggctgcaaacgttagtagctaggcaggcaacttgttttgaagagacacacatactgagggcctattcggttcaaggtataggaaaaacgtagaaataatatagaaatacacgtgtaaaataaaggattagaacacaggaattttttctacaatgagctaaacaaaagagaatggagtggatgttttcattcctatggaattagtacattttggaggttttttagaggattggcataatgttcctatggaaaatttttctttgaatcctacaaaccgaatgcatgaatagtgcttattccaaagggattgagatttcctttaagaatccttcaaaacgaataaggcctgacattatttagagcaaggtacatagctgaaggaagttactcctatatgttttatttacagttgactcaagtcaagatgatattaagaggcatcgactacttaaaaaacgactttttgctagcggtgacctcatcgacggcggatccaacgatagggaccacgagcgggtggcag

SEQ ID NO: 1210 - DNA, 584 bp, Oryza sativa
  unsure (1)..(584): unsure at all n locations
tgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttctatgcccaaattcctcatgatcgtcacgaagagaagtgccgagtcaaagtcaccttgaacagtaatagtgaagatattccctcagnnnnnnnnnnnnnnnnnnnnnnnnnnnnnnnnnnnnnn

SEQ ID NO: 1211 - DNA, 578 bp, Oryza sativa
ccgcactccgcttttgtgggatcaaacgggagaacgtcaggttttcgggacggatatcttgagggaagcagaagaaaaggtgaaaatcattcaagaaagattgcgtgtggcccagtctcgccataagagttatgccgacaatcgtcggagagatctaagttttgacgcaggagattatgtgtaccttcatgtcacgcctcttcgaggggttcatcgttttcataccaaaggaaaattggcaccgcgttttgtgggaccttataagattgtcagtagaagaggagaggttgcttatcagttggaattacctcaatttggcaggcgtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccaggaatcgagttatccgtttttggtaagtccagtggagtaatcactcggaagaagaatcaacttgggaacgagaagatgaattgagtcagctcatccgcatctgttcg

SEQ ID NO: 1212 - DNA, 393 bp, Oryza sativa
cggcgagcacgcgacagcggcgatggcggcagcggcgccggcatcgtgcacgactaccgccccgccgtgctgcccttctacgagaagtggagaaaagactacggtacgtacgtgctctctcgatcgcctcatcagctgctcgatcgaactcgaacgatcgtttaattaattttggtggtgcatgtgtgcgatttatctatcattgctctgcttacgttggcgttagcgttttaatttattttgttgcctagttagttaatataaaaaaatattcaatgttttcttcaattaattaatcttccaaggaggctgggcacgtactgcatatatacaaaggccaattattagaagaaaccaaaactaactctaatcgcatctgaggtaaatatggct

SEQ ID NO: 1213 - DNA, 879 bp, Oryza sativa
  unsure (1)..(879): unsure at all n locations
nnnnnnnnnnnnnnnnnnnnnnnnnnnnnnnnnnnnnnnnnnnnnnnnnnnnnnnnnnnnnnnnnntaatttctcgaacgctggaagaaacggtgagagttctctgcctgactctcccccgttactgtgagaacactgagaaaagtaatttctcgaatttcttcaaattccaatatcatttccttgttttcctacacgctgttttctcgaaaacaatgtcagtcacccaaggcagtcaatgatgagctccctgtggtgtacaatgatccatgcgaagtgggggcacacacatcactgaataatccgcaacccaacaattttcccgaccgatctgagagaggaaagcgactcgaatttcatggtcaccaccaactttcagatttttatgtcacgctgtgttttcacatgcctgccagagcccccaagcgaggtccacaccgggagacgggagtgtacatgatgcccgcaccgctcaccgctaactgaataacgccgcgttttctcgcgtttcgcaggcaacaccgccgtgcgctgcgttgcgccgcgtcgcgtgcggcgtgtgcccgcgtcaactaacgcaagttggtcaagtacaataggctcttcggtacaccaaagatacacataacgctctcgttggtgatgcatacgcgcagatgcggtgtctggttggttaacggcaaaccaccgccatacgaacgcggtttgtacgcggtgagccctctcccccacgttgcgtgttcagtttggttcgcacatgtgtagtgtaggtataaccgcttgccttcttttccggtctccttgccgtactagactagactaatatagatgtgtttggatcagggacttaactttagtatctatatttagatattaatt

SEQ ID NO: 1214 - DNA, 33494 bp, Oryza sativa
gcgaattcgagctcggtacccaaaaaatgaacaacaagaaaaacatcaaggtggttggaaagcagtgtgacacgaggtcttgcaaaattagagaagccaccatgtttggctgccttgcataaatttttgaaaatacgttgattacgctccaaccaaatgttccaccaggaggtgatcaggcaccctggagttctttttcgctgggtttttggtcgaaaggttgagagcaaactccaccaacttttctaaatctaaggtgttaggcaaagtgttttgacctaaaccctttcaagcgcaaattttgttccccacgttgatggtgaaaaagcattctttgaaaagatgagcaatgttttcgaaagcctccctacaaagagggaaaatccaatcacaaggccagtggcgttgaaggagattttgtgcggttagagttttttggtgcaagatgagccagccaataaaacgatgtttcagttcagtaggagctgactagatcctcgtaaaatcgatggtggtgaagatgccttgaaattgcaacatgtatgcactttttgagatgtaatttccgttaggcgagaatttacaaaggatatcatctggcaaacttggatggagatgcacgttctgaatgagggcgcctaaagaaatcaattcatggatcccctctattgtagtgagctgccgaaaggaacatcttttacatttgtgcataggggatttggaaggaggagaaaaaggacaatatgccactccattcgttgggtttagacaaaatgcacccactaaaatgcaaaggataaaataccacatgttaccttaagatattttgccactttgaaaaattttaagaccaaaatacccttgactgtggagagagaaaaagaaagggaaccgttctgctcgctagtgatggaggaggacggcgttgctgatgggagggaggggacggtggcgctgacaagatggcttcgcgcgctcgcagcttgccgcctccgacgctgcccacacgtgggctcacgacaccgctgtcctcctcccccgtcgttttccgcccttgtgcactcaccacccgccggcggcgagcacggacgccgcccaacttgaccttctccggtgcttccctctcccctctttcttcctttctctccacagccaaaggtattttggtcttaaaatccctcaaagtggcaaaatattttgaaggtctcatctattgagtgacattttaacctttgcattttagtgggtggcatttcgtctaagcccaatgaatagagtggcatattgtcctttttctctttgaaggaacatggatgcaaattgtactagtagtatatttgctcgctaaacaagcttcccttgataatagcagtagatatattaggttgaaccagattccctgaacttcctgcaattcaacatgaaacacgttcgtgctgaatttatgaggcctaaagctaatactaggagaaagaacaacaatttttgaacaaaactaacgccaatttgacagtttatatcgattcaatttgtaagattctccaatctactacaattcagcatcctgttgtgatggtaggtttgttgacttgaccacctccccatgtgttagtgttaccaactcatggcattttctacccaatatgattgtcctttgatcctgtccctatttgaaaagcccccgctccttggctgttgttccggacacgatcagattttattatgactgaaataactactagccaccgacgacgtggttccctttgcaaatcatgtgctatctccaggaaaacgtgcacccaagattcattagtgcccaacacgatccgcacctccccgattatccagatatttgcagccttgcacagctatacgtattgtttgtgaaggaaagaaagaaagaaagaaaaaaaacgaagcgttgaagttccttttccttctccagcttcctgtcaacggttggcgacattactttaccgtaaaaagtcaggattaggccattagcagcctcgccctgtttcttgggtcgtcatctactcatctagatgggcaacggagaggaacggcgactagtctggaatctggatagacgccgggcggcaggggtttgaactgtacgcaagggaataaagcgttcgtcctcgatctagatcgcctagaaacaaagcaaaggcgcccgcgaactggaccgggctaccgatgatgaatcagcggtgccggtgtgcaacagccgacgcaacggggtcggggcaagtcgtagtataagacccgtggaaaatgcacagatcacgtgatgaaaaggcccaaaaccaggagaggtggtggaacactggagcgcggaggacgcgcggtgtgtcaacgtgaggcgtgcggccacatatgcctgcagagactgggagggattgtgtacgacttcgcagcggcgcattccccggccgaggccgcgggttggcgcatgcggccgcggtgaaggcgcgcgcgtggttggctgcgtcttccgttctcttgggagggggctggtgcctggtggtccgagtcgtaccatgcatgtgcgcgagttcttcctaattccaacaacgctgactggctgacagtagtagtaagataatcagccattcagcctaatcataaagtgaccacatggatgatagttgagtttttttttccgtgacataaaagacagcaataccctaggtaatcacacgctgcgctctcccgtttaatacgtaacacacataaaccagagaaagttaccaaattaatccacaaaatctaaatgaaatgctacccaaagaaatgcactagcacttgtataaaatgtccaacatcattttctttacgtcgcacactagcaataatttctcgaacgctggaagaaacggtgagagttctctgcctgactctcccccgttactgtgagaacactgagaaaagtaatttctcgaatttcttcaaattccaatatcatttccttgttttcctacacgctgttttctcgaaaacaatgtcagtcacccaaggcagtcaatgatgagctccctgtggtgtacaatgatccatgcgaagtgggggcacacacatcactgaataatccgcaacccaacaattttcccgaccgatctgagagaggaaagcgactcgaatttcatggtcaccaccaactttcagatttttatgtcacgctgtgttttcacatgcctgccagagcccccaagcgaggtccacaccgggagacgggagtgtacatgatgcccgcaccgctcaccgctaactgaataacgccgcgttttctcgcgtttcgcaggcaacaccgccgtgcgctgcgttgcgccgcgtcgcgtgcggcgtgtgcccgcgtcaactaacgcaagttggtcaagtacaataggctcttcggtacaccaaagatacacataacgctctcgttggtgatgcatacgcgcagatgcggtgtctggttggttaacggcaaaccaccgccatacgaacgcggtttgtacgcggtgagccctctcccccacgttgcgtgttcagtttggttcgcacatgtgtagtgtaggtataaccgcttgccttcttttccggtctccttgccgtactagactagactaatatagatgtgtttggatcagggacttaactttagtatctatatttagatattaatttagagtattaaatatagactacttataaaactaattatataaatgaaagctaattcacgagacaaattttttaagcctaattaatctataattagagaatgtttaatgtagcattacataggctaatcatagattaattaggctcaatagattcgtctcgtgaattagtccaagattataaataggttttattaatagtctacgtttaatatttattattagtatccaaacattcgatgtggtagggacttaaaaaagttttagtcccatctaaacatgctcacagtaatacgtcctagtagtactacgtgcctcatctcatcgtacgcagttgtagaattcgatcaagacgttttcctgaaccatttgacttttacgtgtctacgataatataattccatactactccttccgtctcataatataatggattttgacattttgcttatactgtttgactactcgtcttattaaaaaaattatgcaaatataaaaaacgaaaagttatgcctaaagtactttgaataataaagtattaaagtaagtaaaaaaataaaaaaataatttcaattttttaataagataaatggttaaacagtgcaattaaaatgtcaaaatcttttatattaggggacggaggaagtagcaaacaattttaagacgtcggtcaaaactgatatcagatgtaattatccgttttcttttatcaaattcgtcacgcttacgaacgagccaaagtacatcgaaattgaaagatatcgcctccgccgccgcctggatgatttgggcttgccaaaccaactaccagaaatcaggaccaactgagagaaggcagcagcagactcgctaactgaacgagcaggccgactcatacatagatatagagcccacaaactcattaatctaccagcccagtccaaacgagaggcaacagtgcaacacgtcccggccatacatcggaccagtgtgcctcgagacgaagcaaagaacaacaggtcgagcaagcggcgaagggaaaagaagcggagatcgtcccctccccgccgccgactggacgcatatgcgccacggctgccggtgagcttccccgccggcgacgagtggacctcgccccacgcccggctagatccggtgccacccccgccaccacgaggtacatcttcccccttgcctctcgccccgttctcccctactcgctaggttcgctctcggccactactaggctttcctcgcacaagtcgatctagatgcctgatgccgctttcctggtggtttcatctggggcatatgcgagcgctgggtgtatggattgatctatctggttgaacgggtaggggatcctagctaattcctagcacgtatgctcaagggcgaagccaggatttgggaatgggggtgacagaccacaaggctattgtttatatgtatgtatatgctccattgtagctagataagaaacacgtatatgtattgagatacaagagaaggttcaatataggtagctagcagctagctccaacatcatataaatagcaaacaagacagcacatgttttgccatatgaaataaaattatatctcaattaacttaaatttagctctacggataccaggttgatcaaaggccttaataatttcattggaactaatccttgctgccaaatccctttatacgcaaaattgagtatttgactatagtctccagattaggaactagtaaaagtgttgtttaaggatttagggtattagaatggtcagaatttactccctggctcctgtgggcggcagcttggtcagactcgacaacgccacgatggtcaacgacaagacatgatcactaatcggcattgggcagaggtgtcatgaagaaaccgtggtgttgtggccccctagctgcctatctcgatctctcattgttctctcttactaatgggctggctgaagcactgattgggctgggtaggttgggggtgggtggtcgttgattcaagtttcgccacttcgtatactgctgatgtgatatattgtgtgtatgacatgtgaattctcggtagtggtcactatgccagcatctgatcaaatgatcattattcctgtcaaatcatttatcgtagtaccaatattgttttctttctcagtgcaaaccttgtggttttcttggaaattttacatgtaagtttcaattgcatgaattgtgctagtgaaaacaggtctttatgttttttttttggtctttattattttccagtaatgttcacattccaggacgatgacgtctttgcgatattccatatggagaaattatttcaaactaaaatacctactacctgcaggaatgttcttctggccgttcctagagggtcttttgattcttgcaaatgcattggcgatactaaatgaagaccgctttcttgcacccagaggatggagcatgtctgaagtctcaggaaatggacgatcaaagtcattgaagggtcagattgtaggactcatatatgccacacagttctttaggatgccgttgatagcacttaatgttcttatcattgttgtgaagttggtgtcaggctgatactatgaaggtttcagttgttgggcttgattgatttcaatttcaatgtgatgtaaaagtattcacgctaaatatttctgcagctatattaatttgtctatatatgtgccttgttattgttctagtaaattaattctaagcagcaaattgtttctttggcacgtataccatcagagtatgtttgcctgccaatctgctgcgagggttcccttttccttatttctgttctgaatcaaccacacatttattttcttattggtgtgtgttgtgctcggtgttgtttgatattcagatactgcttaaacggaaggtcctcctaggctcctatggtcttacctcatgtcagctggtgataaactggcccttcgtctggtccagccttagctgagtactagaaaatcggcgcgctggataatttatcctgtgagtttttcccctagggcacatgcatagtttctagagtaattactttaatactgataaaatctatgtaaatatcatatattcaaaaatatcattcaatgtgtacttagttttatgtttgtataatacctacgaagaattatagcatgacagtatacgcaaacaaacggtgcatttagtctcacgtttgtaattttaaaattttgtatataagctgttagaattagtaaaattaaaataaaatattttttatttcttgctatcttaaaaaattgtttaaccttttctataatatacttcctccgtttcacaatataagtcattttagcattacccacattcatattgatgtccatgaatctagatagatatatatatctagattcattaacattaatatgatatggaaaatgctaaaatgacttatattgtgaaacggagggagtaggatattaacatggttaagttacatgttttcagctttaaccaatcacacttagcactaagggcatgaataatggtacgatcaccgtaggagagaatgccacacagtatattttttgatgtggaggtgagtgagaggagagaggatacatacgtctattaattggtagacatatatgctagacacagaattttacatagatagcttaacactatatatgcactccatatacaaaatatagaaccaaattagtaattatataatgtaggtaatatgctatatgaattcttttgtatatcgtgtaaatatgatgtgtgactattatagggcaaccactctctgaactatttttcatgttttttttgggacatttcacaccaacattcctataatagtatgtaaatattgatatttgtagaactacttcctccatttcacaatgtaagtcattctagcatttcccacattcatattgatgttgatatttatctagattcattaacatcaatatgaatgtgggaaatgctagaatgacttacattgtgaaacagagggagtactatatttgtcagtttttatatttgtttatacttatcttttttatacacaaattttattattttttgtcttatttttaagtaatatatgaatattataacccagtcaaagtgtgtgcattttttctttattctgttgcagactataccatactttctctttttgagaaatatatgatgtgttagcttttaaaatggcattgacaccaaaatttgatcatcaatattcattctcattatattattattgactataaaactaatactaatttaatgccacaaataattgtatatgagaccaatatggtttgatttatttttttccaagcctgtcatatatgctacaatactcacatgtatgggttcagctaacaggtcagtgatagctaactcggccagcacaggtgcacagcacgggccaatgtagctaggccagctgggatgattgatttttttttatagaacggggatgagagattaatgagagtgtttggcctagatagcagggacgtgaggtgagacgacatccagaagctgctgttatttttgttttctgccgcacgaagacagcaatacatgcgcgagacactcgatcgtttgccgaatgcttcatggacacgtggcgtaaaactgaatgggggtaaacgaaccaatcagcttgctggagaactatttttatccatcttttatcaattgtatacatgtttcctggagaactatttttatcccaacctattatgctgtgtagtatatggtcattcttagttggctttaacattgtgcaatgctatcactgactttttgttattaatccatcatggacttgttaacttttagatgatatccactggaggaaaatggaattttctgttgaaaactgacgagtactcagagcatgttcatcatgcaggtatgctgcgaacctcgttcttgacaaacaatttcgggttcttcacttatttgacatgcatttacctttaatgtttccagtatatgttgccttttggtactcacaacataaccatatgatgttgacataaaccatttgtccattgacatcttccctatagttaaacacatttaagctaagttctgaaacatgccatgagtacgatcaagcctaaatagtatggagctgtatatgtacttttttttttcaagatgcattcatcatattacaattttctctccatcgacctggatagacactgtcattattatgtccaaatcaccaccctattagtgtctatatgcaccttgcactctcgttaaactgaggtccacaccaaattctggttccacaatgagtttcagtgttggagaatgctcatagtttggcgagagcttcaatacaaacttggagatgatgagggaaattagggttttgagttcagccatagcaaagccctgaccaaggcaagttcgagcaccagcgccaaatggcaagtaggaatgtagctggggttgtgcattggagaagcgctctgggttgaattctttcacatctggaccccacaggttgggatcaaggtgcattgtggaaacagggatgtagatgttgacaccttttggtatatgtacacccccaaacttcagttcctgaagggcctgccttgatacaaaggcgccagctgggtacaaacgcaaagtctcctggatcaccattgtcaactacaagcagagaggacctggaagttagtgagctattgtaacaaatgtacaatttactgcaaagtgcactaatggactgctcatagtcaagtcttgttttgttttgcaagattaaaaagatgcatttctttaattgactgaatggaagatgcagaaaaggaaaggagcatatacattcttcattttctgaagggactgagagtctactggctggcctgcacagacctcctgcacttcttcccgtaccctatcctgccactctggatgtagtccaaggagcattagacaccaggcagctgtgacagctgtgctctcatatcctgcaaaatatatactcttgcagttatccactataaagttctctgcctcagcgagctccaccttactgctgcttgcactaagaagaattgcacgtagtaagttcctttcttctccgctttccttcacaatttctagtattagtttgtgcacttgtttgtgaagctcccacgcttgcttgttcctctttatgggaaaaaacctacaacattcaaaattttatctcttgcaactgaattgaaatgggagtttcaacatgttgtctggaactgacaaaagttttaatttatactcttgcactaaagaaatgacatacttggttgctaaccttaggccagtcatttcagctagtacatttggcttggacacagccttttgtagttctctgatctttaaaaatatattctttcctttgatgtagctgcttccaaagcatgttctagagataacgtctgcagagtaagcccttatgtcatcatcaatctttatgtctatggtcccgccatttttgtctattccttcttcccatgacttaagcagtgtttgcgcagaatctaccatcagatccaccatgccctaagtatgtgaaaaaaacaaagaatcaggcaggcaagtaacactcattgttgtcttctgtctagctgtatgcttgttcttaaatctttgaattctaatttactgatgacaataggagaagaataaaaaacccttatgtaagtgtgataaatagctcatcagaatgatccaatgttactgaaagtggtcctaactagagtggggtatagcacgttatcttggtggatcagaatattgtagttttgctgtcgtgagtggtcctaatcagaaattttaatgctcgtaacacattatctagctggatcagactgtagtagtcactctgctccaggctctcttacgttgaactgtaattctaaattgcgtttgctaagcgggaacatgtagatccacatatttatttctccctgaaactatgaggatagctttgaatgcctacttgctggggcctaaggttttcctccgatgccttcaaatctttgttagcaacccaagtctatttgaacatatatctcactgtcagttcttttttggtggctatagtgggagtgacatttcagagtcattctgggcctcaacctcaagagtttcagtttgccataataatttttatttgcatgtatgatagttggatactaactggatattggaacagtgcgatatattgcacataccttgaccttgtccaggaagaactcacgggcaatgatctttctctggtgtgcccacgcctctccgttggatttgaggatgcccccaccgaacaggggctcgtgcgtcgccttgaggtaggagctcttgcccaggtccagcgacacgcagaggttgatgtcccgaaccacgtcaggccggctcacgtgaaggaacacgacgttccccatggagtaagtgaatattggacctgcaattgatcgtaaagttaaacggttaagatcatatatgaataaaaatcgtaagataaaaaattagattcaatcgtaagaacatatattgaagctgtttggttaaaggaaacgtatgtcttttctgccctttaagggcagaaacccactcttattccctttagttatactgtactaccctatgtattcatgttggttttcctctgaaagtacggcaagggttcattttaccattcgtcaatcgatctgagagctattgaaacacacgattgagaaaatagaggagtaggagaaaaatacatggttagcagggctgcacatataaaataaaagactgcaataatcatgataaaaaaataaccgtttggttaggctatggaaaccataggaatttgagagataataaaagacttgaaaggaaatttttcatgaggtctaaaactcatgttgattttttttccaaaacttgcacggattgaaatttcatagaattaaatagggtaaaatcatttgtttcaaaggagcatttatgaaaaaatctgtaggattgcaatcatgcaaaatttctattcatattctaaagtaccggtttcggcatacactctccagtgctagctaactgaccaatgacagtgtaacatgtcggagctatcttgatcacaaagaatccagtccagaaatgccacgcacgcatccgcttgtccaaatcaatccaacatggaaacggaggaacatttgggaccatcaatttggtagtatcatgcctggctcgagagcgctgcccctatcggaaagcatcagctggatgccctgccgggaactgacactgtggcaccgcgtacggttcggccccgtgccgcccgatcgaaaaccaaggcgcgccgtgcagaggccaaaagccggcaggatagacaaacataacccacggcggcgaccatctacggaacaacagtaatacagcacgtacgtcgggcgcactgccggtctcacgcctccctggcggccgccgcctcgcccaaccaggggacgccgccgcgcgcgcccgcccctgtccccgtcccaccctgttgatctcacacgatcacatcgcaaacgccggcaacggttcggaaatgggttaattgggcacatcgctcaccatcaaggctggacgctatgccgttggctagattagaagtggttgttcgaggcagagtggctgatatacgagtcctaattaataataaatggagtaatcttttttaaaatgttaaaaacaactttcttattcttttcacgttctcgttgaaaaattctcaagacttttcacgtactcgttgaaaaattcttatatggtgctcttttaaggtattccatggctgttgtgggcctggacttgatttcctcacgcctcatccatcgacacgtacgtgcggccggcgttgcatgcggttggcgtaggtggccgcgcgcttctatccgggaacaggcgctcactcgtctaaacgacgtgatatgtcggggttttggtgctatatgcattgctaactatgcaagccatgcccaaccaccaatcgggtaaccgatcttcgatcgtgcactagctagtataggagtagtagctaatagctctgcatcaggattcaggagctagccgtcagcaccatgcaaggctgcgagccgcgccggctatgtgcgataaataaattgatcttgatgcctcttatctttttgtgattcatactcatattattgagatgtgacttgattgtgcccccgatgggactttgattgttgaatttgatggccttttgcggattggttttatagcgttgttgactcgtcgcaccatcgattgattgcagttggtgtgttgtatattccctcggtccacatatatagtgaattctaggttttatagagtttaaggctcgggtgaaattgctttgatatcttgaaagtttacttgattaagaaagactatgactagtgagcaataaatatagtggttagatgatataggtaaagtatacttcaaaatctctacattcgtggacataatatgaatttttgaacataaagtctcttatatatcctatatttgtggatagagtggatatttaggaagaaacaaaataaaatgaatattttttagttgaggggaacgtatcctatgcacacacatcttctcgtgtatacactatacacaccaactaacaaacttcaaaaaaaatttctagaaaaatatatacatatacttttagttgtatcataattatgtctaaagtctcgtcttcaaaatcattctatatatggagaaaaaaaagacaaaattttggactatttatacccttaaaatcgtcagaacttttatcttaggctaaaatataatgaattcaaggttaaaactttatacataagtataatgctatcaaaagtacatgtacattttttctaatttttttagtgaaatatgttagttggtatgcatagtgcgtacacggaaagtttgtatccacatgatgtcatatgtatatatgatgtggaattgatgtggtgcataattaattggtttaggctttactaaatatgatatgttgtataattaattgaattttaattattataaacttaaaaaatagattcattatatatttttaaagcaagtttttgcgcaaaatatatcgtttagcaatttgagaaacgtgttaatgaaaattgacatgtcctgtctcacatagctatatgactgatccttgggaaaaaattctttatttgtttctaaagttgatcgattctctcattttatcatggtaaaattggatttttccttttatgctcttcattctcaaattttgttttttatttgtactttccgtacgtgagttctctgtcaacatagcattaattagtacatgtgtgcaaacatgattttgccattgtgcatcattttctgtgtatcagcaaagcttgtttattaattataaataaattatagattaggttttcacggttaagatgtatccataataaatgaagcaacaacaatagttttagggaagactttgatactgcttcttgttaaattaatgggctaggcccaattaaatcctaataaattccattggcctacattaagtgttatgggtaataataccaccttggaaatctaagtgaagaggtctcaacttaaatatggagctagtggagagtctctgttgaccggttgagatggtgcgcggacaactaggcggggcgaggcgaggcaaacagctgctgcgctctctcgttttgtaacggacggtaataaacaacggatatatactctcttcacgactcttgcactccgagttcctcctcctctattcctgagctgcagaatccttccccggttctgttcacctgcgcgcacaggtgtacaggacgagcaggtgcctccgaaactccgtccgcttgagaacttgcacggataggcgggcgatcaagtttttgggtagcgcttcaagcgcgactgctcttgttcttcgcggctactgctgctgcatcagcgccttcaccaagatgtcaacggagattggagacaagaagatgaacgacatcaacggaggcaatactgcctcaaaatccagcggtgggacattttcgaggtatactttcattctcccgattctattagatgtttctttgttaatactcttcgcaatggcagcattgcattactatataaatgtttatgcttatttcatattaagcatactcaagttgtatacatctagcactgtcactagatctactcatattgcaaatgtcatgtttattgtcttaatattttggattaaaatatgccgaattatgaccaaattttcaacacttcttagcttagttgttgaaagtcctagactgcaaaataaaaacaaaaatagctataaaattaagttttaaaatttaaattcgactgactgataagatgacgagcagtcaatgacaattaatttgggcctagcccattaattgggatttaattgggcctagcccattaatccaaaaacttagcctcgaacaaaagtgtacgtgctaaatgtacttcctatcaagtttttggattgttggaaatttggtcataattcggcatattttaatccaaaatattaatacaataaacatgacatttgtaatttgagtagatctagtgacagtgctagatgtgtacaacatgagcatgcttaatatagaataagcatcaatatagataagagaacgcaataatattgcgacagacagttgtaggaaacgaaggacgaatggtaatagtgaaacgttataccccgagaatggccttccgctggagtttgaggcagtattgcctccgttggtgttgacgagaggctccttctccttgtctccagtgttgttgttgtcgccggttgtcgacatgttggtgaagatgatgcagagcagtcgcgcttaaagcactacccaaaaacttgatcgcccgtctacccatgcaggttctcaagcggacggagtttcggaggcacctgctcgttctgatcacccgtgcacgcgggatgaacataaccggggaaacagagagacagcgcaggaacagaaggagagtatcgccaaggaacaatagtaggaggaagacacacactttgagagcctctgccttgcgttatatgtagagagagatctccattaccacacaaataaatctcatttgttgtgaaggttatcacaaaataaatcccatttgttgtgaaggttaccacataatgaatctttcatttgttgtgaaggttacaacaaataaatctctcatttgttgtgaatgttacaacacaatgaatctctcatttgttgtggaggttacaacacaatgaatttcatttgttaatggtgactttattctagtctgttacaaaacgaaagagcagcaggcaggcttggctcggtcggccgcctcgcctcgctacgcccacggccgaggccgactcggcatacgcatatgcgtgtggcagtccaaccatcacctcaaccggtcaacagggaatctctaatatcaccctatttaagttgaggttcttccacctaaattttcaaggcagtattattctctctaacattacttgtgggctcttgagattttaattgaattaaattgggcctagcccatttattccaacaatccccaccaaatttcatggctcacaagaaatgttctcaaaactgaacctgttagttataccagtgtttcgatggagactgttaagttgaacttccacctaggaaaagagctacaccagatcacaactgaacaatagactatgccttgaattattagtcttgtgcgattcaggtttcactcaaacccttaactggtattgggctgtcatttgcatcctctctgtttggagcgtataagtcatactcctggccttttcatgagtatctagagatcacctagatctcataaactgtgactagcagtcggactcatataggtgtgttccttctaagatgttctgtaggccaacatctctgctttatgaaaagccactcagatcacattaaggtgtataccatcctaccatacagattagaagagaagtgcatcatgaaaataggctcattttagggtctcttctctcagctacacaatagtttatttcgccatccaaattcacgggatctccgatcacaatggacaggtttccactattgtgcaactctaagtgggtctcaagcccatctccctcgatgcacagtctatcacattacgtggtagccccttggtaaattgatctgccagatttttagccgtctggacatagtccaatgctatcactccggagtttttatgctttctgacagtctttagtcttcttttaacatgcctggatgacttcatgttgtccttcgaactgttcactttaataatcactgtttgattatcacagttcattaggattgctggtactagtttttcaaccaccggcaaatccatcaggagctcacgaggtcgttcggcctaaactgtggcagtatctaaagctgtgagttctgcttccattgttgacctcgttaagatggtcttcttgcaagacttccaagaaacattgcaagacttccaagaaacagcgccccctccaagtgtgaacacatacccacttgtggcatttatctcatcagcatcagatatccagtttgaatcactatagccctctagcacttttgggtacccggcgtagtgaattccatagctcattgtcccttttagatagcacattactctttcaagagcatgccaatgatcatctcccggatttgaaacaaaccggctcaacttgctcacagcaaatgagatgtcaggcctcgttgcactagctaagtacatcaatgaaccaatgatctgagagtatcttaattgatcccttgctattcttcggtttttccttaatagcacactaggatcataaggagtaggagctgccttgcagtcactataaccaaagcgactcaagaccttgtccacatagtgagattgcacaagtgtaatcccaccctcatgtcctctcagtagtttaatgttaagaataacatcagccactcccaaatctttcatttcaaagctttttgacagaaagtccttgacctcctcaatcacattgaggctggtcccaaagatcaatatgtcatcgacatataaacacaagatcactccctctcccccaccatagcgatagtacacacatttgtcagcttcattcacaacaaagccagcagatgtaagtgtattgtcaaacttctcatgccattgcttaggcgcttgtttgagaccatacaaggacttcagcagcttgcacaccattcccttctgaccttctagtacatacccatctggttgatccatatagatctcttcctccaactctccattgaggaaagctgtcttaacatctatctgatggacgagtagaccatgagaggctgccagagcgagtagtactcgaatcgtggtcaagcgagcaaccggtgaataagtgtcgaaaaagtcctcgccttctttttgggtataacccttggccacaagccttgccttgtacttttcaattgtaccatcaggcctaagctttttcttgaaaacccatttgcatcctacaggcttgcacccatatgggcgctcgacgacttcccaagtaccattagacataattgagtccatctcactgcgtaccgcttccttccaatagtcagcgtcaggagatgaatatgtctcttcaatggttcttggagtatcatccacaagatatacaatgtagtcatctccaaaagactctgcagtcctttgtctcttactctttcgagttgttacaatattatcctcctcaggatttttctcaagcgtttgatcaatatgttctatcggcacaaagtgctcaggggataaaataggttctttactagaagtgctaggtgcatttttcataggaaattcattctcaaaaaatatggcatttctagactcaataattgtaccaacacgcatgtcgggtactccagaatttactattaagaacctatatcccacactgtggatagcataaccaaggaacacacaatctacggtctttggtccaagtttacgctttttggctataggtacatttaccttggccaaacagccccatgtgcgcaggtgagagagatttaatttcttcctttcccattcctcgaatggtgttacttccttatgcttagtaggaattctattcaggacatgacacgcagtcaatattgcctcaccccaccattccttggaaagtcctgcagtgtctaacatggcattcaccatctcagttagagtgcggttctttctttcggctaccccgtttgactggggtgaatagggagccgtcctctcatgaataattccatactcttcgcagaaagaaataaactcattggaaaaatactctccacccctatcagacctcaactgtttgattttcctttccagttgattttctacctcagccttatagatcttaaagtaatgtaatgcttcatcctttgttttcaataggtacacatagcagaatctagtgcaatcatctatcagtgtcatgaaatatttctttccccctttagtcaacacgccgttcatttcgcacagaccggaatgaacaagttctagtggtgccaaatttctcgcctcagatgccttatgaggcttgcgaggttgtttcgattgaacacaagtatggcacttagagcctttgactaaaatgaattttggaattaaactcatgttggctaagcgtgtcatactaccaaaattcacatgacagagtcatgaatgccacacattagactcatcatcatcattgcttacatggttcacaactttattacacatatcatccaaggaaaagcgaaacaagcctccgctgtcataaccttttcaaataaacgttccatattagatacgacacatttattagattcaaacacaagtctaaaaccatctctacacagtagagagtcgctaactagattcttctttattgaagggacatgctgcacgttcttcagctgcacgatctttcccgaagtaaacttcagatcgatcgtatcaacaccatgaacagctgcaagcgatccgtttcccatcaacaaggaggaacctctcccgacctgataggaagaaaatagggaaatgtcagcacacacatgaatattagcaccagtatcaacccaccaatcaggtgagtgacagacagagagaactgtaggtaaaaatttaccatacctcgatgttcctccgccctcactaataaccatgtttgcagacttcttgtccttgcgctcaggacaatccttggcccaatgcccagacttgccacacacaaagcaatctctttttgcctttcccttacctttcttcttaaaattggttgtagccttgggtttgacgtcaggtttgactttcttgttgttgttgtgggatgcgtgagggttcttcttctacaccaaattggcgctagaacctccctcgatctttttgcccaagttatcctttgccctcgccttctcctcaacacccaaagagccaatgagatcagtaagaccgaactcttgcctcttgtgttttagagaagtagcaaagtctgaccaagaaggtggcaatttggcaataatgccaccccgcataaacttgtccggcaactcacaattgttgttctcaagttcctttgccaacatttgaatctcatgagcctgtctccacaacagaacggtcatcgaccatcttgtagtcatagaattgctccatgacatacagctcgctgcggcgtcggaaactccgaacttggcctcaagtgcatcccacatgtccttccccgaaagcatgtgcatgtacacatccactatattgtcagtgagtacactgatcaatgctccacggaacaagcaatccgaagcctctaacttagccttctcctcaggagagagaggcggttcactcggtttgccccgtgagacaaagaaacaatgcatcgttgtcaaccacaaaagtgtacatggtttccatcttttataatttgaaccatcgaaagcatgtggttttagtgatgcaacaaagccaactaccgaaaaagacctagactgcaaaataaaaacaaaaatagctataaaattaagttttaaaatttaaattcgactgactgataagatgacgagcagtcaatgacaattaatttcacacaatatactaaatttaaagaatttcgcataactcctgattacgaaaataccatttaggttcaggagagaaattcaaccttttgtgcataacaagctagtatagaaattgctgaccatgcatgaaacaagttaaggggaaaaagttgtgttttcacccgcctactaacgacggtaggttgatggaaagctaacggaaaggacaaataaaatatgaaaagaatgagaatgaggagcaaatttcacgagagcaaataagggaatcaatcaattccgaagggcatctggaaagctaacgaagaagtttctccttggttttaagtggaagtctagtgcatctgaacaggctggcaaaaatttcaatttcctgcggtaactaaaactatttgactaatcgccgggtacatcaaattaatatgattgcattctagtgcaatcatatcatctgaacaacagatttaattaaatgcatgctcgactgcgatctttcaaatagggaaaaaggctaggttacttttatgggagcagagttgcacatggtgcagcatgtatactcagcttgatcccagcagtacttgtccttttgcatcgtttcgggccaaaactacatgacaggatctggctagctattattcaccccgttccataatataagaaattttaatattttacttatgttgtttgactattcgtcttatttaattttttaaattattattattattgacttactttattattcaaagtactttaagcacaatttttcttttttatatttgcacaattatttttaataaaataagtggtcaaacagtagaagcaaaatgttaaaatcccttatattatattatgggacaaagggagtactagcttatatatatataattagtcacctcgacactcattccagcttaatttctttatgattttaacccctttcaaatctttacatacttgtcatgatcttcacctttctatcaaatagctagggtccaaagaagttgtagaagaaggtgatggccagctcacctaatgtaatcttgctatccaacagtaacagcgacggggagggttgcttaattagcagcaacgagttggacgtgaacagtagtttagccaagctgttaacgttgggatggctacaattaaagtaagatcaacatcaagatgcaaatggtggattgattaattaattttagaagtaatcatttccggggcctgaaagggatgtcacttggtgacacagtagatatataacgtcgtaatacctttttttttcattgaaagaagaaattaaaccttttccgttttggctactcgaaattctgtctcagtggcttggctagctcagtaatgaatcaactattgagcgactctgtgttctgttactgtagtatattgcactcactgagttgcacggctgctgccataatctgttaactcagtgatgttatttttaaccaatcctagagaagcccagattccattggtctctagctactagtacctaaatttgtgggacccatggttccctgaacccacattttaaatataatataatatacttatggttactcttatactcacttttacatttactgtcaaatataattgatatcgccaacggttgcggagatatatagacaaacagtccaatagtacatcatggtcaaacaaacttgagtgaaaacaccagtactgataatagccatatttacctcagatgcgattagtgttagttttggtttcttctaataattggcctttgtatatatgcagtacgtgcccagcctccttggaagattaattaattgaagaaaacattgaatatttttttatattaactaactaggcaacaaaataaattaaaacgctaacgccaacgtaagcagagcaatgatagataaatcgcacacatgcaccaccaaaattaattaaacgatcgttcgagttcgatcgagcagctgatgaggcgatcgagagagcacgtacgtaccgtagtcttttctccacttctcgtagaagggcagcacggcggggcggtagtcgtgcacgatgccggcgccgctgccgccatcgccgctgtcgcgtgctcgccgtcggcgtcgcgcctccgccagctgatgcctggcggccgcgacggcctcccgcatgtcggcgaggttgccgtaggggaaggaagggcgcggcccgccgatgccctgcctcctgaactcggcgagcacccgccgcggcgccacccacacgacgcggtacaggtacgccgcgaggcagcacgcccccacgcaccacaggctcaccaacaccttcgccgccaccaccaccaccatgcccacctccatctctctctcactcactacgactctctctacgacgttaattaactaagcttctcctcctagtgtttgtgtttgtgtgtgtgcagagagaatgtgagtgtgtgtgtgggcgcgcgcgcgcgtgtttcagctggtcgtcagtgttgtgcgtgtatgtatagacggtgtccggccggggggggagaggggccggggttgcgagagctagagtccaaatggtgactttggcgcaaaaaaaaaaagatactgaaaaaaaaggagggaagttgcactcacacatgttgtacatgtatgtaggctacttcctccgttttatattataagattttttagcattgcttaaattcatatatatgtaatgaatctagacatatacatatacatagattcattaatatctatatgaatgcgggcaatgctagaaagtcttataatttgaaaaagaggtagtatgttatgttagctagggggtgtaataatacaatgcctccaaagtgcaatgtctatccattatgttgatcggatcccttatgttttagctttgttggtgaatatccatctcgcctctgtgatgaatgaacagatcaggggagagctagctgaagtgcagctctcaactaaccgatcttatcccggcaaagacgtgcgacaacctagctgctcattatattttcgccttttcgggtgtaaaaattagtcacatcgatcattggatacggatggcaggatggggctttggtcgcctgtagtcactagtttttcacaagcaatgcatgggtgcaaaaggggtaaagatgcatggggtgtttgctttcacccattcgatcggatcaataattggcatagtgtgtccagggtttgcattatcgtcggtttacgttcggcaacagggatttgctattagtgtgtggtaacggaaatcacaatgtatattcaccaagtttaatttttattttttaagataatattttttgtgtaaaatttgtctagtttttattggttttgcttggtaagtggtttggttataccgctaaccgacggtaacaaaaaaccaaaaccctgacagtgtgccatttatttaggagcaattttacggtctttaaggatgtacatgaggtaccacgtttttttattgtaaatttggtatctctgggtacctactaccttgtcccagaaaaagataaactctagctacgagtccaggttcgtagctactaacatggacatatgcatgtgtccagattcgtggttaggattggacttttttttgggacggagggggtaggtactgttaggtatcaaattttataataaatttttagtatctcatgttgcctcctcaagaattgtaaaattgatatttatttagagtgtgaatatgtgtgcaccttgattcaatgtacgagcagaggccttggatctgcaattttaagtacaaaaatgtttcgtaaaagaaaccgagtgaaaaagggagaaataaagtccatctccggtacacaaaacgatgtatacattaatgcatgattaattaaatttagctattttttaaaaaaatatattaacataatttttaaaaacgatgtatgcattaatgcatgattaattaaatttagctattttttaaaaaaatatattaacataatttttaaagcaactttcgtatagaaaattcttgcaaaatacacaccgtttagcagtttaaaaaacatgcgtgcgaaaaacgagagagatgagttgggaaagtgaaaaaagaactcagccgtatatcaactaagaacaagttgaaggagaagaaaatccatatttttttaaaaaaaaagaggaaaatcagtattatgcgcattgctttgattccgaaaggagaaacgaagtccatacattaatgatatcttttgtttttgcttggacatatttttgatatcgactaacaaacaggacaaaaaaaatgtgattccacacgtgggagtgcaaaaggaaaaaaataaagcctatatatattattaacatattagttatatggacaaaaaggaaggccgaagaggcatattttgagcacgtatctgaattctatggacattacttaaagagagcgctgcccacatatcaatggcagatagattcgatcctctctgcgatcgatctcacgaaagaagaaaaggcgaaaattggacatgagcacaaagtataatcacacaatatatcagtgcttttggagtagtctttcaatcgatctgccatacatatatttctccacatacgttgtactattatttaaaagtaagtgttgatgttggatgtgtctagctagctaagtgtcatgcttgtgcggccgtgcatgcatacaacggatatataggaatatatatattacatcgtttgtctaatcggacaatccaaaaatatcaagagctccatcgattggcgacgagctgatcattataatgccaaatgatttattagcgacccaagattagtatatatatatccttggagacttaaaagtcggatgctgaaaaagtaaatacatcaaaaatatcctaaaatcatctccaaaattaaattttaaattaaattttggcagcgcttaatttcatataggacaaacaatgagactgcaagagttttatgtgttgctgaattggcgggtccttagtccttatatgtgtgttgctatcatccttgttgctatcgtgggagatgatttagagccttcttggcacatttctttctaaaaggctacattttattttaaattttagaatttggtttttaaagttaattttaagagttttcttggcctcttttattgcccaagcctttatttcacgattgttaagaagatgactaattttttaacccaaaactatttaaaataacacatttaaaaatttaatttcttatggtactatcgaagtggagtttcgtccgttcgtctgtcatccctctcccgttgctcacgcagcaaattaaaaatttgctccgcgtaaaaacctagctagcccattaaaaaaaaaacaacccaccctctatatgaaaagagtcccaggactaatataaaaactgcatataggaaaaaggaggaattaattggtgctaagagacccacacctgcaaccaaatgaaaaccaaccctttgcattctgcgttaaccaaatagggcggaaagaggagaaaaacaaccatacttatacaccaaatgtcaacctggaatatttcttttaccttgcatgagttgcatgacaaatttagatttctgttgcaaacgtataggcaattatctggtactttagaaaatgcaaccaaggtgaagccttaattttttattacaggaaacgataagggaaatgtggatggtggcaggtagatttacatgcccaatagctgtaaaacaagatacccgatgacagtacagttgcagtgagagagatagagcgctgatggattacaggttggttctgggctgtccggctggagttgcgcccacaactgtgaggcagtacgaaacattagatcatctgggggcctttgcattgcattgcctttgccctgcatgcctggcctgaccaagctgagcaaagcccggccggccaccagccgcagccagcccatgtgccattcatcaattcctctcctcgcctcgtacaacagcgtgcaggctttacacctgcctgccgccctctggattagtttcactgctccctttatatccataaatataaaggattttagattgtttagtaaagttaaacataaaattgcttggatgtattgaagagtttattacttgattagaaaaaacaatatccttttacagtgcttaattgtaaggtatctcacatacctcccaaactcctaaaaatccaccgttgattttgggagggtaattaaggaaaaaaaattacgcaaacatggtttgcattgtgatttgtccttagacgtgattttctctaattcccttgcatttgttcatttcttctcccacggcgatgaaccccttatccctgattttcatcttcctaatcaccatagatttataaatttattgcatcttgaactattatatcagttaattaatatttagttacatatgattaattatatagttttataagtagttacatgacctatcatgccaataaattacttagttttactattaatttcgtaattcctgatcaattacctagttttggtacatgatctgcagcaattcgtgatcgatattgacaccctgtaatcagcgttgctagctcctgagtgtcatctttaaattcctgttaatatatttttaccgttttgcctttcacactttgacgtggtaatgatacaaattatctacttaaccttccactaaattacctagcccacatatcaaataccttctaataggtacctttgtgtttcaaatcgttagattgaacagaatcaacggatctcgttattttgagaaacacggatctttcggctagctcaataagggtgggctagacgatctgggtctgaagtttcaccccttctagttatttgatattaggtcctttcgtaatattgatgtcttttttcttagatctccttatttccaagcacaatagaaggtattgagaagatagtgctcctagcaatgtactattgtctgacagaattgagaagatagtgctccaaaaccccttaaatttgtgaataatttttaaaccccagaatatgttactctttatatcttaaaatataagaatctagaatcagatatgatattttctaatactacgaatttgaacagacaacctgtctagattcgtagtacgagaaaatattccatatgatgttactccctccgtcccataaaaacccaacctagtattaaatgtaactcatcctagtactacgaatctggacaaatatacgtccagattcgtcgtactataatgtgtcatattcagttctagattaattttttttaggacggagggagtatattccattattttaggacggactactgtatactacctccgtcccaaaataagtgcagctatgagtttccgcgcccaactttgatcgtccgttttatttgaaatttttttataattagcagttttgttgttataagatgataaaacatgaataatactttactcatgacttatgtttttaatttctttcaaaaaaaatttcaaataagacgaacggtcaaagttagatgctgaaaaccatgattgtacttattttgggatgaagttagtactattcctatgaggatcaccgtactgattttgttggatatattcgccgggaatcgtttcgatcagctgagctgatatgatgtttgtggccaagtggtggttgagtggttgatctgcaggccccgggcggtaggcactaggctcgagtgtcaccgtgagtggagagctaatagctgccccgtacagaatgaggccaaccggttgagacgataaggccaaccggctgcgtttccagagttgaacagatattttttcgcacgtatatattttaaactactaagcagtgtatttaaaaaaaatctttttatataaaagttgctttaaaaatcatactatctatttttgaagtttaaaatatttaatacttaaataattacgcaataatatcttatcttattttaagtatcttctcaatattatttattcctctctctcaaacacactaatatgagaagcattatagtaccatgtagactaggtttatgggtttaaaatttgagttttcagcaagacaagttgctttaaggatggttttgattttatattctagtccttaataccttttgttttagttatcatattttctcaatttgtgtggagattcaaaatttacaccgaacaccctagaatccagaaaaaaatacaaaaatctccatcccccctctctcccttatcctctcagcatctccctcaatctcgctaatcgctaccggcggtgactcccggctcccatctccttctgaccaatgctcctcatctcctcccccgaccggcggccctcctcccctggctggcatgcgcgtggagcatgttgaaggcgagatcgacggctcgggagtgggggatggcaagacttggcggtgcagatttgggacgagctagctcgagctcctctccctctccccctcatgtcttcctcacggccggggccctctcctcctcccccaaccgacgcctctcctatcctctcctctccaccccacctagtcgacgcgctgatgagttcaacggtgcggcacgggggaacaatgatgagctcagtagcgtttgtcgagggcagtagaatgagccgacaagcttctccagcccccaccgccttccccatcgagccgtgcgggcttctccagcgtagatcaaggtgggcggttagggcaccatcgacagcccaacaagctcccttcacctatccccaacctccatccctcaccaagaaaatctgcattcaccacctccactcccctgctggcacccatctcccttcaccactcgatggcgacagcgagatccacaagacggtgaccacgagctgtggatgggctgagggtttgagaaggccaccattgggctactgcggcggacgggtcgaggccaccgccaccttctcgagctcatactcatcgtccacggccgtgatgttgccgacgcaacccaagtgctccacgaccatgaggatgacgcccggtcaccctcctcccctagccaatgaggttggcggcgtggagcgcaggttggcgatgaggtccctatcctcccttctctagcggcaagggacatgagtgtaggccagacctgcaaattttgagcaagaacctatggctcatcttgtctccgcaatcttcatagggcaacgagaatggcagacgtggcacctatggctcatcttgtctccgcaatcttcatagggcaacgagaatggcagacgtggcatggaatctctgacctatcatgctgaggctgaacgacatctcagtgcattgtgaaagcaccaagagcaagttttatagtgaaggtgacaattacctttaattttagtcatatcatttactaggaataatcattgattaagagataacatgtacatcaatttacacaaatcccaataattttttggtggttcactctcataccatctcactttgctcttggaattgtgtagtggtggctcatcctctctcttctcacttctccctttcacctcatcatctaatcttatatggtatttttagaggacttgctctaaattgatcggcgagcgttcacgatacagctggataagctcgatgtaattcaaggatctgagtgatcagcaatatgaattgtagaccccggtgagtttacctattggtagttatggatttattcttacttcttacagtacatactcttgttttttagttgtcggtcaatgtcgatccagaacccattttctcgagtaggtaaacctgcctgtgtccaagtgtttgcgaaaataggaattcttcaatcggataacacaaccacgagcaaaaagatttttttgcaggagaacgtgttatgctgcccatatgaaaaagaatttcggcgaaaaaaattccaaaaaccaaaccctagcccccaacccagaaaaccctagccacccccaccgccgccaccaaaaatacattgccgcacggtggtgtaggcgcccatgccgtcttcgagctcccctgcgccggatccaccatctttgaggtcatagtcatcggatccgcgtcgttgaggccgttgctgccacccgctcgtggtccctatcgttggatccgccgtcgatgaggtcaccgctagcaaaaagtcgttttttaagtagtcgatgcctcttaatatcatcttgacttgaggcaatgtaaataaaacatataggagtaacttccttcagctatgtaccttgctctaaataatgtcaggccttattcgttttgaaggattcttaaaggaaatctcaatccctttggaataagcactattcatgcattcggtttgtaggattcaaagaaaaattttccataggaacattatgccaatcctctaaaaaacctccaaaatgtactaattccataggaatgaaaacatccactccattctcttttgtttagctcattgtagaaaaaattcctgtgttctaatcctttattttacacgtgtatttctatattatttctacgtttttcctataccttgaaccgaataggccctcagtatgtgtgtctcttcaaaacaagttgcctgcctagctactaacgtttgcagcctaaaattggtcgccagtacagtgaccacttaagcgcacctaatatgtcagcttgttcgatccttatcctgttagtatttgtgattcattcgctcatttctccataataattgaagtgcagactacacttcatcctcccgttcttggttagttaggcttgcatatattactttatattgatttgctagagtttgtatcgaatacatatgatctgtttatatatcttgtccttcacttattatgttcgagtttttatagctgtttggtttgcacgcacgtcctgaagccacatgttctaatgtgtatcttaacgatgatgacactagtggtaaaaagttaattagttggtttcactctcaatgcatgcggaatgtgtgccccaacaggaagattcatcttgtatccttgtttggcgttacgtgggccgaattgttctgttgtcttcttttttcaaagataaactagctgattgccatcctttcttcttacgtggtgtcacctggaccctttttttttccttaaaaaaaagataaagtactccagattgtccagtgcaattttgcacggagttaatctgttttcactagaagcaacctacagatccaatgtaacttatgggtattccgaatacccataaactttagacataaacctagcatacatagggtatactagtaatacatacctccatatcctagctagatttaatatctatacctctaacaacccaactttatccccttctagctatcctctgtccaaaagatcgagcaacgggctctccctagtccctcccagtttggcaccattcatgctaatttggttagctcactcgcttattggcttcagcaattgatgagcaattagttaagactagtatatatctctgaatgttgtatattcttctatttcctctgtgcatatagcaatagagcttggttgtagctagcttcacccacctagttgtttttctctccattttgttatgtaattgatgccaattatcttaaagaagaagatccattcaattgccagtagtttctttgtggttgcaagtttttttcttcgtcaacacaagaagttaaaatatccttgctacataaagttgtcaaccagtgcaatataatctcccaaaagtctgattgtttggtactcttgacaccttaaattaacatgcagagctcctaccaaattttcttttttaaaaaatggtttgatgccaattataacaagtcatcaaattccttcttttaatatatatatacgcacatgttgcgatatgagtggtgtaattaagaaaatggtgtgtatcaataccatcgacatattgtatcgatatcactatatctaagcaagctactatagtagtttacaaatccgaatgcctccctaagaagatgaatctacacaagaaggagattgtgcaaacccgttttcggcgattcttgtgtagaatccccaaagatgaatctacacaagaatccgaatgcatcgagcaacactatgggcccagcctctacacattttattgacataaaagcttctacacatcgaggataggattgtagtttcttcttgcaaagaaatcctctcttcctcccttctatccatatgatttgttcatgtaaagaattctgtacttgattatctttcaaccaaaattcaggtggggaaacccttaatttcttaaagaagaaaacccgaatatcctataaatcctagctctaccactggttgggcctcaagccagcccatttgtcacccagcatcgcggcctaatttatatggcccagaaccgtgacattgattttgactgttgacatttttacacctatccatttgtgctttgttttggacgtctatgaaatgcaccgtttgaaaattctacaagatgacttgttggcattgaaagaggccaatagtgatatggtgatgttgtataccattgcttgtcatggtgatacaagagaatataggctgtcctatttatgaccttc

SEQ ID NO: 1215 - DNA, 9593 bp, Oryza sativa
catttgctgcacccaactgtttttttgggtcatggccatttgacaaatcctcatatgccagagtataccagcatttagccaatttatgggaagagctcacatatggaaaaatcaggtgaaaccggtatgttagtaatagtaaattagtaatacacaaccaaagctcttataagcatgcttaaaatagcttatagaggagtatttttttcacaaaaaaaaaacggaactcatattttgtgacacatagaagataaagtattttaggacccttgtcgcatttccaagatggactgtgaacttccttcctttcctttgtactctctgtgaatttgtcatcttaactcctaagttatcactctcgcattgcttattatccataatctgctataccagaatagcaagctttaatgtcctacaagataatggcgttgcattgcctctattgtccaatcaacaattccatggcaagaatgcattaaaataataggcatagatgggctaccagctggagtagttacatcttttcctttatattgtatatcatggaacataaactctactgttgtgtggtactattgccattgtggcccttagaagaagaggtgaagagatgtctggaaaagggaagaggcgaagtgctagattactgaagcttgaagagcagaagaacgatgacactactgccactggttgtctcctagatccttggcagataatccgaaacagcattgctggtgttcgagggaagagaaaaaggaatgaagaaatccaggtaattgtctgtctaggtagtcattaggtaccctgatgaactctcatcaaccttgccgttctcatctcatcttgatctgtatgttctttcagcatttgcagggagaagcttcttctagccaagcactgtgtgcaacaaccgatatcagtaagaatatttgtttctttttgttgtctcgatgtggtgttgcttgtgcaaatctgaatttctgtaagagagagagaaagcagcatatctgaattctgccgcttcgtctttcagataatttgtcaagcaaaagttcagcagtacaaatcattgagtacattcttgatacactagagatgtaagtttgaactatcgtgttcttttggcttccacatcaatcggagcacagattttgtatgatgactgatgttaaggatatatatatatgcttatattatcttatcttttcctctgttgcaggagagacactcatgagttatttgcaatgcctgatgacatccaagtaagccatggaggaatatatcaaaaaatatttaagttcatgttaaagaatgataatacgctgtttgttctctcatgaaaaaaaacattaacaaatcacttatttcttggtttcatgtgctgatgtactatgtgttattatcttatagaaagataatttaacatgttaacgcaggtaactgattatgcagaacgggtgaacaggcccggtgactttgcaacattaaggcagaagaacaaggatggcatgtacaacacactggagcaattcgaggtccacctcgttgctcatttcccaaatcatcctctcttctgaacatataaagctgaatattatcagttttatcggcttcctgaaattcatatgcaactgcagaatgatgtttacatggtgttccagaaagcaatgtccataaacagcgaggacactataccttacagagaggtcggttgtatcaaaacttagatagtacggagtatatcacaatcacatcatagatgtatcatgtatcaaaactttgatgataataagctcactaattcgcatggacgttttctttgtttcctctcttttgcaggcaatgtcactgctacatcaagccaagcaggtattcctgtccctgaagagcaaccagatgtactcggagtcagagctcgcagcgtggcgccagaaaaatctggtgagccagtcgccggccaagctaaacgggaaattcgatggcagcaaagtaggctccggctccggcgccggcggcgccgctccgaccacaccacagcggccgagcgcgccggcgaggaagaagatcgccgccaaaaccggcgctgtcgccgccgccacctcggttaagagcacaacgaggcagcgggcagcgagggagagcaacggtgcgccgggaagaagagcaagaaaaggtaagcgagctgttcattgagtgtttcatccgccgtgatgtgatcgagacgccttacatttggagctgcagctgcatcggtgacgccggggacggcggagcacggtggcgccggcgccagcgccaccgtggagcagagacggttagcctacgccgacgaggctgatcacggcggctggcggccagtgcccgtcgtctccactggccagcacgccactctcgtttacgtaagcccggcctactgtatcgagagattagaatccatctccagcagcctagcaatgttccattctttgaactgaactgaagtgaagctggcttggcgccgtttttcttttttttttcagcggccgcagacggcggcgcacacgtaccaggatagcctccggcgattcgtccggcacgccgggcttaaggcgcgcgtcgccgccgagttcaggaacctcgagtgcgacgtacgggccaggcaggcccgcccggcgccgggctactgccgaactgtggtttcgcttccagctccggcgccggcacggccagcaggtcgttcctcccgcaacggccgctgcccgccgccgtctcctccgagcgcggcgttcggaggcggcggcgctgccgctgcatcatctgccgacgctgccggcaacaaggcgccaccgcggtgcaggctgaagacggacgaggtgctcaagctcctcgtgctgatcggcaggccggcgttcatggagagagccaggagagtgctcggccatgagcgccaggagagcagctcaaagcagggacacgatcagaaaccagctgtgaccagagccggtgacgacgacggcggcgcgaaggccggcgtaacggcggccaagccagggaagaagaagggcagtgccagcaagccagccgccgtcgagttcgggccattcgcgccgcccaagctggtcatccccggccggcagctgggcttcagccagttcgccggctcgtcctcccaaccgttcaaagtgacgcctaccactccaaatgttcctgacaagaagaagaagaaacgaggttgaaccaaacaagctgcagcttgctgctccaaccacatcagcttattaccaattctttagtcctgttgggaagaatggcacaataatcttgattcacttcacccttattatgcgtttatatgtaaactggaggatgactactacctctcgttttcgacttttcaaagttaaacaagaccaactccaaaattcatacgtagctcatgtagtacagtgatagacaagaccagcattaacatgcacatctgatgatgtctccttgaacattaacatggagcttatttatagcttaaaactcttcctaacaccatcgctcttaaagcgttgcacggcagtaagccccacctacagggtaagctttctgcattagctaacctcgagagaccggaccatcagacgaagagtaacagttgcatcggtattaacttttccagttatccttggtcttcctaacttctcgcagggcctcaactggcgacttggcaccaaactttgcctgcaagatcgatggcattatctgcataagcatcaccggcaaaggaactatcttcgaaattaagaattgatagttgttgattcttgtcagtaagaccgcaagtttctaaacaatattagctttatcttgctgtcaacctccatggacgcaaagatttttccaacacagccacaaagaaacatagcatcatgttgaacagatgtaactaataagtggattagaacctgtatttctggcagatcaacacgcatgaaggtgtttgtctcaaattcctctcctatagttgatggaatagttggttggtttgcttcacgctgcttttgagcccattctagtttctgcttcactttttcgttatctggctcgaccgtcagtatgaatttcaggttcttcacagtgtactgtaagtcataataagactagtaagaataaagtatggctgttaccttttttttttcttttgaatgacaagaaccataccatgataagtagaagtacataacaaagggcaaccaaaaatttccttggttgcacacataaactaatggcaatcacgttatcctccatttatgaagaactgacagcatgaacttatttttccttaatgcagaaggccagaccacattcttttttttgccagaaaagaacacgttagttattatccttcagttaaggctgcacatactagcctcatctagtttgtaatctagattcaaagcttccagcatctttaataatggaggtttatggacaggtccaaattaaagtaagaaaatagcatggaacatgaagtagaagccaaagggataaaacatcagttgtcaacacaaatcacgaggaagaaggaaaaaaataaggcaaggcacacagcatacatatcctacatatttcactacagattcacatccctcaaaaatggaggaagagcaaagaagcaaatgggggaaatagaaaatgtacctcatgcccgcagtaaacttgagttggcttaggcagcgagcccagtgttacacaaagggattggtacatttgctctgcagtgccctcaaaaaatctcccacaaccagcaatgaactataccaaaaaggaaggtcgatatgttaaatagaaaaggagccatcactgtaagtcagatgcatatactaaccaaggtgtctccagtaaacactgctggatcttcctcctctttactagtgacgtaatagctgatatgtccttttgtgtggctgttagaagaagggaaatgaaaggactatgagatttaagtaatcaacaagctgttacagaaacatataaaaggttgactagactgtacaaccaatgcactacagcaatattgtttaagtctttgtgctatcaactatcgcttagttgcatgcgaagtccttgaacataaatgtttcataaacttctcaattggcaaatctgcaggatgggttattatagtgagtacaagtggaaacatgttggatttgcctatctgttattgtagaggtttaaatcctgatcttcagtgcttctatgattccatcgaagtaatcacactgatgataccataaatgaaatgtgacttataaagaaaacagcataccacggtgtgtgcaggcatagtatctcaatgtccttcccaagggacaatttggttccattctccacctgatcagtgcatcctttcacattgtccagggatcctccatagaccttaatccctggcactgactgcgccatcttttcattgccaccagcatgatccctacaaccacaaccacggattagttgggcttttcaattaccacttctctacatcgttgctaatgaattcagcaaaatctggcaaataatattctatgcatagaatgcacctgagagtaatcctaaaaaaaatcaatccttttaatgtatttgtgtttattttatcatatggtgcaaagcacttcctcagccgcatgctcagacaccgtatttctcaatttattataaaatcctaatgcaataaatcccaatctgcaactaactaaaatcactcactttctggtggtaggtgattggtccctgagggtgggattggggaaaattttggcacagcactgattgcatcccataggaaactctggaaggccaacatttgggcggaatttttccataactaaactagaaggaggactaggacgctcaccagtgatggtgggtggtgagtacgcagtcgatgcggacgccgacctccgcggccgccgcaagcaccttctccggctccacggggtcgacggccgccgccgacttggtgctctcgtccacgattcttcaagaacaaaacgaaggataatcaagaaagagccaagaaacaagaaccgaacatacagacaactgacaaggatggattcaggagggtacaggtaggcatagttgtcctccaggcaagcgaccgggatgatcttcatctgcttcctacgcggagagatttggattgggcttatggtctcttggcgagatttctggagccaacaccgagtcgcgacgaagatgagcaggtgtaaacgggaggattgtgtgtgtggaaggtttaagaaaggggaaaacaggaaaacgcagccgcttaacgtagaaaacggccagccgcttaggataggctgacaagggaaaaagattgcttagccggcacccggcagctcatatctccgttccaaaatataacgatttttagctacgaatttatatatgcatttatctagatttatagttaaaagttattatattttagaacagagagagtatatcactagatttttaaatattggtatcatcttatattacttgatacctacatatataaatttgatatctactccctcaataaaaaaatgtaagccggcacctggcagctcatatcactggattcttaaatattggtatctacttatattacctgatacctacatatataaatttgatatctactcctcatatcccaaaaacaaatctataactagctgtctagatactacacattttagtacaacgaatctggatagatatattttcagattcatagtgttagggtgtgtcacatccagtacaggttagttttttatagtaaagagagagtacatagtatctaagggcaatcacaatcagtagcgtaactaggatgtaaagtaaaggttgtccatctatatgtactgtgtcaattaaaaaggtggttcactgtataatttttattatattaactagtacatataggttgtgtttagttcacgtcaaaattggaacgatgtgatggaaaagttaaaaatttatgtgtgtagaaagttttgatgtgatggaaaagttggaagtttgaaaaaaaaattggagctaaacaagaccatactatagttttaaatttttagtccatggaccacagtgccacctagctagctacgccactgactacaatatggttcaaaagcaggtagtaagtaatgaatgcattcttattaataagatataagcattgtggaaggaggtaacaacaactactggttgtagtgctactatcgcgagtagcaatcatagcaagcaaataaaaaaacaatagctttacactgcagatgaggaagatagcaattctactagataggaaatatttttttttcttgatggacctcatcttattctccatggcaggcaagaaacactgtgccctctgtaatgcactacctcctgttgcttgtgctcatactaataccaagttgggtgaggatgcctaaacactaacaggtaccagatctggcatctaccaggtattatctgagaccaacagatatcaggtttggtattgtacagatatcaaatctggtaccgcacatgtatcgttggatcctctgttctcaaagctgcttttgccaaaccccttcgtgtagcttgtcgtcaccgccatcgttgagtccctttgagaaaggtaattctaggacactgggagaatgaaaaagatttttcctaaaaaaccgtcaaataaatagaaaaagaaggtgattcatcttacaaattcgcttgattgggcctgacctctgctgccaagtcaacaaccttgtccaccaccatgaaatatcatgtgcgacacctgcttccccaacctccgtgagctctgctactgagcatcaccatggtcgctagcacgcaaggacatacaatcatcgctacctcaagtgtggccatggagaccgtgagcagagagatctaacacaagacaaggctactccgacgagaccgtcatagctgcccacgtccatgctttcgacctcatcctccatgctctggatctcatccaggagcttctcatccatcaccaccactaataacaaaacttactagtagcacataagataatttgctactatattccccttccagtcctctacaatcaactacctactcttgcatacccaaaatccaaaatctctcaatcctcaatccaaatcccaaactacgtaccaagctcgtctcgttagctagtggaagaaggctaattaatcaataagcttagcatattggaggaatcaggaggaaggcaagttggctatcgagtgaatggaagagaagaagaaaaaggcaagctaagccatgaaaaataaagaaatctaattcaatggagctagccaggaggtatttgaggatcagtcgggaagctatctctttgcccaaatcaccgttgccaccgcccacatcgactctgacaactccgcgcgacgtgtgctccaggtgcctcgtccatgcgtgcgctcatatgtctcattgtgcgaggatatcggtacataacatttccttttttaaaagtaattacactataattgggatgtaatttatattaaacttatatataattgatagcatagtgcgtgtggctggttggctagctagcggatgatcttcttttcgagctatttttgttatgtgaagcatattccaaacgaaaattgcgaaaaatatagagaagttattcatatttacaataacaatgacacacactgctattcttttttttcgagataatcacataaagagggtcatataaatattattaagattgagaaaaaaaattaaaaaaaggataaaatactatcgataatgttggttatgtaccgaagtgcacgtctagataccatgcatgaaccctacaaacatatgcaagatagtgaagcctagcaccaaaacaataaccactatacgtgaccgttcgtcgctaagcggagactcccaaaagaaaggcttggttcagtctgtcgaatatatggattacaataagcataacttgaaatgttgatgatatgctagctgcagcgcatacccatggtggcaatggtgcaagaagtactaataatgaactagccctttttttcacacgaagaataattcaccaatctttatttattcgcatgcagagttaatttacagcacgaaccgtgctaccaaagaccaacaaggcttactgcacacagtcaccgtcatttattccactaccataatatatacacatgacatgtcactcttttaacagagctcgatcagacactgcagcctgcaaccacctccaatgagatggacagtgaaagcactcctcatgcgtctgagcctgcaacggagggtgggaagacccctctcccgggctggcgatcagcaaccgatccgtgccgagttagcaactacatgcagcgaaacatcacatccattatattagcatttttttagaaaaaatattattttaataaaaacttgtaaaaccacaaatttagcaccatgtcgaacacatgacacatggtgtaaggtagggttgttgtgcagtaaaaaaaagtgatatcacatgatccatgagctatgactaataggaaagcaagcaactgtactatagg

SEQ ID NO: 1216 - DNA, 12303 bp, Oryza sativa
  unsure (1)..(12303): unsure at all n locations
nnnnnnnnnnnnnnnnnnnnnnnnnnnnnnnnnnnnnnnnnnnnnnnnnnnnttatttattcgcatgcagagttaatttacagcacgaaccgtgctaccaaagaccaacaaggcttactgcacacagtcaccgtcatttattccactaccataatatatacacatgacatgtcactcttttaacagagctcgatcagacactgcagcctgcaaccacctccaatgagatggacagtgaaagcactcctcatgcgtctgagcctgcaacggagggtgggaagacccctctcccgggctggcgatcagcaaccgatccgtgccgagttagcaactacatgcagcgaaacatcacatccattatattagcatttttttagaaaaaatattattttaataaaaacttgtaaaaccacaaatttagcaccatgtcgaacacatgacacatggtgtaaggtagggttgttgtgcagtaaaaaaaagtgatatcacatgatccatgagctatgactaataggaaagcaagcaactgtactataggtggccagtgggtaggacctatcgaacaatgaaagtttgataggccatgcactccctttttaccaggcaaataacttcgtcgaacactagctcttcgatgctcttatgtggcaccatgaaaattcatatcactcaatcaaattttgatcgatatacaccctatcaaactttgcttattcaatatggtgctaaacttacaattttagcaaaatagtctctacttttgcaatttcccattaatatagtattatttctaaaaaatattatatatatatatatagaataattagccgctgttcaccatacatgcattaatcaacttggttataattttgtcgtttcgagcgatacaccgcggtttcgtacgtaccttggcgttgacgccatcgggcacgatgcgtccctcgctcttaagcttgaggtactcgtcgcgcttgaacctggtgaatcccctgaaaaccaataaaaagttaaaaaccgagacacatcatcatcagatgacacgaaagaatttatatcatcctggccgtccatcctgacgaacgtaccacttggcgctgaagatgaccctctggcggccggggaacttgaacttggcgcggcgcagggcctcctgcgcgtgcgcggcgttcgcgtcgcggcatcgcacggagaggagcacctgcccgatgcggacgcgggcgcacgtccccgtgggcttcccgaacgcgccgcgcatcccggtctgcagccggtcggcgcccgcgcaggacagcatcttgttgatgcggaggacgtggtacgggtgggcgcacacccggaggtggaacgcgtccttgcccgcgtgcttggccatgtacttgttgcacgcgatccgggccgcctccagggcctcgctcgacacgttctccttctcccagctcaccaggtgcacgcacagcgggaagtcgtccgcgctccgcttcttctgcccgacgtcgaagatgcggatcttcgggtcgggcacgccgcggcagtagcgcgacttcgggtacggcttgttcttgatctgacggtagcaccgcactggccctgcacgcacgatatcgatcgatcgatcacgtcctcgatcgcgttgtcattcaagaaaaccaggtaacaacgccatgcacggcaacggccggcaacagctacgatatgatgtctgtgccgtggtaagttggttggttcggttgttgcttactcctccccatggcgatcgatcggcggcgaaaagtgtggagtcgcgggtgctggtgatcaggaagggtccaggtgcgtgtgtgattttgaagagatcatgcggaggccaggtggttgatgtgcgtatgtatatagatagacaaagaggagggcaggtgagtgcgcgaatgttctggttttgccggtcgggaagacgggaaggcgtggcggcgagaggccaatagacgcagcttgcgtttggactcgacgtacgcggacgcctcggcagcaggtgggtgggccgacctgtgagttgggctgagagggcgtgagttgggctttcaccgagtcgtactcttcgtgggcaagcgagaaacggccgcagcattctcaggacggaacgagagtactcatctatgacatagacggattgtaatggcaccatctctgttgcataaagcttgaagaaatgtagagatagttggcagtttctcttcttttgcattaagaagattcttgcatttgccgttcgtttacacggctcccggatgcgcccacgcgaaccgatcaatcgatcggtccggccatgtggtccggttcagttttcaggggacgtagtacatggggttggggatcttgaagacgcggtcgccgacgtagtcgccctgcaggtcgctccactggtcgccgacgttgccgcggatcctgtagccctcctcctccaccagccgcttcctcatcgccgacttgaacaccgacgagctctgcccccggtactccgggctcctgcattgtaccatgatattgcacgatcagatatcttactttctgaattttaaccatgcaacctatgctactaacaaagtagtattctgccatgggattgcgatatcttgtgcagttcgtcatctgaatgttcagctcagctgccagtatcattgatccattaacttggcagtcacaagccagcacttgacacgaatgctggggccattgaagcataaagattcgcggaattagcagaatgcaggatatgatctccggccctaatgcaggaggaaattaagggctttgttcactttgttgtctaaatcaatcataccaaattttggtaatgctaaattttgtcgtattttggtagtaccaaatgttttttgataatattggctttgcttggtttgatgattttattaaattttggtagaatttcaagagagtaagcttctagaactgttaaaatttggtaaggtagtaatggttaaagtgtgtttactttattgccctaccaaaatttgaaaggtttaaagtgacaacaaactaaacatgccataaaacatttttaaccagtgtaaaattttcacaacatggaacaagaacagaaatgtgatcgcacctcatgatgagcctctcataccccaagaacccctctgactcgagattctctgacgtgcaagtggccagtgtctcttcatccctcccggagaggaggaaaaccttgaaccccttggcttgcaatgtggcgaacaactcaagaaccgcaggtatccccgggcaagcccctttgctagcccacgtcttgaaggccgagggatcataggccctggaataaaaataccaacaagtcacgacatcgctggatatattaatctgtacttgaaagtactaattgccacatttccagcattaatatttttacttgaaagtactaagttttctgttttgataagctcatccaagccgattaaagaaaagattatcctattgatttagctactggccataaagtatcatttttaaaaaatagtggatattttattggataatggaattgcatttggcgcctgtatctattagggacgcacacaatgacacaacctatagaaaagaaaagaaacaaagaaaagaaaggaagacaacgtgaacatattatgcttagttttttttttctgaatgaaacatattatgcttagtatcatctaggctgatagcctgatcctatgttgagttatgtacggactaatttaacgagaagttgaagtacagagaactaaaaaatggatgagttcgaactcttccccatacccgaactgcttggcctcgtagtagagcaggttggagaggcatgtgtcgtcgatgtcgaggatccatgcgtcgaggccgtcgccgtcggcctcgacggtgtcgacgtaggcggcgacctggtccatgacgctgctcaggtccctgccgtactgcccccgcgtcatgtagcccctgacgtaggcgacgcacgccgcgggcaccgtgcgccaccccctggcgttgttcgcctccaccatgacccgccagctcaggcacccggcgtcgccgtccacggacgccgagtggcacggcctcgccgcgacgccgccgccgacgtcgaggacgacggcggcgaccaaatgcggcagcaggacgacgagagcgacgacggccgccgccgtagcccgtgagaacgccattggacgcagcttagctagcctcgatcgacctgtaggcatcaacaagcatgacattgaattatatacgtacacaaagatattcacctagctcatcatcgatcgcaccccatttcgagaccgaaggaaagaaaaagaaagggacacggacagaaaggaaaaaaaggatcatgatccgatcgatcgagacagagagagcagagcactacttcatgctactactactatacctcgatcaatcaactcgatgtgccaagcaattgctgaatttgcagcagctaagccggccggaccgggacaggatattgtacgatcgatgatgccccgagcaacaacttgcgtgtgtgtgcattttatagggaagtcctgcaggcccggcccccccatggcgtacgtgcagagtcaccaccacaaacgcaagagaaaaaagggcatgattacgccatggaatttggcaaggagcgaggaggacggcccggatatatgcacgcgacgcgacctgcttattatagctttaggattaggtactaccttacccctcctccggtgcgtgtgcaagttgcaccgccagcgctccaggtgtgcgccacgtggacccaactccgccgccggctacctcctccgtgacattgcccgacggcgacgtctcggccgtgtacgtgaatacgtgatggtgagttacgttggggccggctctggccgttctatcccttctcctttcttccactttgtagctgccgccaatcgacgagcgctgacgaattaagcttaaacatatgcaggctgctccgatgtaatccgcggctgagagagagatagattctcgagaatattgaccaccgagagggaagcctctagtaacggaacgcacaaacaatgtaggcttttcgccggtagctttactttccggcgatgtaatgggcatggtggatcacttgggtgcagaaatggagcgtgcattagaggcggagctagagctgccagcagctatgcttaaaaaccctcattaaccaatgaggggagtagaatacttgggaacgagagacctgtttggatcatttaatttctggactaaaattagttcatggcctaaaaactttagtccttactgtttagatcaagggactaaacggggagtaaagtcacgtggaccgagggagagagaagagtgaagctgtcactttagtcctataaatacctccaagagagactaatggattttagtcctatatgtactttttaagacccttttagtcgtctctgtttagattcttaaagattaaaaggaactaaaatagagagactaatggattagtcctatgaaccaaacagccaagagggcctgaatcaagtctgttgaagaatgaaatggagtatcctcgttattccccatccaatgagtaggtcaactcacgacaagatctcccaccgagcacgcgcattggtgcatcttcttcttttcgttttcttttaggttgtcatcgacaggggaataaaaagaagatgcattcaccactcgacactccctacatgtctttcaaaactctatcaagaacttcattttaattttacttggacttcccctccttttcttctctatactttctacattgtatcatcgatgtccggttaccgctcaaaacttctaattatggtcattattttgtacaattcaaaattagaactatcagctacctatttatttttagacagatttagagctttaaatcttgcagaatttttgacaaatgaatacaactcgttttgaaataaataaaaaaagatgaacatgtcaaaaaatcgtaatctagagaagaacttttgtaaaatttaatgttagtgcgttgttaatgaatgtaagtgttctataaccaagtataagtgccatgtaactaaatttaactgcaacttaggtctaaagaaacacgaatcttgatacaagatttatggaaaaaaaatcaaaagataggagctaaatatttatcgcaaatgagatagcaaaaccgtaattctaaattgttgtcatctttcactgttgtttatctacggccaagtcgatacgaagggctttgtttgttttgaagccagctagccccttatcaaaattttgacaactttaatagtatcacatagatgtttggattactacaaatttttgcttatattagtgttacaaaaacaattagtatggtaaaacttactaacattttggcactaccaaaatattaagagtaaaaattggctttaaaccaaacaagcgttggagatccatttattgggaagtcaaccaacttgcattgcgagtaagggagcagccacaaactcagaaagatttgtttgcctttgctttaactagcaccgaacaatcgaaagtatgcatttgtaatagaaatggctgtgtagtagccactcaccattagtggcagatggacaatagcctgcaacatatatctggaatcgcccgttcaaaatatatctatataacatgtctggaacgcacctaagaaactttagcatagtatagcccaccagtatcaacctttgtacagctaaattattgtatttcctaggcatgtagcacatatataatgggaatagcaaaaacccattaaccacattttctcggtgatgcacctaagaaaagatcatgcctgagctgtgcatgtacgctccatatcagattaattaattaaggcgcactgaatcatacataattcataaccagcagattttggttcgtcaaatttcttgggtgaaacatataaggggaggcctttaaagagcacgccatggaaacagaccacaaactttgaattctttatagctgtatgaacaattgaaggaacagccaatattcaaaactggctaaattgtagataaaaccatgaaaattttgtcaatcgtgtatacacaagatacttttcttcatgtcttaatactgtaatccaaaatttcaaaaagtagggaaagtgacctatactcaatggagaactcaatgctccactttcagagttaacacgtttagctaaatggggcactaagccactaactcaacatctactgaatttagtatgcactgctctcatcatgcatactaaaaatgtatggaaccgagtgacaaatctgaaatctgtcatgataagtaggctagaggctgggaactaacccaacaagtcattcaagtatttgatctgcaataaagcatcagaaatcagtcaaatccatatgaacctgattcacttattcagataccaatctaaaacatattttcattattattctctttaatcaggcggtattactgatactgttcacaatgtaagtacatgagaaaactattcaggtataggaggaaacaaaattgctcaaaaataagaacaaaaaaagaagaggaacaaaaacacgacctttctccatggctccatgctacgcagtagcaatcgctttgtagccagactcatcaatgtagttggctaaagctctgtcacccgtcttcactatcttgcccttttcctggaagtagcatatcagaagtattatcaataccaattcatgcccttcatgtagtactccatgtgtacctatttaattgatgcttgctgatccactcggtcagacatccaaattgcgacatcattgtttaaaagtgtcaaaatttggatatatgaaacctacatcactaggttttaaaaaaaaatttacaatattattttttatatatattatagtgatggaacatttaaaaagcagtggtcattggtcaaatccaagataccatcaaaaggcaaaattttcataagaaaacaacaggagggatagcatggataatgagcaatatcatacacgtttgctatcttagtatttatacatcttgagtggaacaattgtatataactcacatagctctttaccacctaatggccaactaaaatcacaatatattctgtgtaccaatgtaatgattagccagtgatgagtccaaaagagactctacttgaaaataatacaggattatgtaaattgaagtattaaattcatttgaacaaataaattactatcaattcaagtgcaattgctcaaaaaggaatttgtctatacgcttaccatgatgtgaacatagctgggcttaataagatccaagagacgttggtagtgtgtaatcatcattagagagctgtttggtgtcaagatcccattcactgctttagctacatattcgagtgcatcaacatctaatcccgaatcaatctcgtcaagaagagctaaatcagccccaaggacctataattgataatgagaaaacaaataagaggcacaaatttatcgaagtacataactagatagtcaaacaaattcttctgacaggtaaaaatgttcaaggaagcactgtctcataaaatattatcttctagcacttttttcaggaaacttttgcctatatttattggtcataaatatatcagtgaattgcattttggaccacagtttcacgccgccgcccacggtaagacctaacgaaacaagagcgttgcattaaaaaaaatcacatttaacagaacatggcatctggaagagaagttcagtgaatcttcgtggcataaaacactagtttctattttattgctgagtaataaatgtaagaatatttctccagatttatgttcaaacgaaaagtgtgtaatgttcatttgacaactaaactaagacgccacatagtttcatagtaatcttacagagagttgcagaatctcattgcgcttcctttcaccaccactaaacccttcattgacagcacggttaaggatctctgcattcatattcaaggcattaaccttttcctctataattggataaacctgtatgataaagagaagttatgtcagagttcctagcaactggaaataacccaacagtaagaaacagcaaaacaagaaacgattaggttagaaaacaccaccaagctcacttgtgttattaaaatagaaagttctgcatttatagaaaaacaaacaacgtagacaatggagtctgggacatgttaacttaaccccagtcattcctataagatattaataggataggtcatacatcgaaatagtgagaaatattaataggataggtcatacatcgaaatagtgagaaacacatgatgccttataattccctttgtaaattaagagtgcagttttaaaaatgccttacaccataagtataaattgcaaacctggagaggctctaatgctggtaaacccttcttctctctgcgagcatttaatgccatgagcagaaaatcgtaattgttcactccaggaatctcaacaggtgcttggaaactcataaaaaggcccgcaagagatctttcctctggctccatatcaatcaaattctcacccttaaagagcacggtaccaccagttacctcatactctggatgcccagccagaacctgagacgaaaggatgcaacagttcactgaagttttagatatcacagtaacaaacatggttagtttctcggtttaatcaggatggtgggaaggcacattgaacacttaggggttgatctccaaaagcacttgaacttcaagatcacaaactggattattctagttgcactttcttaatctggactaagaatacacacgaggcaaccagaaacctctttcatggatggcacaatttctcacagaagcaaatactagagaagccaggcggcaacaatacatataaacaattctatcgcaatcagaaaacacttgatgtattatctattattaagatagcttgaaaatgagtcaccatgttcgctttggtggctataaattaccacattaattggaggaaaaagaaagatctacaccgttagatcatggttggtccaaattaacgatgtagcgtgatacaaagtacaattccatcagaagctaaagaattgtttatcaaattcaatttcaccttaataatctattgtatacaaaatacaactgttacaggtgaaaacaaagttgagaggtgtatactaaatccaattcgacttccaaagtttagctcctcgcaaaattgtgcgagacaatctgctatgctatgctaataaaaacaaaaatatacaggaacagaagtgttacataggtaacaggcaatatttccgcacagtgtcgatcctagcaaagttcttgtcctaatatttagttttttggcagaataagaaatgaaagcatcgatcagaagcgccttaccttcatgagagtgctcttgccggagccattttgacccatgagcgcatgaatctatacaaaacaagcagacgaacacccaatctaagtaccctgcaacctcgcagaccccaattattaagaattttaagatagccacacaactagaccagaacgaacctcgccctcccgaatggtgaggttgacgccgctgaggatctcctgcccgttctccttcacgcaggcgacgagatcgcgcgcctcgagaagcggcctcccggcggactcgacagcagcggaggccgcggcgatcgagcggcgccgcggccggagggagacggagctcgggggcagatggcggcgggggagggggcgggacgaagaggaggaaaagagaggggaggaggaggatacggccgcggcggcggcggcggcggcggccaaggcggcgccatgggaggagggagggtgaggtgcgtgcgcctccagatgcttcttcctccctcgtcgcggctcggcttcggatgacgagcggcggcgtcgaatgctactttttatgggccgtttactctggagatctcgcgctcgcatataccaggccgaacttatgggcctaatgggcttagaaagttagtgcgttttttgggcggaaaaagtatactttgactccctcaactatggcccgagtataattcatgtcctccaaccataaaaacgggtatatcgactcctccaagtatcaaaaccggtgcaaacaatatccctcggtggttttggaggtggttttggttgacatggcgcttacgtgacgggcttgatcgagtctttgtcatacgtggcgcttacgtggcattagaataagaacaaaattaaaaaaaatatgtggaacccatatcattcacataaaaagtaggaccctctgacatgtgggacccatatgtcatcctccctccctttctcccttatctctctcaggagcggcggcggtggcagtggccgggaatcggctcctctacgtcagagggacgttcgactcccgatatccgtcgcttgcgcatccaacggctccggtccgcgagtgcctgatgtatagcctttccgtacggtgcacatgcgcagaatcgtagctgggagctcacgccaaagggaagcaccagccaccggagccgtcgctcgagccatagcctagcgtcggccgacgagaattaagctctgtccgcgggcgtgcagtgcgcggaagtggagcgctctggtctgcttctcgacgaggtagctagtcggcggccttgctgaggaagctaggatggagacgcctaggaagacgaaggtgcaggcgagcagcttggcagcgtcgttggcgggacgaagtcgccgtagccgacggtggtcatgtgtgtgtccttgtttttagcagcatcctagagtagattgcatcaggtttcaatttctgttggcatcgtattccttcggacgtgcttagttcatgtcgcggcgtatccgcgtcgtgcgctccgcttcgctcgtgtgggatggaacacattcgcggcaatggcagcgaggccacgatgcatggtgagtctttgtattctgcaaataaaaggatgagaaaacgaaaagctgcagtgagccagtgacacacatcaccaaaactccctctgtcgaacaccttgtgagtgcactggtcattttcttcctccagacaatctaggagtttgtgagccaaatcaccaattggggctgtcaaaggacggcgagaagatggggggagccaatcaatgtgtccctcgacgaaataatccatgggaagggtatgaacacgaagcacgccatgaaaatgtcgatcgacaaggacgatgaagaggccaagatgacgatggcggcggcggcggtggcggtcgg

SEQ ID NO: 1217 - DNA, 11643 bp, Oryza sativa
  unsure (1)..(11643): unsure at all n locations
gcctcatccccatctgccaccgctcttgagttctgagagagataaggaagagagagggggtaggaagaagggaaggagagagaggatcacatgtgggtcccacatgtcagtgggcacactttttgtgtgaataacatatgggtctcacatatttttttatttttatttttattctagtgccacgtaagcgccacgtaggacaaagactcggtcaagcccgccgcgtcagccaaaaccacctctaaaaccaccgagggacattgtttgcaccggttttgatatttgaaggagtcgatatactcggttttatggttgaaggacaagaatcaaactcgggcgatagttaagggagtcaaagtatattttttttcctttctgggctcttttttgcgggttcgtaggtcttggaccttaaaggcccaataatgaaaatcccgcttgaattatagaatttgattataaattaccttttgggttagggagtttctctttggcacttttattggtcaaccttgtgttttcatgattattaagaagactaaataaactacctaaatttattcgtcaatatgacattccgtagttttggcatttcagaaaaataagtgctaggtgggctttcaaaagtttgagaattttcgcatgaatggagccgccctgtcaaccaaactctagatagacagcgagattgctaaggggcgatcgatcgcccctagcgatcagattcggattccccctccctccatctggtttcctttttgacaccgcattacttttctattttagtaaatttatgcacctaaagtttgtacacctcaactttacacatttaaagtttagagacccaaagtttataaatcaaaagtttatatatccgattcaaattttttatatatagtatttctatacatctaaagtttatacacctaaaatttatagacccaaagtttataagtcaaaagtttatatacccgattcaaatttgaatttgaattcaaatattttttatatatagtatttctatacatataaagtttatacacctaaagtttatagacccaaagtttataagtcaaaagtttacatacccgattcaaatttgaatttgaattcaaatattttttatatatatagtatttctacacatctaaagtttatacacctaaagtgtatagacccaaagtttataagtcaaaagtttatatacccgattcaattttgaatttaaattcaaatattagtttatagacccaaagtttataagtcaaaagtttacatacccgtttcaaatttaaatttgaatttaaattatatattttttcaaactttgttttttttattttttttaaatttatagtgtagtaggaagagaggaatggaaggaggaaggagggagagaggagtgtacatggtggatggggatcgagcgatcaatcgcccattagccagctccagatagacctccagatagacagttgatgagacatcctactatatttatttataatactaaaagtggagtcgttcgtcctccctcccctgtatttagtgtatacctcatcaagggcatgacaaaaccaatcctaactaccaatctggctacacacacgtagtactcatgccggaaaaaaaacagaaaaacagaaaaaaaaaaggtggttgctaaaaaaaatcatgtgtattacatccacacccagcttattcccactggtatggcccggtggaatggacccattgcaatgcacgagaatattactagtcgttcgataagaataggtccgtccaaatcagtgccttctcattccacaaccacaattcaaacaccgcctaaagaaaatgatacccctggtagaatcatcatcgctaaccaagaaaaaaaataattgcagggggaaattatcatgggtatcaggtggagtcgtgagtccataacttcacttcaaatctaaatttccacaaatattatgtgcatgtagatgcattttcatatataattagtgagatcaagaatatgttaatggtatttatatatacgaaccgtgtgttagagagatcatactcgtaaatgcgtgaatgtggtgtgcgtgcgcaagggtgaatagaagctcgtatagttggcacggtggctcagtcctaaattgctcatgttggtctattctctctttacaattttctaattttgcaagttattgtcgcaagcaagaatattttggaacaaaatggaatagccatgtacctcaagggtgtgccggtttggagagacatgcatgctacggatacatcgatactcttagtgtaatgcttaccctgaactatatagagtcgctcactgtatagatgaagaattccctaacctaatctaattctatcataaaagactctatccatctaaattgcatactcggagtgttcggaaggaggagaaagaaaatgattgaaaatatacgtaaaataagatgagctattaagatattattaattagttaagtattaattattttaaacttgaaaaatagattaatacgatttttcgaaaacaattttcctgtaaaaagtttttacaagagaatataccttttaatagtttgaaaagtgtgcacgtgaaaaacaagtgtttttttattcttttgtggtgcaaactagtgcaagagggtgttaggcccatgacagttattttcgttttggcttgttaacaaatacagatgatagagaataataatataataaattaaactattaagaaaagctcaatgaaaactcgatttggacattgagaaagaaaattatttcccaagccccctcctcgaaatattttactcactctgtcccaaataaattaacttttatacatcaatatgcatacacgctgattagggaatatacgaagctttcattcatcccagttcaaccattcatctcagatggtcgcgaaatccgattggatttcgtcggaatcataaaccctgggctcaactagaaatgtcacatgctaattcatgtttccgcttattcttcttccctcattcatgaattcagttaatatagaagtgattatatatgacgatgtggtcttgctgtccccacatgagacaaatgcaagaagaaactcgaaaatagcagtgtctagctagccctctggaaagactgtacatatattggcagttggcaacttggcatgattcagaagcaccaaactgcatgaatactgttgtctgaatcagtatctgctgcttcaccggtgctgcgttttctgcataatcgatagaatactgttcttgctcctcctcctcctcctcctctctttttctttcattttatttttaggctaagttcttgttcttgggcagcgttttgtctcgctgcctatggacagtcctccctgcaagtttttggacagatccaacttccaatctccaagaagaaccaaaatcacagaatcaaggtaggacatagtacacacttgaacatagcaggattaacagcattatataactgcgattccaagatgcagaaactacagtaatcccccagttcttgacagctggtgtggtctccagcttgagatgccactgaggacaaaagaacggtggcatctgccaccagggaagcaaaggagaggagaaaaaagcatggaaatttttttgtgatgtgatgtgagctgcggattcaaccaaacagctcctccccagcatataaagttcgatggaccatggtggcactatctgattttgatcccttcctgccgcctccaaaattgtgaactgattcacactcccctttctttgccttgttcactgaagctttcagatgattggtaatcttagcgagtaagaaatagagcattaacatctcttgagagtgtactcattattcaggcccggcgaaaagaaagtgctcgccacaggccacagcgacatatgaatgaatacctgttgccgtcatttctttggcgacgaatcaaacattcatactacgaacaaagatatacagtaatagtaactaatcttggtaaaagttttataacaaatcataagtaaatactaagggagcgttagttacagaaagggaaaaaatatttgtcttgtaactattttaaaaaaaatagtaactatttttttaaaaattctatagtaatgttgttttaaatcattacattaatttattttttaagtctaaaataattactacttaattaatcatacaataatgactcatctcattttatgtatttttcaatcattttttcctagcgattaacctcctctaaagattatgtatgtgtttgattatcgaccacactttaacacaactaagattaggtaagttatgataaccccaaatgtattgtggacaaattgtaagtcataaagtatgacaaaattgataaaaaaaataaatctgtgacgtgaggatatactacagtatgctagtactccctctgtcccatagtataagggattttgagtttttgcatgcgaccactcgtcttattaaaaaaaattgtgcaaatataaaaaacgaaaagttacgcttaaaatactttggataataaagtaagtaaaaaaaataattctaaaattttttaaataagacgggtgatcagtgtaagagagagagtatataacgtaacagtgaaccaataacaaattaaaccgtgacaagccaaaatatctaccacaccgatcgagcaccatgctttactggtggaaaccgtggaatactggtacagcacagctgtttgtttgttgcgcttttactccgggcttttgaccaggcgagcgggccccgcagtagggtgggacccacgtatcagtggccgcaggcaataaaagtgggcgccgcggcggcagcgagaagagcgtgccgcttctctctcctcctctctagcgcgctgcaccctgcacccgaacccacgccacgcgaacgcaacaaaacggctttactgcgggctctctctttctccccccccctccgtttcctcgttttaaacgcttcccctctccctgctgcccatcctccactccactccgcctccactcctccgccgcagcattgctaccgtctgaatcaatcatcagttcgtcgcagcgccgaccaccggatcaggtacgggtacagcgcccaccctcgcgccactttgtgtttttgagttttgaggcttttcgcctgtcaaaaatgtgtttgtttgtttttttttgctctgtttgtgtttgttttctctccgcgaggttcttgcgttccgctttgttcggattagttagtagccgcgccctgattatatctgcgtgtagttcgtttccgcccggttacttgaagatcctgaaaattttggcattcttggcgttgcctcgcgcattttagaccttcaggcttcagttactgaactcgattatggtaacagctcacaaatctttctgcacaacttcgtgtgatgctcttagattgccgctgtaatgcctttgtgttgatctttcagtctagtaggtcctatttctaactgaactcccagcgcgctactgtttggaagcagtgaagaccggaagagagtagaatccctcaggggaaaaaatacttttcttttttgcttaaaccctaaggacaggaagagcattaggcttgtatatgttaggtttgatctttttgttagcttctacatttctcgtttctgctgaaaatagtggatctagtattggtagattggtaccaccagtctactgccagtgccatggttttatactccatttgggtagaatagcgccatacgcacggtgacactggttttgatgagcttttaggtggatagaaagatgtgaaccgcgagctcttgcaaaatcatgacctaacattggttttggaagggcttgccagtaatcgattgttcgccggaattaaataatgtggtcgctttaagtgggaattaaacaattgggcaccaaccaagatcttgtagtcagtaaacaatgctgcaaagaccggcatgtgcaatcactccggctcatctccccgcaagcatctccgtccttgccagtgcgccctagcttcccctagttcacatttcagtttgtttagagtggttcaggtttgccttttctttgcttcgcttttcctttcacctttgtctagtggtattctctgatcaggcagcctttctttatagtggccattgccttacttgttgcactatggaggtcctgagagccttgtgcagtggtaaggctgctacatttttatccctaatgaggatgggattgatttcaatcaatgattaactcaaaactgtgtgtagctgtgtaaggctgcaattatcattttttagagaatggaaaagtgtaaggccgcagttagtctctgactgcttgaatttcgagcttaagcatgctgtcctatgaagaaacttacgctgacggctgacctaaacgtgcagtgtctgacactacttaagaaaccatagcagtgctaaagttgtgtgtggtaatcgtgggcaccaaactgaacaccccttagcaactagtgttgatgtgctagactgaatttagttctcggtaagcatactgccatactttagtgttccattcaagaaagtagtgcagcgtgcacgatgtgatatgctcatctatgtggctagtattgaaatatttatgttttttttttctatttttccttcttgcctcatctttctctgctttattgatgccttttgtcttttacacgtcgaccctatcatttcagattaaccctcctttagttgctttgtttcggtgacttttaatcgcatattttagttgaaattaaactagcgccattctttggaagtagaattcttgtcccttgtggtgattagatattggtagttttattcccatgatttacacactgctttgtgctgatagagaatctcagaatcacctctttggtgagttacaaggctcagtaaagagattggctgccaggccctcctagaggaaaaacatgcagggttccctacatgttttgtaatgattcgcactgacctatttggcaggataacacctttactagcattctttagcttcttttatgaaagaaagcagactgcactaatttggacaagagttttcttaaatcattaggctttgatgggtcattttttcttttgaaagtgctttggtctttttcttggcatgagcctctagtggggcaaactgccagctttatgcttccactacacaggcatgcttgtctgcataagtgcatagctgcatttgaagatcatggaatgtgcttccttctggactcagcacacacacatctgtcgtgattgctcgtatgctatattctcttgagggtttatgagttaaaagacacaattagagttatgtttacagttctactgttacttttcatgattttagcactgacgttttccattttcattgcagcaggactggtagttactgatataaacagatgctgatattgttcatttagtccagttgattcagagacacctcttatgggctataaaatttttgaaggttctttggttctactgtcgttacttcttttcacctcattggccgtggcagacatcgcctctgagaagcaagcgctccttgcttttgcctctgcagtctaccgtgggaacaaactcaattgggatgtaaacatttctttgtgctcatggcatggtgtaacttgctcgccggaccgatcacgcatatctgcccttagggtaccagctgctggcctgattggtgcaattcctccaaatacccttggcaggcttgtctccctccaagtgttaagcctgagatctaatcgtttgattggaagtatcccatctgatatcacctcacttccttctttgcagtccatatttcttcaggataatgaactgtcaggagatttgccttcttttttctctccaacccttaataccattgacctatcctacaattcctttgcaggacaaatccctgcaagtttgcaaaatcttactcaattatctaccctgaacttgtcaaaaaattctctctctggacctatccctgatctcaaacttccgagcttaagacagttaaatctgagcaacaatgagttgaatggctcaattcctcccttccttcaaatattctcaaacagttcattcttggggaaccctggattgtgcgggccacctctagctgaatgttctcttccttcaccaacatcctcaccagaatcttcattaccaccaccatcagcattgccacatcgtgggaagaaagtaggtactggctctataattgcagctgcagttgggggctttgctgtatttctgctagctgctgcgatatttgtcgtgtgcttttctaagaggaaggagaagaaagatgatggattggataacaatggtaaaggcactgataatgcaaggattgagaagcgcaaagagcaagtcagtagcggtgtccaaatggccgagaagaacaaattggttttcttggatggatgtagttataactttgacttggaggatttactgagagcttctgccgaagtccttggtaaggggagctatgggactgcctacaaagctatacttgaggatggcaccatagtggtcgttaagaggctaaaggacgtcgtggcagggaagaaagaatttgagcagcaaatggagcaaattgggagggtaggcaaacatgcaaaccttgtgcctcttcgcgcttactactactcaaaggatgagaaacttgtcgtctatgagtatgttgccaccggcagcttttcagccatgttgcacggtatgcttatgtctttcactactaaatgctttacatttgatttctgatattgatcaatttttccaggtagaaatctaacaatccatgatgtatcaaagctaatttacaagcacaaaatgcaatgcaagcacgcaaccaaaagttatttctcatttttctcacaaacttctgattaacaggtattaagggtattgccgagaagaccccgttagactggaataccaggatgaagattatacttggaacagcgcgtggtatagcacacattcatgcagaaggcggctccaagctcgcccatggcaatatcaaggcaaccaatgtactcctcgaccaagaccacaacccctacgtctcagactacgggctgagtgccttgatgagcttccccatcagcacatcccgggttgttgtcggttaccgtgctccagagaccttcgaatccaggaaattcactcacaagtccgatgtttacagcttcggtgttctcctcatggagatgctgactggaaaagcaccccttcagtcgcaaggacaggacgatgtcgtggatctaccaaggtgggtgcattccgtggtccgggaggagtggaccgctgaggtgttcgacgttgagctgatgaagtacctgaacatagaagacgagctggtgcagatgcttcagctcgcaatggcgtgcacgtcgcgatcccctgaacggcgcccgacgatggcggaggtgatcaggatgatcgaggagctccggcagtctgcttcagagagccgcgattcctccaacgaaaatgccagggaatccaatcctccttcggcgtaatgcctgacgagctgctgtgtggtttactggtttgtatgtttgcaggttgcagcaattcatttagaattaaggctggtcgtgatggcctcttcaatgtagccagaagctttcagcactggcactatgtagaagcattgcatgatgcgcaagttgatttgctggcttcttgacctgtatttacatgctgtgctccggtgttggtaacttgcgttcattagaaattgtcactagggagtctttttctatggggaaagaaaaatcaaggtagaggagacaacgtgattggcagtttagttcctttctgttcatggttttgcggttgtctgtcttcgctatgaaaaattgcaaacgagaaagccaagtaacagttgacatccataggtccaacactaggacaaacaaatggagcaacaatgcggcaccgcagagatcagcaataccaggggcaaacattaaatcggggacaccaaaaggttccaatttgacaaaacaacattgtatagcaaccatccaatcaatgcaatacatcaaatccaaatggtcaactttcttcaagatgcatggtcattgttcagtgcattaaacatctgttggaataccaaaaattttcagtttctgtagaataaatatggtcagtacaccccacatggtcaggaaggcctcttgtgtgtataacactataactggggaacaagagcttctgctgcccctgaaaaattgacaggggaggaagaaaaactggtagtgacacgagcacactaccaagaactgaacagaggttccatatctctgttgaattcagtgcatccatcgtatacatcctcacaatcttagcgagataactgtgtgagcagaatcaaaacaggaagactcctctttccaagaaatacagatctcaagctgcttgatggcattaatggagaattacttctggttcaccaaatcagcaccactgacatacctagcaacgaatgaaatcaaccggaatggagcaccgacgattggagcatcagaaaatggaacctcctctgcctcatcatcggctaccggtggttgtgggtcttcctcatgaatctgtatatcatctaatgcaactggcagaatttcttcgcttgttcttggttcatcaaaatcttgctttgacctttgatgtgcattcatgtcaatgaggccctcggaagaaacatcattgattgttgtttctggaagttgcattggagcttcttctagatgattactaacataggcgttgctaggactgctgttgattggactatagttatccacagaagtaattgctgcagaactgtttacacttctatcaacaatcagttcattaccctgcaagcagaaaacaattacgctgtatacaagtatatatgaattctggcggtttccagacatttgatattctgtcacactgcatgcggagactcgtacttcttaccaaaaccaacagtctgctcattgagaactgtgctggtcaaatccgtttaatccatcacattattttcaaagacctcaattatcatgtctctatcttatgcactagaatctggaaggacaagtgttttatgcacaagagagaagagactactgatatcaagtggtatttctccccaggcagatccactggagtgtatagcgtctaccaaattggacacaggtgacaaaaaggaatgttctgcataacatttacctttttagtcacggaggcttcagtaagagcagactttgcttcaaagactcctaatcttgatgccagttcatcaaaaccttttaccaacctctggctttcctcaacagtattgtttgaagcttcctccagcaccttcacctgccagactttgttattaaatagtaatatcagatgatataagcagaactatgtctaatgctgcaaatgaaaaccaaagcaccaaagctttaaatccgacatattcaaaatcgtcacgaataaatcatgacttttaactttacatatgattgaacacctttctggagaggacannnnnnnnnnnnnnnnnnnnnnnnnnnnnnnnnnnnnnnnnnnnnnnnnnnnnnnnn

SEQ ID NO: 1218 - DNA, 3954 bp, Oryza sativa
  unsure (1)..(3954): unsure at all n locations
tttttttcccaattattagtaaccacccttgtgcaaagtttgnaagtgtgacagaacacacctgtggccatgaatgaaatgccagacatacttggtgagacttagctgtgaagtatcatagtgaagccgacataatttgttgttcatagaggcataaaaacacaaattggaactaaaattaatctgcaaaattcagaactcctgcatataggcaggactggtatgtctacccacacgagcaaagaaatcattagaataaataaatatatacctccttcttaatcagcacatcatacccattctgtaaattattgagcttttcctccaaacggacctagagattggatcacaagacaacattttagctagatttttaattcatatcacctgtccattcactttgtgacatggcagaaaatcttgggtatgaagagtaaggtagtttttctagctatattggttgaatgaattgcatgtggttgcatccaggattccagggcataaacatacctcattctgtgcatgataatccactttgttatgcaacttttcaacctcaatctccatggagctctgcaggaaaaagaatgagaaaatatttcttacatgacatttctatgatggccaaaatagcatttgttcacattttgcaacaaaccatttgatccaaagatataaacatatggacacaaaataatccaccaaacatgtattataatttgtaacttaagtctttaacatgcaaaacagcaaatgtcattatcaacaaatggagatgcctgattgaggaaatgaatagatgaaacaaaaatgcttcattcggcaaagcacaaatcacaggataaaactgttagaactcggagaagttaatctaacattgtttcacacatatcttctcgtttctgtttatcagcacatgaagactgagtgttggaccatgaattattatcaaataaaaatttgtggtgtcaagacatgcctcgtagttaggaaaaaaagtgaaagtaggttggtatggagatatttaaattctatacatgttattttattgtactaaggtaccaaaaatatgtttcagaccaattggccaacagcaatggtatatactataaatacaaatgagtgctatgtatgtcaaccacaagtgccgatagccagatacaaaccattttttgatgccacaaactcttctcatcttccaacttctttatcgtatcatgtaatttatcctgcattggcaatatctgaggttaaaagatgacataattgagaaacatgacagcaggtaaggcagtgacgagctcaactattggcacatggtaggtggctaagaatgggtgataggaagaacagtgaagtggttgcaatgcaaccggacaaatgcagggaggagactaagaatacaagaggtgggaatgatgagaaaaatatgggcaagggggagaaaaaatgacacctatatggtctttgctcactgtatgggtgattatggctgcacgtgaaactaatccaacaacatggaagcatgcccaagtgatatcagagcacccttttttttgcattcccaaaagaaaattcacattgccaacttttagcattaatgtcaaacctactaatgtattgttgcacggtaaagaatctaatgcaaaaaatacactgtcaattcaagtggtaggaaaagctgcttccactaagctttgtaagctacgaactttgcataagaatacggtaaatttataatctaataatttacagatacttacaagctttgcttcatatagtctgtgcatgtcaagctccacggtggaatctgacatctcaacactcctctgatcagcatgggctgtactactgactttgtgattttcatgtgtcatggcagggtcaaggttctgaaatggaatcccctctccaacagaggacatgacatcatcagtgtttgtgctatcatgatttgcctgtcgatctggctcatgattctggtactgaggagcttcctctccaacagtggacattgcatcatcagcatcagtgccattatgatggtcattaggggctgtctcatgattgtgggaccgaatggcagcctctgcagtgctggacgttacatcaccagtgttcttcccttggttccccttcttcttcttgttcctcttctttttagcatccatctccggttgcaaacccaagcccttacaatactttatctacctactaatacaacaaaagatatcaacttacaaccacatttaacagattagctgtttcatcaggtaaatgtcatgttctagagacggatagccaatctattactgacaaaaaaaaagtttgtgcaccagttttagctcccaaaatcataaataaaaaaaatcatttgcaactaaaacatatctgatatctctacgataagcacattaaagtaaacattccattttattgaactgacgccaacataaggccagaaattctagctgggaatccacgcgctacagacaaccggaaccatgtccattctatatcaacaaagcatctacccagaaaactcaaccgctataaaaatttacggaggggcgctgccctaaacaagactagttagaaaaaataccgagaaatgccggcggagcgagagctaaccctagaacagccgcaggccgcagcctccgccacgaatctgggaggctggggatttgttgggtggaggaggggggggaaagctctcacgagaagactttttgggggaaagcgaggcgagcgcggggtggagatctgcgtctcttgggaaggaggagcgcggaggcgtaactgccggtggctttgtcgcaggcggccacgcgccgcgcacgcggcacgccttccccttcccggcgcggtggccggtgcgacccctgcgcgctacacgtggcatgtccgaatctcgtgacgtgaaaatgggcctgggccttcttggcccagcccatagtagcgcttaccccgctcggcccatcacacgcggggcctctctctccctctccccaaaaccttgggcctcttccccctccaggcttcctcctccccactagctttctccaccgccgctcttttcgccgcagcggcgccgcgcgcaaacgccctccgccgctaaccctagcgctccatggcccccgcggacggcgggggagagcagccgcacaaggcgcaccggcagcacaagtccggcgcgaaggcgaggaagaagaaggggaaggggaagggcggcggcggcgacgatgacggtggcgagaggaagaacccgaaggtacgcacgcacgggcgcacggacaagtgaacgggcttcatgttgggttctgtctggtggggggcgtgaggctgtgagcttccatggattaggattttgacgctctggcgagtgtgctatccgggtggtagctgtaggagttggttcgtttaggtggcgattaaatgtagctcgtggcgatcctgtttttcgttcatgcggatatactgcgcggttccaacttgttccagaagatatacatcttgcttatcacgatgaagtctcattttctcggttttctattggagaaattggaacaatattaatttgagcatctgatgcaagccatacagattggatattgtaaactgtgtttaaatctgtgctaacagcgttgctctgtattaatacagtgttatagtccagtgcaattagcttaaaatgtagaatttagatagcattgagtgcccgtgctcgtattattagcaagctattgcaatagatgcatttatttatttatgctttggtgatattttctgccgtctatatatggaattttatgagtttggttggaggtcatgtggtcactggctatgatccatgctttttaaagaaaaatggtaaatatcctccttaaaaaggacacggttagatctctgtaactaaatggttctttacactgtgcaaacgaactcaacaac

SEQ ID NO: 1219 - DNA, 7495 bp, Oryza sativa
gcgctgcggctgcgcagggtgttcgacctgttcgaccgcaacggcgacgccgagatcacgctcgacgagatggcgtccgcgctcgacgcgctcggcctcggcgccgaccgcgcggggctgaaggccacggtcgggggctacatccccgcgggcgccgcggggctccgcttcggcgacttcgaggcactccaccgcgcgctcggcgacgcgctcttcggccccgtcgaggaggaggagcccgggaagcaaggggaggacgacgacgagggcgacatgaaggaggcgttccgggtgttcgacgaggacggcgacggcttcatctccgccgccgagctgcaggccgtgctcaagaagctcggcctccccgaggcccggaacctcgccacggtgcaggagatgatctgcaacgtcgaccgcgactgcgacggccgcgtcgacttcggcgagttcaagtgcatgatgcaggggatcaccgtgtggggcgcttgacggcggcgagcgaggccgccgtccttcgtcctctccccgtgtgtcatgtatgtatccacgcattgcaacgtgtctctgctcggcaaatttttcttgatcgtcctgtggaatcctcctgttcttgacttgatctgcttaattgtagcattgagaattttctgtgaccaccatgaaatgcgacattatagaaaaaaaatggcatgcgaagatttcattggtatttactccggtacttaaacattggttttgttaattattcctatccacatatatctaagaggaaagttgaccagcttcaccacaagtttttctttcttcaatttcgtggtgctttcgtgcacatgcctaggcctatcatttccctttgtgcgttgacgtattcagccgtcatttgaataagcgtttgcttgaagaaatggcagagaaagaagaaatgggcttgacatgattttctattgaaaatattgtggacaggtttaaaacatagaaatttcgtagaaaaccgttcaatattctaaccaaggggaaaatcattagcactaaacagggttatagagaacatgggaagtttgttctatgatcctactacaggaatataatatctatggaggcctttggaacaaaggattagacattacagattactttaaagttattatctaacagactaatccatagtaattttggaaaaaaaaaatccatgaggtcaacttcatgttttcatcccctttcttgaaaatcaacatcccccccctccccctattacatccaaacctctcttttaaagtactcgtgtttttccatcagaatttgagaaggcatttctccttgttttcctcctttctattttgagttcccttcattccaaaagcttaattgtttgaaatctaatagataactcttttaaatccaaggaggcatagagttctcacatggaccattatcttcttgttctttcattagtacagtagtgtacgtttaagcacatgaagattgctaggccaacctaacgtctgcttatgaatacctaccacatgttaataggaacttgcatcagcatgtttgcatgctctacactttatatgattacgcattgctttcttattatacatgtttggctttaaaccaagtttttatatgccttcaagtaatgtactccattgatttgcagattctgaagcatctgaagattgatctaggagctataacattacccttggattgtttcagtcaatactgattcagtgtttgttgtatgttggtcataatgcaggtaatgatgactgtaatttcagtactgtttgtttaactcttggttttacccttcactaatctaggcatgtagccagataggtcttgtgcgcatctgtgtcattgtgttcctcctaatccaataagctttctgtatgtaagaagaacaatgtgacctatatcagaacaatggtctttttgttaattaaaattgtaataagcgtgtgcttggttactggtggaatgttttttttccctttgtatctataacatgttttgaacaggtatcattggttttttttgtgtgtttggggggtggggggggggggggttatggagtacggtctttagttatggacaaagtgtgagataacagcatcctattactgcttctaaatgaacacatgtcaatatggccttgtttagataaaaaaaaattggcaaaaaacatcacatcaaacgtttggacacatacatgggacattaaatgtggaaaaaaaattaattgtacagtttgcatgtaaattacgagacgttgtcacgatatgatttgacatgtgatgctataataaacattagctaataacggattaattaggcttaataaattcgttttgcagtttacatgcggaatctgtaatttgttttgttattagtctacgtttaatacctcaaatatgcgtcggtatacttcaaaaactttacacccaaagaatcaaacacaccctaagctttaatagtatatagttagtggtactgatgtcttgggataatgaaaattatgattatgttggattacgaaatgttatgattatatatgactaatagagagagaccttcaaggccctcgagtcttttctgtaatcattgacaacaccaagttgtttgcttggtggctgtttctgcagaatggaaatcatgtgcacactattgatgcacatggtggtggttcagaaattatataggacctggaagactgcatttttcccgtgataaaatttacaacatagacagcaatgtgcatcatgaagaaaattataccccaaccacagccgtccacaatcttccaaaacaaaaccactgcttatctggtattaccagaaagtacagcaactctgcaactattgtagctaactgtactcacagcaccccaagtattacataggcattgttaaaaatttagattacatttgggcacttgcatggaagaaatcttacattgctcatatggattgccgatcatctctatgctgttccattgctagactttggaggtagaaagggctcccaccatccatactcatacttggggtatggagctgtccatttctcaggcttgtcaaatttcaagtcgaccgggttagaagccaatgcctcctcaagcgtttctgcttcaaattgttctgctaagaccctgtctagcctcaacttcataaaactgataacaaaagaataaaatgagtaaccttgaggattgccatgctacttaaattgaaagtagttaatcatggtatcggcaattacaagatcattaaaagtgtagatgctggctatttcagtgattgtttggtcctcttcctatctggaattttggatggttagaagcacaactggtctggtcatggcgattcacaccatgtcgtacatcatgacatccagaaaataatgtgatgcatagtcactgagtcacatgctcagagccaaaattctgtgtattatcatgttgtccagtttcgtagtccaataagattgtccctttccctctattactttttcactagctttctcatcaaatcagtgtgttcaggatgcgaacgactcattaccaatgtccacaactcgaaatcctacccagttagtatggtgcgtggaaaaaaatcagagaaaattcctctgtgccctgactagttttcgctcaatcatttctatgcctctgaatttttcctattttcctacatgctcccgagtttcattttaatcccatatatacctattccattagttgaccgctagatttctttttccaaaacgacaatattacccctcgtacttgtgtgctagcttattgagaaaaaaaatacaattctcaatgggaaaaaggttcattattttttttaaaaaaaacaaatggggtataattctttgaccacaaattttaaaactgaaatttatcatttttaaatcattttcaattcaaatgtaagccaaacaaaaatagttttggtttcaagttcttgatgaaattttgtatgaattttatcagtattttgaagtttgctaaaaatttgaatctttcatatttagggtcaaataattccatcacttttgattttatcatatataagaattttccacatcgagaattgtgttttttctcaataagctagcacataattatgagagaagggcagtatagtcatttcagggaaaaaaatataacggtcagttcatggccaaataacggaatgggtatgtagggtatcaaaatgaaaactcaagaccatgtaagggatgtggcaaaatttatagaagggattgagcgaaaaaacagaggcacgtaaggaattttctcaaaaaattaagatgacacttgtagatcattatcatgagccatgacaaagaaagacagatccaagcatcatagcaaataagatggaggatcacgtaaaattccaaaggactgttgacttgagcaaaactcaaaaggtacactcagtgtcttcgtttacataaggtgtattcatccattctgaaatgtttgacattaataaactaaccagcatcatacacaaataaacagagggagtagttctgagtttttccagtcatatcaacactacaatatacctatgcctcacaatacttcacaaggactacaaaaaacttttgtacttttgcatttgaaacaggatcttgaccaaatgttagaaatgtgcccggtgaaacacatcaaacttggaaaatggacgttacaattgtacagaacattacgggctcaaatctgactagttgctcttataagaaaaatattctactatatgtctatatccctccgcttgcatttgcaagagacacaatttactgttttgtgggatatatttatagctgcagaatgtgtttacagtcgcaggatgcatatttcgtgggaagcattttacaatcgcgagtgcaagtccgatggacaaggcactactagcatctttggctgtaattagtgctatataagaaaactactgcttatttgcaatagtttggcatttcttatccctgaatttgaagttttttcaacaaaaaaaaaagaagaatgcttgcatattaaccaaactaggcattttggcatcgtccttattttgtcaccagctcagaacatgtactgaagcaaatgtatgtcggcgtaggatcagcaataccgtaaagctctatttaaatccacatttgatgagtggtaagagaaatgaaaaactgttgatgttgtcatcatgttggttcggtgcttttgcagtttgtactttgttctctgctgatcataagtccataacacactacacacaggtaataccgtactgacactgcgactctttatgataggcgttttaatttctgtactagacatgttttgtgttgtactagtaattagcttattattagcatcggttgcggctgcaattgaaacgatcgatggagggagggggcactgcacttacgtgatccagttgccgtcggtggagacgagcgcgacggcggggcgcttgaggcgcttggtgatgttggggaacctgtcgaggaacttgggctccaccaccagccagaagtcctgctccttctcccgctccccgtagagccgcagcttctccttcagctgctcctggaagtgctcctcctcgtccagcatgaacttggcgttcgccaccaggaagtggtacttcttcggcttcgcctcctgcgcgcgcccaatccaccacaattctccgtctcaaaccgggacgggaaaattatcaaaattagggcgggaggcgaggggcggtttggtttacctgatcgggaggctcgggggagccctgctggtcggagtcgacggccacggcgcggagcgacaggcgccgccgcctcggctggcacgagacggcgggcgggagcgcgaacccggcgccgacgcggggcagcgcggcgcgggacggcgcgagggtcgcgaaggggcggagggacagcgtcgcgggagccaccattgccccactcgcctcggctgccgaactcggggacggagccgaactgaagtgctgaagctggtcgtgtcagctcggagagggggcttgaggtcggaggacgacgatggacggtgagctttagccttatctctggacacgaggggtgggcgcctttaatactactgtgccgtgccattactggttaaatggctccatgacagcacacgggttttcgcactgtgccgttttgaggcccatagattttttttttgggcacacgtggaccctactttgggttttatataggaataagttcatctgaggtccctcaatctctatatacgatttcaggtctaatcccaggcctctcactgagccacgtggcatcacgcttgcgctccatccaaattctcagcaggagaacatgccacgcattcaaaatgtcccatagccgtccgatgacatacgaacggtgagaaaaaggtccagcggacctaaatataaaatgcaagttttaagaagggtttttaaacaaaatggacaatgccatctagaagagcctggagtagaggaaaaaaatcccagaaccaaaaaaaaagaaggggctgtctatataggaatcgaatgatttctgaagctccaatcatacagattttatctaccataggatgcacatccaacaactcagaaaaagtgatacaaatagatattacacttaaaaacagatatattatttgattatttgaacgccatttttttaaagcctaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtctatatccagatccataaaagcccattagtaaaaagcaggcccaagatacaaaattagaagcaaaacacaaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctataggaaagaagaaatcaaagacaacttctgaacagaaagttgagatccatacaaaggaaacacagaatctggagaacacaaagaaaaaacaagaggaaggcaaaatcaagagaaacaagaaggctccagttcaaggttagttcaaggctccaattcttatcccctatatacaattcctgaaaaagatcaaagagagagtttaggtcaaatatataattcaaaagaatacatgaaattgctgaatatgtcaaatgaaacaaggttaacaatccactttgctggat

SEQ ID NO: 1220 - DNA, 769 bp, Oryza sativa
  unsure (1)..(769): unsure at all n locations
aatctctaatatcaccctatttaagttgaggttcttccacgtaaattttcaggccagtattattctctctaacattacttgtgggctcttgagattttaattgaattaaattgggcctagcccatttattccaacaatccccaccaaatttcatggctcacaagaaatgttctcaaaactgaacctgttagttataccagtgtttcgatggagactgttaagttgaacttccacctaggaaaagagctacaccagatcacaactgaacaatagactatgccttgaattattagtcttgtgcgattcaggtttcactcaaacccttaactggtattgggctgtcatttgcatcctctctgtttggagcgtataagtcatactcctggccttttcatgagtatctagagatcacctagatctcataaactgtgactagcagtcggactcatataggtgtgttccttctaagatgttctgtaggccaacatctctgctttatgaaaagccactcagatcacattaaggtgtataccatcctaccatacagattagaagagaagtgcatcatgaaaataggctcattttagggtctcttctctcagctacacaatagtttatttcgccatccaaattcacgggatctccgatcacaatggacaggtttccactattgtgcaactctaagtgggtctcaagcccatctccctcgatgnnnnnnnnnnnnnnnnnnnnnnnnnnnnnnnnnnnnnnnnnnnnnnnnnnnnnnnnn

SEQ ID NO: 1221 - DNA, 1903 bp, Oryza sativa
agttatgaggaaggacaagattttggacaagaaccatgctgagtacatgaaagcagagagagatatactgactaaagttgatcatccttttgttgtacagctgaggtactcctttcaggtatgcatttatcatctctgtgtgttctttgttgtcaagctatcatgcatgttatatttttcagtcttgtcccaaattttaaacccagtatttacttggcagacaaaataccgactttaccttgtgttggacttcataaatgggggccatcttttcttccagctctaccaacagggtttgtttaggtaatttcattacattattttatgtttattcctatcgctttgcatgaacatttaattaagcaaccttttgtctgtcagggaggagcttgcacgcatctacactgctgaaatcgtgtctgctgtagcccatctccatgccaatggaattatgcacagagatctgaagcctgagaacatcttgttggatgctgatggacatgtaaggatcctttaatacatatttttcttcaccttctctgactttatctactgattggtatttgggaatttacggaatttttcattgtcttatttaggccatgctgactgattttggcctggcaaaggaatttgatgaaaacactagatcaaactcaatgtgtggtactgttgagtacatggctccagaaattgttcagggccgtggtcatgataaggctgctgactggtggagtgtgggaatccttttgtttgaaatgcttacaggaaaggttagttatttaagcacgatgtttctgcatagaagatgtgtttgcattacagatggtttgcttctatatatccttttgttcccatgctcactcttattatattctgcagcctccgtttgttggcggaaacagggacaaagttcagcagaagattgttaaggagaaaattaagcttccggcatatttatctagcgaagttcattctctgctaaaaggcgtaagttgtttgccaagttgctatgattcaccgcacccatatttttttgcagccttgtgctagtttctagagtcaacctgtttgatcttgggattgaatttttagtccatcttatgtttcagttactgcacaaagaagctggcaggaggctgggctgtggaccaggcgggagcaatgaaataaagaatcacaagtggttcaagtcagtaaactggaagaagctagactcccgacagattcagccaagcttccgcccaaatgttgctggcaaaacctgcatcgccaactttgacgagtgctggaccagcatgcccgtgctcgactctccagtggccagccctgtcgctgcagatagcaacttcgtgggattcagctatgtgaggccagcgcccttccttcagaggccgagtcctctaggctgaagacctccagttgagaccgaaatacatcttgccactgggtatgaagctgacaaaatttactgtttcgatgattattatgtaaaactacctatttatgttgttcggtttgtctgggaaaaccccagtatcttttcttcgttgaagatactagtaaaagatgaacgtggtacttgttgaaaccagacaaatttgtctattgccagatggaacagttgccctggcttctatgatcaacccctgccccctgggccctgggcccctggcacatttaggttttctcggccgttcacgtacatgtttccaaatccaaatcctgctgcatgttgcaacacaaatcctgttgagatgcaaatttaaagcataccgtttatgcatgttgaaatgtaaattcgaacagagagttgctaaatttccacgacatctaaaaagtatagtatcactagttataagaaatggaccggcccaagtaataagctcacatggacagcagc

SEQ ID NO: 1222 - DNA, 25651 bp, Oryza sativa
  unsure (1)..(25651): unsure at all n locations
nnnnnnnnnnnnnnnnnnnnnnnnnnnnnnnnnnnnnnnnnnnnnnnnnnnnnnnagctaaatgttttagctgtagctatagccggttatagctgctcttagctattggagagcacaaccgctaagagccttagccagagatttagaatattgctagcgactagtgcggtggcagggaggaaaaaggaaaactgattagggttttgtggactttgcacaaatctcaaattaatcaatggtctgaaatttataagatactaggaggggttttctgtaaactgaggagtagacagtaaaaaaaaaaaaccatatagcattgccaccggccacccattgccttttgttcccctttcgtgattgcccggtcgcggcctcgccgctaaccctaaccgatcgaattccttccgaaaaaattcagccatggcgccggcggcgcaggagccttgggccattctggccgcaatccctaacgtggtggggtacaaggaggcgaagcgcatcttcccgccgggcaccgacatctccgtcgcccgcaaggaggtcccgcgagcctccgtcctgaccgtgccgcgccacatctccctcccggcctgcctcggactctacccctatgtcgtcgccgccgaccgctctggccttctcctcctcggcacgcatcctgtcacctccgcctccgccatggtctcctaccacatctgtgatgcgcacaccggtgaggtagtctccctccgcgactgcaaaccaatgcgccccatgaccttctacggcgccgccaacgtcggtctcatcatcaaggacgacggctgtatggtcgctgagctccagccgggatgcaagggcacaagcaccggtggtgccactctgctcagctacaaggtgggggagtgctgcaagtggcgcgagagggagcttacctgctcgcccccactcccgctggactggtacccggagggcgtcgtctcccacggcgggatgctctggtgggtggacctctcctacggcctcctcgcgtgcgatcccttcgccgaggagccgaacctgatccacgtcccgctcccacaagttcccgacgagcttcctgttgatgaccaggttaaccgcggtgcccaccgctgcgtgaaggtgagcggaggaaggctgatgtacgtgcagatacacggcaatcctgttgtgccggtggtcagcacatggttgctcgacgaatcgacctgctcgcccggggagtgggagtggaacccccagctcagcgcgcccttggccgagctctggattgaccagagctatgtggacaccatgctgccgttgaccattcctgcccttgcgctcccccaccccacagatcctaacagggtatatttcttcctcaaatcttgcatcttcgcagccgacctacggttgaggaagctggtgtcattcaatagttttgagatgctcgacccaccgtgtgaactttggatgaagcgctcctcccacttggtccacgcatggcagtatgatccttcaagcagtcgtatgtatcttttgtctctgcccttctctttatcttgatgtgttcagatgatagctcatatttcgatgttcctgccaattgtcattagcatggataaatcaatctgatccaccgcttatatcaaaactctactcagaccactcagaccctgtataaaatatccagtacccttgaactaaaacaagaccataaatcctatcctggtttctttataattttagcttgaagatccacaacttccggaacaccgatatgagctagatagtgtgataattgtgtgtttatacttgtttaattctgaaccaatgctcgctgctatataccttattcctgtacatattcctgtatagtttgtactgctccatttgatggaatactgctagtataactttagtgattgcaagagtgacgtaggtccggaatagttcttccatattctctagaaatgttccgttgcctcttacaaattaaatgatacagggaactgccaaaccgagtgatgggatgttttgcccttgaatggaatgggtgtaaccaccttgtgacactgggaatgtatagatgttacatcttttacagttgtgcttatgaggcacacggaccacttggttttcatggggaattattgatatttttaggtgtattgtttctctgcagaatatttagccagtttatagtgcttataaatcttagttgaagtgtcattctgttgctctcctcagcttacatataaccactgtaatttctttttttaggttctgactttgtattggcatgcttgaggcaagacaaggcaattgcttctaagagcaggtgaccctatacttcactttaacttccaattagattttcttgcatatccttaactttaacttccaagaagtagattttctttcaatggcctaatacaatctttcttttgattcagcttctctggtataattcctgtcactcgtagaactggtatgtactatataatctatgcaattcttcaattgcaattattggatggggtgtttcttttgtccaggttgtagaaaagtgagcaaatttcaaataacgccagacatagtgttttgtcaaacgtactctgtaaaatttgattgaatacgtccttatggtgtgagtatgttaactgtggtgccatgtttttttcccttcggtccagagtttttgtactgaagagctgatattatctgttgtatttccagctaaaagtttgaagagagtttgggattctgtaaccaggcagcagcaaaagcaggagcagcagcttgcagaagcaagctatgtaagggtgcagaatctctgaagaaagcagaatcagccagcctcattaagtatgaaggaagggtagagtatattattttgtgcatgatttgccagcctcattaaccaggatttatgaaaacgatctgatacagcatgagcttacttgtgagttcttgttctgtgccttttcttaggcctatttataagggagacgcttcatgtacagcttgagtacaaacgtgaatcttgactgttggatgcatttatgaggattttaaccattccgatcttgagttgtcccaaataagactttcaatagacagtcttcaatgttaaatagaaacatgttaattagttctacaaccataccatgcatgcatgtgtacgtgacagtcttcaatgcttggacagtactatggctgaatatttgtaactgatgtaacggttaggatgtatcaaaataagatagcttgaaaaaagtccatacttttgttctagaggccaaagaattaccatgttaattgaaaaactaatttcaagtccatacttttgttctagaggccaaagaattaccatgttaattgaaaaaatatattatgaagatggctaaaaaagtgctatcttttatttcggaggcctaaaattaccgtgttaatgaaaaaaaaaactacaccattagataaacatatattttaactgttaaaattaatttataagtataacaaacagcaaattaaatagacaaatactactcaaagtttggaaattactgtataactaaacaataatcatgttcagactctcaggtcccaaccggacttgggctaaacacattctttctagaggcaccacgtttaccgtggggactagaaatacccacattaatcgaaaaaaagaaaaggagagtccaacttgaaatacaatttaataataactgaaattaagaattaaaaataatcactatttaaagaagagtccatctaagaacccaatacgaggttaattaatattcggattaaaaaataaaataaaatccgaaattagcaaaagaagaagagaagagctcgagtagaaatacaatttaaaaataactaaaattccaaattaaaattaagtaatattgaaagaagagcccatataaaaacctaatacgagattaattaaaatgcggaataaaaaatcgaaataaaaaaaagaagagttcaagtaggaatataatgtaaaattaactgaaattcggaattaaatataagtaatactaaaataagagtacatataataacccaaaacgagattaattaaaattcagaatgaaaaataaaataacatatgaaattggataaattgaaaagagagttcaagtaggaatacgatttttaaacaactgaaattgaaaataaaaataaaaatattaaaagaacacattatgatattagttaaaatttgaaatagaaaataaaaaaaatcttaaattagaacaagagaaataagatttcaactagggatacaacttataaataactaaaattggtgataaaaaataaagactattgaacgaatagaccataaacacatgatgagattaattaattaatagtcatataaaggtgtaaagtggtggcggttgacgaggcatctaaaactattaataaaacaccaaatagaattctaataacaattaaattaaagggaaggagaacgaacatgtcatgaaataaccggtcaaggaggttggcaagacttctagaaagtaaaaaaaataaacccaattgataatcatatttaatttttaaaatctcaatgatagtaaaaaggagaggcagcgggcgggtcgtacaggagtaaaatagcatagccgctaatggttggtggtacttttagaaagtataaaatgaattccaacgatagttatgttcgacttttagaatctaaataacaataaagagtaggcggcggataggtcatagaggagtatagtggcagcgtttgacatgatttctaaaaattataaaaaatgaaatccaatgagacaacaaattctaaaaactataaggttcgggcttctaaaagtaaaaaaaaaaactccaatgataattatatttgatttttaaaatctcaatgacaataaagaagggagacaatggatgagccgtaaaggagtacagtgacaaagccgctgacgttttgcggaacttctagaaagtaaaaaatgaacccaaatgattattatgtttgattttgaaaataccaatgaaataaatagaataggtagtgacgggcaacatttgacgggatttctagaaattataaaaacgaaccccaatgggacattgaactctaaaaactatggatccaatttttaaaggttccaaggaaataaagaaagatatgacagaagtaagggatatcaattgatgtgacttttaaaaattataaaattagaaacacgaggatgataaggtttggtctttcaaagtcttaagacaacgaggtaactatttaataaattttaagtaaaatattatatttaaaaaatataattttgtattgatgctagccgcgcaattgcgcgggccacccagctagttatattattaaaacagctttgaaaggagatatcacgttcgctgtggaggctaacaattcaaaaatagctgaaattcggaattaaaaataagcaatattaaaagaagagtccatataaaaacccaatacgagattaatcaaaatttggaataaaaataaaataaaattcgaaattagaaaataaaaggagagtccaagtaggaatataatttaaaaataactgaaattcggaattgaaaataaggaatattgagagaagagtccatataaaaatccaatacgagattagttaatattcggaataaaaaaataaaaataaaatctgaaattagcaaaaagaaaaagaagagttcaagtaggaatacaatttaaaattaactgaaattcagaattaaaaataagtaatatttaaagaagaatcatataagagcccgatacgagattaaataaatttcagaataaaaaaataaaataatatccaaaattagaaaaaaaataaaagagagttaagtaggaatacaattttgaaacaactgaaattgaaaaataaaaatattaaaagaacactatacggtattaattaaaatttgaaaaaaaataaattatgaaactagaaaaagaaaaaaaagattcaattaggaatacaatttataaataactaaaattggtgatagaaaataaagactatttaaagaaaagaccatctaaaacacatgacgagataaattaagtaacatgcatgtaaaggagtagagtggtggcggttgatactacatataaaaactatctataaaacacaaaatacaatcctaatgacgattaaaaggagtgacgacaggcaaacaggtaaggcggttgtcgggacttctagaaagtaaaaatataaaccccattgataattatattcgatttttaaaatctcaatgacaataaaagggagaagcagcgggtggggtgtatatgagtatagttgtagagccgccaacggttggcaggacttctagaaaataaaaaatgaattccaaaagatagttatgttcgatttttagaatcccaatgacaataaagagtaggcggcggatgagccgtagaggagtatagtggcctcgtttgacgggacttctaaaaattataaagaatgaaacccaacaaaacaataaactccaaaaactacatggtccaatttttaaaggttcggaaattctaaaatgtaaaaaaaaaccccaataataatcatgttcgattttaaaatctcatgacaataaagaagagaggcagcgggcgagtcaaagaggagtacaatggcaaagccactgacggtttggcgggacttatggaaagtaaaaaatgaacccgaatgataattatgttcgatttttaaaatcccaatgacaataaaaagaaaagacaatggatgggtcgtataggagtataatggcagcgtttgatgggacttctagaaattataaaaagaaacccaacaagacaataaactctaaaaactataagatctaatttttaaaggttccaaggtgaatgaatagaaatagtagtagatcgagcaagcaaataaacaaggagatgacagaagtaagaggtatcaactggtgtaactcttaaaaactatataattatgtaactcttaaaaactatataattagaaacacggggatgataagatttggtctttcaaagtcgtaagacaatgagaaagttatgtaataaattttaagtaaatcatttagaaaagaccatctaaaacacatgacgagataaattaagtaacatgcatgtaaaggagtagagtggtggcggttgatactacatataaaaactatctataaaacacaaaatacaatcctaatgacgattaaaaggagtgacgacaggcaaacaggtaaggcggttgtcgggacttctagaaagtaaaaatataaaccccattgataattatattcgatttttaaaatctcaatgacaataaaagggagaagcagcgggtggggtgtatatgagtatagttgtagagccgccaacggttggcaggacttctagaaaataaaaaatgaattccaaaagatagtttggcgggacttctaaaaattataaagaatgaaacccaacaaaacaataaactccaaaaactacatggtccaatttttaaaggttcggaaattctaaaatgtaaaaaaaacccccaataataatcatgttcgattttaaaatctcatgacaataaagaagagaggcagcgggcgagtcaaagaggagtacaatggcaaagccgctgacggtttggcgggacttatggaaagtaaaaaatgaacccgaatgataattatgttcgatttttaaaatcccaatgacaataaaaagaaaagacaatggatgggccgtataggagtataatggcagcgtttgacgggacttctagaaattataaaaagaaacccaacaagacaataaactctaaaaactataagatctaattttaaaaggttccaaggtgaatgaatagaaatagtagtagatcgagcaagcaaataaacaaggagatgacagaagtaagatgtatcaactggtgtaactcttaaaaactatataattagaaacacggggatgataagatttggtctttcaaagtcgtaagacaatgaaaaagttatgtaataaattttaagtaaatcatttagaaaaatatatgattttgtttaggtgctagccgcgcaatttggcgggccacccagctagtttttattttaataataagatctaggagtataatgtttatactccactaactcaactggtaataaagaccacgtcgcatagaaatcacaatatactacctccattttttatatatgacgttttcaactttttcacataacgtttaatcatttttattacgtaaatgtatcagttttttctaggcatgcaacctaataaaagtctttacttataagtgcttatgattttttttttgtgaattttgtgttttgaattttgtctcgagaccttcatgttcttcctcattcgctgacacgtgggacccatggggactactgtcaccgccacagcttctgctttttcgcgcgcaccgcgatagcgacagccactttggcttggctttgcgcgaggaagcagcgcagcgatcccgtcaccgtgacctcatcctcccccgatcacaacacaaacccaactacaccaagagcttggggattgggggagtcagggggaaaaccctactccgtctcgccaccccacacccaaggccggcgactccttcggtatgccaaactccaccggtagtttctcctttctttctctgtgcacctgtgatgtcgtcgtcttgtccgtgcaggctccatagcgggtaagaaagggtgcaccaagatcgccggcggagatcgtcgccttggtcttgacgaggccagtgagccctttctcccttcctgttcttgagttggcgcagatccgatccatgccctgactctctctcctctttcgcaggctgccgtgaccccaggcgaccggaacgtgaggagccggaccagggacaccgagagagaagcccgccgtggagacgactgccaagttcttcgcctgctccatatgtcgacatcccctccctcggtgagtatccagccaacctgcccaacgtagggtattagtgtccggcttcgtgcgttgctccaaggggctttgtgtgcgcacgcgttcacggcgtggtgatctgttcacgccgccgtcacggtcgataactcgatatctccttcgttcgccgtagagccctcgtgcctgtctccccacgccgcttgttgtcgccgtgacttgctgtgccgcgtcgtaatcgcttgtttagcacttagcagagcatcaggttctggtgccactccaccgcgagtttggggaccggtttcccttttctgatgacttcgccgggcgagattacgacgtttgggtagagtacgtacgtggcgctgccgggcgagattacaggcgagtcgccgccatcctgcggagggggattggctgctcaacgtactacacgattgattgatccatccccatttcgctcaacctactaccgattgattgatccacccccatttcacttcattgcaggacatgtcggagatggtcactgtgcaatttctggatctgagaattcatcgcatgcccgccaacgacgtcctacaacttcgtcgccgtcttcctcctctggagttgaactgcgtccaatccgtggaccaattcaaaagattccaggcgtttgtaagaaaaaatgaggagaaggagaaaagggatgaagaagaggccgagctcaacacttccctaccgatctttcttctaccgttgattcttgctaactgattaactttgctatgtgcgtgtgtttataatgtgacgaattgacactgttcttgtatccagttggcaattgtcacgagtcaaacagatctagcgcgcatatgcgctacaagaggtgaagaactggatgagcttggtatagtggaggagtacgacgacgacgacgacgacgacgacgacgacgacggcgacgagcactatgtgtatggaggcttggatatgttcgagccagccaccaccgatgaagaggacgccaacgcgcaggtggatgctgatgatctttactacctgggggtcagtgacgacgagaatgaggaagtgggaagcgacggcgggactgatgacgacggcggtgatgatgctggaggcgacggcggacgggctggacccctcaggtgggacaacctatgggacgacgacccaccacagtgagtcagtgacggcgtgatgccctgatacaccgatcgaaatcctatcttatttattgcggagtagcagaattgacgaacaaacctagagcttatttatttccttacgactgacttgtgcaaacattcagcatgtcttgtgcaagtcatgttttaaattgcatctggatgacaatgagctatggttaatgcagctataatttcctccaactgtcactgctctttgcctgatgattttctagagacaagaggcagaagatctcgcaaattctgatagtgcataattaattgtttctagatatgatctgtatatataagtgcacttacagtatgtgagactgattgggtactctagaccatttttactggaatcacaagctcatgcatgcattcagcgcatcgaagcccatagcattctacatctacagcagtaaaagggactttatttttgtccctgactactgatgaacagatggttctacacttctactaagtttcatactctccgaaacaatggtattatacatgtattgcaagaatggctctgagctttcactgcagcggaagactgtctactttactgaactgtcagctcttggcttccttctccagcccatgcttaagagcaggtataatatacatttcgagaaaataaaataggagagaggagttagtacggagtagttgactatactattaaacttgcactaaatacattgagcatctagcacatcctcttccttgggaacatcagcaagcaaattcaaattgttggccttcttggtgttcgaggaaaccgtcggtcctctcgcgaagatcgtcgaattgacccgaaagaagccgtgtcacagggtggtgggtcttcgtcggactccggtgcgactgcgacgtcgagctatcgtcacggactctcacggtggtcaacagttcaacaccgcacagctcaagtgggacgcccctcttacggtcaccgcggcgtgcacgcggggagggagccgcccggagccagaaattaaccgtgtagattcaattactagtttactactgctccatccgtctcctaatatgaggaattttgacatttgatttgtactgtttaaccattcgtcttattaaaaaaaatttagaaattatcatttttttcctactttattatccaaagtgcattaagccacaactttttattttttatatttgtataaatttttgaccattcgtcttattccaactttttattcgtcttattttttaaaaaatttatatataaaaatcaagattattgggtcagccgaccccacagtttgtacatacatccgacactggagctgtcggccgggtacgtatgccacacaggtgccgcgtcccagggcacttcatcgagcactgccctaccaacgggcaacggcgacccaagatttgacatctggagggtggctccagctccagcgtcctcatcggcgccgctgcgtggggggaacctgacggcgtcatcccggcggagctctactgcaagatttgccggaacgtgatgaccgacgcgatggtgacgagcaagtgcttcttcagaaattgccgattaagagctacttggagattttcttttcctctcatttgcgtgttgtcatgtagtgtgtgtataagatcaagtagcgtgctatgttgtaatgtagaagatgaactacttcagatctcttttcatcatgtatatactgtacctatgtaatacagtacgtattattaattggaatgattttgtcatcctgtatacactgtatacactctcttgtcatcttgtgattctctctgtctctctctacggagtaatatgttaattggaatgatttttttccaccaaaaatctgaaatcttttgttcctgtaagcgtgactcttccccgtacattttgacgtacgatctcggaacaattgccgtggcgcgggcgcgcgccaacgacgatggcgaattggcgatccaacggcgtcccgttcggcctgacacatcatgctaaccattctacgacggcgcaatgcatgacggctctgcccacccgatgccttccccggcgtgcaacatgccagccagcgccaccgaccggagcgcactgggcgattccgctccggcgggacagacagaccagaccatggtcgagcctccacgacgacgaggagctgatccggttcacaacgtataaacaagacacaagaatggcaccttacgtgttccgtgtaaccctcaccattgtcagctgatccaaaaatcatacaggaaatacacattaaaactcgtaataattttcaaagcctccaccgattcgcgactcgacaagtaaacgccgacgctcccatcgcgatgcgacggtggtagtagttacaaaagaggcgaatgcgccgcgtacgcgcgcgcgtctcacgatcgagaaggaagaggcggtggccggttgccggagcaggtccagctcggctcatcactcacctcacctgccgcggagcagggccttctcggcggtgtccatctcctcgaggatgcgcgcgcggcggtaggggtggagctatagcgaaacagaggatggtgccacttgcttaatttactctactttagattgagtataagctaatacagatgtctaaatttgtattgagggggtgcatacatgatgaaaatagatgaggtatagctaaaaaattttcttcactgggttcctaggcacctccctaatatatactagctccacccctggcaacacttgttggggatgggagttgtggggccgaagctgatgtagtgtcccgacacacgacacggtgttgagcgcggagtacatctccctgaaggacagccgacccagtaaactgaaagaagctagactcccgacagattcggtgcctgtttgggggagcttcttctagaatctccagttgctagaaagctcccccaaacagtccagctttttacccatattctgagaatctgtagttatataatcttaaaaataaattagaagccaaaagctgggtttctcagcttctccagattctcagcagctgcttctcagaatcttaagcttcccaaacaggtcctcagccaagtttccgccaaatgttgctggcaaaacctgcatcgccaattttgacgagtgctggaccagcatgcccgtgctcgactctccagtggccagccctgtcgctgcagatagcaacttcgtgggattcagctatgtgaggccagcgcccttccttcagaggccgagtcctctaggctgaagacctccagttgagaccgaaatacatcttgccactgggtatgaagctgacaaaatttactgtttcgatgattattatgtaaaactacctatttatgttgttcggtttgtctgggaaaaccccagtatcttttcttcgttgaagatactagtaaaagatgaacgtggtacttgttgaaaccagacaaatttgtctattgccagatggaacagttaccctggcttctatgatcaacccctgccccttggcacatttaggttttcgggccgttcacatacatgtttccaaatctaagggcttgtttggattgtagcttaaaaaatgatatggttaaaaatagcatcaaagtgaacatgtccaaattcttctgcatgttgtaacacaaatcctgttgagatgcaaattcaaagcataccgtttatgcatgttgaaatgtaaattcgaacagagagttgctaaatttccacgatgtctataaagtatagtagcactagtaataagaaacggaccgccccaagtaataagctcacatggacagcagcgtataggccgagtcggagtctgagcgttacatgccacgcaccaactccgactccgactccgattcatccttgcctccgcgggcgatataagcgacgccacgccacgccatcctcccagtctccatcacgctcagcaacggcacgcaatccgcctctaccctccatcaccctcttcattccttcttacaacctccggcgatcgcagcagcagcagcaatagcacccctcctccgttcaacttgagggagaggctatggcggtgttctacaggtacagaagcagggtggacaccttctccgtgcccgtgccggagccttttgtctccgtcggggagctcaagcgcctcatcacggccaccgcgcgccacggccatggacgttcgcgcggccggggcccagggacagcgtcgcgctgtgcagcgacaagactggcgaggagtacgcggacgaggacgagctgatccctagcggctgcacggtcgtcgtgcggcgccgagtctccgggcctcctgcagagacgatcgtcgagttgacagtaaagaagccaatgtcggagggcggtggttcttcgtcggactctggcgcgccgtcgacgggagctgaagtggacgacgaggagaaagctatcagctccgtgatcgacgccgcacagctcaagtgggaggccccgacgtcacaaggaggcctgcatcgggggagtctgacggcgtcatcccggcggagctctactgcaagatttgccggaacgtgatggccgacgcggtggtgacgagcaagtgctgcttcgacagcttctgcgacgggtgcatcagggaccacatcgcctccaagtccaagtgcgcgtgcggggcgcaggcgcgcgccgacgacctgatccccaacacgacgctccgcaccaccatcgccaacctgctcgccaccaccaccggcgcggcagcaagcgcctcaagtggaaccgacaagacgaggagctccgccggcagcaacgcggcacatccggcggcgccgctgagccccgcagcttcgcaggcgagccgcagcagcaacgtgagctcagagaaggccgagcacagcgacggcggcgcgtccacgtcgaagaagatcgccacgatctcaggtgccctcggcccaagaaaggcgcaggagacggtggctggcgaccactctgcagaatccggagctcgcgccgtccatggcggcgatcactacggcgtcccgttctgcccggcgaccggctacgtcgaccccttcttcttcggcggcatgccattcggagccgatccttacatgtactacggcggcgtgccttacggctgcggtggtgcacccaacggctactacggcggcgaggagctccgtgacaggaagagggcgcgcgtctctcccggaaccggatgttggtgatcggcttcggagaggatcagaagttgccgattaaaagccatttggagattttccttttcgtctcatttttgtgttgatatatagtgtgcataagatcaaagtgaaatgctagagatgaacaaattcagctctcttgtctctctgtattgtacggctgtacccatgtataataatgttattaattggaatggttttccccaaaaaaaaaaatctgaaatcttttgtcttgtgatcctctactaacatgttaattggtattatatattttttcactcaaaacttgaaatcttttgtccctgcgtgagcgtgactttctcgctcaaacacaagacatgcgcgcaaggtgtttgattctgctaacgacgggcattttgacgtacgatctcggaacaattgccggggcgcgcgccgacgaagatagcgaattggcgatccagcggcgtcccatctcgttcggcctgacacaccattgcttaaccagtctacgacggcgcaatgcatgacggctcgccccaccggatgcctcccccggcgtggcgcgtgcaacatgccaaccagcgccaccggccggagcgcatcgggcgattccacgccggcggagctccggttcacgacgtataaacgagacacaagaattaatggaaactctagggagttgcatgtccccaagccaaccgtgtaatcctcaccatgtcagctgaaccaaaaatcatacagaaaaaaaaaatacacatacaactcagtagtaataatttcaaagcctccaccgattcgattccactcgacaagagcaaagccgacgcccggccccatcgcgacgcgacggtagtatagtagttacaaaaagtgaatgtgccgcgtacgcacgcgcgtgcgtgcgtctcacacgagaaagatcggtggccgtaagcactcggctcaatcaatcatcactcacctcaccggccgcggagcagggccttctcggcggtgtccatctcctcgaggatgcgggcgcggcgcttgttggggatggggcccgtggggccgaagctgatgtagtggcccgacacggcgttgagcgccgagtacatctcccgtaaggacgggcgggccagcagcgacttctccctggcgtacttggccacccacgagttggacagctcgcggagctccgccaccgcgtccgccacaccggggtccgccctgtccatgttgatcgtcgaccgcaccttcccgatcacgtccttcgtctcgctcacgtactcgtcgtcagacgccgcccgcgccgctcctccgcacggccacagcgccaccgccgccgccgccaccaccaactcgcgcttgttggcttgaagcgcgcgttgaggcggcgttggctttacggcgatggcggcagtggcagcggtagccggggccgtgaggacggccggcacgggggacgacgctggcctcatctcgttcgtgtcctacgcgagctcgcggtgtgaaagggaaagggggaaaagggatagcgcgcgggtttgtaagataggcttgggttgggttgggaaggaggcccgaaggccggaaaaaggtgacacgtcggcttatccccttatcccgactcgtcaccatgcacggttatgtatgggctcgcgggatttccgatgataggccgcccatggtgttcggcaactacacgttgatggttaccggaactcgcaaatgaacatcagccctagatcctaatgatctagcaaagtgacagggtgaataagcgaaaaggagacgggattggccgcaaacattgatcctcatggtctcggataaaactgaaattcacagcagagttggaagcagagttacggtcacaaatacacaaaacggtgtagacacagtgaaaactggacaataattgttgtaaatcggcaaattaggtttttgtagcgatgattggggagtgtatccgaggctctgagcagggtggacgtttaacttaggttccagccttccgacgaccaacttgggcaacgaatccagccttgataggagcaacagatcttgaagaaccacactgcggagggtaaacaaaaccagcagtcaatatttggcttgacgaagcaataacgagaaatggcatgatttggatgacaataatacatcaatccactggcacctaaacaagggtcacaacttgtactaacgggcgccaacaaaaaaaactctcgatatattaagaaaaatccaccagaaagccaagtgaactacatctttttatcctcagatgttgcaattgtttctcacaggttagtcaaacaatgtaggcaataaattttgcaactcatcataggttaaaaaaaaggcaatgaattgccctcttcttttctaaagtaataaaagataaaccaaccagcagaaaatcaagtaaaggggtaactttttatcctcagatgttgcaaattttctcacaggttagtcaaacaatgtaggcaataaatttcacaactcatcataggtaaagaaaaacaatgaattgcactcatattttctagaagaaaaaaaaaaagaaaaaacaaccagcagaaaatcaagtaaaaggagtaactttttatcctcagatgttgcaaattttctcacaggtttaatcaaacaatgcaggcaataaatttcgcaactcatcataggtaaagaaagacaatgaattacattctttattctagaagaacaaaaagaaaaaccaatgacagtgctttatgcctcagaggttgcaaatattatcatgacaacatttgtcagacaatgtaggcaaaagatattgcaactcatcataagcagagagtcaggatttacaaaaacaaataaaatgactagttggcaacaatacaagttagttaattaggacgtatgagtgctgatgcaatgcagcaagaaaaattgtgatagcatctcaagcctcagctacttgcaattaatatcacaaagatacttgtcaaacaatgtaggcaataatcttgcaagtcatcataggcatcattggtatcaaatacatatgatatgcaaaaatagattattattattacagcaatgcaagacaagaagctgaattgactcagctctcgcaactttagttacttgcaaacaatgtaggcaatttcataggaaatgtttgatgatagggaccttgcaaaaaaaaagagaccaaggtaatgctctcaagagcaaatccaggtatggtttgcagtagaccacaaatgcacaaacaaactcttcggactaatataactagagaaccatgtaaagctgtacaaagcaggggggcatgtttgttgcagtattaaagatgcctttagataagctctctctgtatggaaattaactacatttgacacgactggacatgcaaatatatattgaacagcttacctgttcgcaacgaaggaagaacaacctattctccttagaaaggatggtatcaggactcttgcacccattgcatatgacatactcatctgaaaggagtgaaattaaaaaaggatgtaagtttagcacaacaagactttaatgacaatcccacacataggacctcataaaaggaacaagagaataaacgatccagccatatatatagtacccctccaaatcttcctaactctagaccttactgcattaaaaaaataatatacatgggaggtggaaaaataaatagggcccaaggcattaaagaatgtatagtaaagtggttaacagcccaataactcctcctagataactgtatggatacttcaatttcaactggtaaggcttctctgacatctttgtttttttaaaaaaaaccaacatttatctatttctcttaacagattagtaaaccctcttttgaagacagataaggaaagcttcaccataattggtaagattcctttaatttcccagtacaaaacaatgaattggccctataagtctatttaacagaagctaatgaattctggatatcacagctgcaagtttgtttatagttcagcagtaactttaaagagtatgagcaagattcatgtgacattaaggaaacttactgatatatctcctaagtatggcttcaaagtttttaggagcaaatcttccttttataaccaatctttgttgcccatcaagggatccacttgttcccatctcagcaagtaaaaacatcatcacatgttcaggttgcctatgcattctggaagtgtaaacgatgatttcagttagctcatggtaatttatcttctctgaaataaaagcaggcctagagcatatggtatggagtggtaaaaaagtgagatcatacgttttgcacaaatccatgaagttcacaaaaactgtcttctttgtgccttccctaagaacttgaggaggcctcataacagttcttcgtctatcaccagcaagatcaggattattctcacgcaggatattaaatactctgccaagcagctgtcaccaaatagattgaaagggttcattaacagaaacacaattgaatactagttgaagctgagctgagcactacatgagatactaataccatatcaatagcaacaaaaacataagaagatcaaaataaaaaaaaatacttaaaagggagcaatgcttctcctcaatagacaatgaaccttccaccattactactccctccgattccataatttttgacattttggacaatgacacggtctccaaaatacatctttgactatatttttctattataacatatacaataaaaagatacacttttacttttattatagtattttgtaagacaaatctatatgctgttctagtacctttaaactaaatatttcaaagttattgatagttaaagttataaaagtttgacctcaaccttgtcgaaaacgtcaagaattatggaaccggagggagtttaacttaaaaatataattgcaggtgacataatatgaaaactccacagctttctattttgatatgtatatcttatatggaatttacaagtcatgatctgtcaagaacatgacaaggatatagaatcacaaaaatttgaacaggcaaggagtattaacctcttcatatttataatctctgtcagttccttcccaagggtatcgagttgcacctccaagcacaatcccttctccttcttcatcctctccgatttgatcatctgaacaatatatgatcagacaaagcaaaacaacgcaaccagggcaaatatgagcaagccacaattacctatagcatcttcaccatctccagcttcagtaagagatgtatcatgctccacctgaaatttgcaaaattagtaaatagaatagtacagaaggaaatattaatccaacaaacattgcaacaggcatttgtaatttgtaaccaactaaactcacatgcttcttcttcttctttttcatgcctgtaaaacttggctcaccagtctcagcgactgaaaaaaaaaagcaagttaagcatatattagtaaaaatgcatacttggcaattccttttttttttgcagcattaaaagtatacctgtcaagctctcagttttctctgccaacttatccacctcatcagatggatcttggatcacaaccttcttcttcttctttttcttggttgggtcaaaaggagtaagctacaaaacatcacaaacattgtcaacaagccgctggtacaaggaaaaatgatatagaaggctgacaagaaataattgtgaaaggctgattacaaacaaataaaatgctgaaatccaccacggagtaacatttcacttgctttttatcaaattgtgatgttaaccctttgttgcacatgataatccttaggcataacatgtgaccgccatgctcaaaacacaaatgatgaatctaatttgttgatctccttacaggctacagctctacatccgttcaatcaacagaaaaatcccacattgtggtgcatatatcctgacagggccattataacactgataatgaccaggctagcactgacagtatattcagacacaagtccaaacaccatcaaatatcaccataggtgttcactgctaactggttcagtcctcacaagctactacaaaaagatgaacaaaacaaatcattgcttaatctggcctatcactcatctcagatgttttttttattatttttgaagcccactcatctcagaagcttaatccgctcttacagatttcactgattcaatccaagcacacagatcaaacatcctgaagaggcccatggtcgcggattcacgcccaaaacaccctaccagatcacgcatacaccaaacacagacagcacagcacggcaccgcacccagcccatcgctacgccgtttcttcccttccccgccgaaaaaccgaactgaatccgatgtgcagggcaaatgaaaaaaagaaaaaaaaacgagaagggcaggcttttcacctcggagacctcctccttcctctccacctgctcctcgtccgccatggtgacgctggccttcttcacacggcgactcgatccgcggcgcggcgggctggggacctgaactgcaagggacacgagcagcgatcagatcgggtcgggggaatcgaccggaggaggaggaggcgacaaacccttacagggcgagagggaggatgacgacggcgggcggcggcggcggcggcggcgctcctgctagggtttctgatgggcgctttgctaggctttactgaagctatcctttttcttcgactcctctgtttttctttttcttgggtggttgccaggttttcgtttcgtggctgggccggtatttgtagctcgagtcacttggtcgcaacattgtcctagcctagccggcccacatgagagactgtagaagcgacaatggtgggctctgttaactttgttaccacttttaaccctactactaaaccttaatattattaaattttgttagagcaatcaactagaacatatccttatccatattatcacaccaaattttagtaatcatagaaatttctactcttggaaaatttatcaaaattagataaagttctaaaccaaccatgttcaacgttaccaaaattcgataacaccaaaatgtgctacttcctctatctcataatatagtaatctaaaactggatatttcatattacaataaatttagatagaccagataaaatatttcatagcacaataaaatctaaataacctattacttgtgtaagtggtgctcttgtctcacaagaagaacacggagttagggcatgtaaaacaaaaaagtcactaatgcatgattaatttagttttaatttttataaatttaaaattttgatttaattagtattttaaatcaacctttgtatagaaaaattttcgtatgaaatgcatagttaacggtttggtaaagcatactaaaaatgaggtaaaatatgtaggcattgttgacgctttttcgtggccaacacaagatcacctaacgatttgcggtgtaaacaatagagtcatcaaaatcgatagatcaaaatcggctggtgaaaccgatttcgagatcaattcgctttcgtggaatcacacgactaatttataagcaaattagtaaagaagattctatcgtacttacgtgacgacgaacgactagtttccgagcaaactagcaaaggataaccttctcgctttcgtggaaaagcacgaccgtttttcagcgcaaaacggcaaagattaaccaaattctagggttaagcaaaatagaaaataacagaaaagtaaagaacaagaaaaataaaaataatagtagattgattatttgttcggggttccacaaattgacgcaatgccctaatatatataggagcaactaaacgctaggtgcgataagcacggcaactccacgtaccgtatagcttaaccgaatacgattccatctaaacaaatctaactattaaaaggaaatatatcgctacctttcctctgatacgcatataaccagcggcttggctccatctcctctctgaagacgtaaatcgcgccggacgtatacgtacgcaacacatgcgtagcccctgtagtttcccggccatggaaccttcttcgagccgtactcctgacttgatgaagtaataggaaaaacagcccagcgccatgcatcaatcaagcagataacagaccagcaacccaaagcaaagcacttaatctccatcacacgaaatccccgtggtgcatttcatctactcatctactccctctgcatatgattaatatatatgtttaactagccctcaagccaaccaattaaacatatataacagctgctccaatgaatttggcctgctcaaatgaaactgactattattagccaaattatggtataaagaggcatatgtatcctccagtcccccgtcagcgagcaacggatgaaacaaaaacgacatatgctgatgctccatcagtcgtgcaacggaagtggttggtcgacccattggctgccattggttatggcctatgtccctatttttactcttgcgccttgattgtcttcctgcgagtaatgcaatatgactagctgttcttttctgattaagattcagattttatctcggttttcattagcacgtatttcaaagtatggtactttccgtacgaaaatttttatataaaaattgtttaaaatatcaaacatatctatttgtcaactttgtaataattacaacttaattaatcatgtgcttataattttcaagttttatgtgtgtcagcttaatatttatcttaataagttacaaacaccactgtaggacttgactcggtttagaccctgtctctttcagcttaagattattataatctagattattgagtcagattactgtaaactagattgttataatctgtagtagaataagcggttagttgtttctttcctagattattagagcctagattattgggtttgcaagtctaaagagggagtggggtagcatggtgggtaatttttcacccaataatctagaaaaagctcacctaaatgagcttatcagattataataagctgggctttagattataataagctacttcaataagttgtctgtttctttcagtttactcccaataatctgcattataataatcctaagatgaaaaaacagggccttagtcgttacgaatcgactcggtgtgcaattgacatggcaagatttagcacgttgttttgtgacccgcatgctacttgttatgtatctaaacatttgtcactttcgattagatactgcgtgcgattcttgtgcaacatggtactaaaaattaattaaagaggtataactcagataaaacacgcattttatataagtatgaattgttggactgactgggtattcagtagcctcgccatttggtggtgatggtgtgtaggctgggacatgattttttagctcgcgataagaacatttccctcctcttggttgttggggcacgccgctgcaaccaacctgaaaaaggcattccaattcctctttttgcaatatcaggttggaaaattaagcatccaggaatcatcctttctccacgtgaattcccatccatttcctctcttgaccacagtctgtatcttgcaagaaacattgagatttagctgggcagcaggcgacgacgacatgcagatgttaaatgagaaaatgatcaacagagacacggtagtcccctggttctgcacaaatctagctggagacgactgtcacagcacccttacatcagttaaacgagtataaaaacacatcagggttacgtaacacaacgaaaatgaaaaagaaaatggcataaaaagttgttggtaagaaaaattactagcctaaagaaaggccactgaaaggaacaccaagaagaagaaaacaaggttcggtgttgacggtgtcatcgacccattcatctcagaaagtcagaatgtgcacttgagaaaaataacaccccggaatatcatagtccacggttcatcaagatgatacaaattcacgcaatggtgcgactctttcatccaaatatcttcaattgtatcattagactgtacctgcatacagttactctttatcttgcacacagatataagcaagataatcaccaaccatcacggggaaaaaaccaagcaattagtaggttaggcgagctactaaaaaaaatccaatacattattgctcggaaaaaaaaaagctgataagatgggatgacaccgaatacaaagcaatctggatccagacacttcaattatctacgcagctgttagtacaccatcaatgaatatccagataacggcactagtacagtacaacag

SEQ ID NO: 1223 - DNA, 1356 bp, Oryza sativa
agataatcacaaccatcacggggaaaaaaccaagcaattagtaggttaggcgagctactaaaaaaaatccaatacattattgctcggaaaaaaaaaagctgataagatgggatgacaccgaatacaaagcaatctggatccagacacttcaattatctacgcagctgttagtacaccatcaatgaatatccagatacggcactagtacagtacaacagttcaacacctatattatagatacacaattgtaagacaagaagacaaggaaaacaaggttcgttggtgtatgtgcatgagcacgacagatgcaacaatcggcatctagcatggtcaaaatatagcagcataaaagctttctagaatcatcgacccaacacctctaattcaatgccacatgctaacatctttgcacacagcgattttgccaaaatggactcaacctagctctgccaacaatcgagtatgatgaacaatattatacaagacaataagtgcagctcagcagctgttgtgttggggctccgaccgaacacatgattaagataacaaaaaagggagtgtggatcatgcgtatcactctctcatacagtatcattcgttgggtcaatagcagtggtatggtatattacaatacatgccgataagcttataggcactacatcagggagaaaacacagggaaagacagaaccatctaatttgaaacaattatctgacttccgatccataattcaagagaacataagggcaaactcatgaacatatgctgaatgaatagattatgcctgcagggtaacaaaccgagacattgttacctcaccgtcccttggggttcatgatctgcgagaagacagcactaggcgtcagcccatccgagtcaatacttgcaacactctgctcacccatgcttatcgaggtagttgtcgttgtcgtggtgcttgactcgatagatggatcattgggatccttctttccaactatcacaaggggagtgctgtcgtctgacatcccacatccaaggcttccgctctcctctgcactttcttgcatttgaagggcaaattccaagttccacagcacatctcccatcgaaggacggtcaatgccctgatcagaaacacacttctcagctgtttctgcaaacttcttgaaacattgtggagcaatctttcccttcaggtggggatcaacaatctgatcaagaatacccttcttctggcagtgtaatgcccactcagccaagctaacttcttcctttgcaagagtgggattcaaggcaggccgagcacataggacctcaaacagtacaacaccaaaagaatagacatcagatttgtcagtaagctgctgcctgcgg

SEQ ID NO: 1224 - DNA, 12165 bp, Oryza sativa
  unsure (1)..(12165): unsure at all n locations
nnnnnnnnnnnnnnnnnnnnnnnnnnnnnnnnnnnnnnnnnnnnnnnnnnnnnnnnnaagattagggtttcgtcctggttcccagccgtcgcctgtggtgttgggtgttagttcgttggttccgctgctgctgctgttgttggtgtttcctcgtccgtgtcgtcggttgcattctcggattgttctgagctgcaacctaagttaaggtaaataagtcgactctatttatcccttaaggattgctatgattcatatttgtcaccgtgggtaccagcactatgtcctgggactggtaccgagatcgcggtttcgtaggaaacggttcacgccgttttccctacgacacgctcctgtcaggtgccgttgtacggcggtatcagattggggtgtgacaccagagtacatgttctggaatattacagaaacttatggaatatgtctatttccattgtattcaagtaaacctctctctattttcagtcatttccatttctattcttttgtgccacccctttttgatgaagatgaatttctcttctttttgccttctaattcagccccagaattatgcttctcctgtgatatatcttgttgcaaatcttttcttttgtttgaaacatctttctttttctgctctacaccatcctgcaacaaataatatctttctttattacttttttaaaaaaattcaattcatatggatttgtaatttttgttacctgttctcttgtatttttaacctttcttctcttcttccttggcaagtcaaactcaacgtgtttcagagggcacgttggaaatgtgtgatctgtcctctgacaatgactgcaatgatatagttctttttgctgtatttcttccctgattgtcttatatctttgagctggcctgcctttggattttgcaatatctggatccaacaatatttcttctgtattttcctcagattgttgattgcctttttcatgtgagttcaaattgtcttctgcatttggatctgaatcattgatctcctgctcagcatctttatttgaacacattaattccaattgtttagcaattttgtccatctcttccactgcaaactggaaagtttcattgcttttcgatccatttgatgctatttctgcacttttccttgacaaaatgttgaatctcaggattgagctctgtgctaaaggtatatttccattgccttttcccccaagacctttgtactctttttttgtccatctttcaataatatatttttctggtatcttcattgcattgaggtggagcattactttcaatacatggcagcatagaagtccatctttctcaaactttgagcaaatgcagttgaaatcctccttttccaagtccacaataacaaggtacttccttcttctgattacttgaatattttgattcaatgccaaaaaaaacttcataagttttgaacttctctacttcatttatttgaaatctagttgttcttttcaactcaacttgaaacttgatgaagattttgcgattatacattctcattgcttggtactcaatgtagtaatgggaccaaagtttgcttggtttctttgtccttgaaatgtgatcatcaaactgttccaagttttgaattgtatccattactctttcatactctatcatgaagtttgtaatgctgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccaaatagattgaaagctttctttacaatatgaaagaagcaatttatgtgctttgcattttgaaatacttgagcaattgctgatctcattgctccatcctgatcagtaatgattgtttttggttctttttgtgacatagctttcaaaaaagttctgaacagccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattctaaagttttcatcatatcattgctgcttgtctccttgttaattgtggttctcacattgcttatatctttcttcgtataaggcaaagaagtcaatcctcctcttagaacagataaaatcacaatcatgtgccttgttggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactggtttggattgagaagttggtttgccttgtctattacatctgaacgttactgtcacgcccggaatttctatccaaaattccaaacgcttacatgtgtgtgaactctcgtccaggaatcagccgaggcacacaataacaaattgataatagagtacaattattactctaattaataagcgaataaaatgtcattacagaggtagatagttcctctcaatcaataaagatctaagcagcggaaaaaataagataaacggcgcagacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcattttgcaaaagcagcatttagcaaacatttgagaatttaataaaacagttaagtaataattaaacaatattaatccaacgctatacaacataccctgttgtataggcccaaccattctgaacaaccatcccagctgcacagttctatctccaaactaggaatataccattccaaaccaggagctaatcaaattattaccagttatagcatcttttattatgatgagaggtgtgagactaatcacgaaagacattgttagacccgcccataaccgcgggcatggctattcgaatagttttactctgatcagaggtgtaccaatgtacccacaagacacagccccacatcatgtcaccatgtgcctcaataccaccacggtacctcggaaaggagctgtgacaataccccttgcacaacacaatccactacagcgcacctttcctggatcataatcacccccttataaacaaggcatggactccccagcgacccccgtgggcttatctccgtcacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtaaatcttaagttatcccaatagtgtgctaatgtttctaagcagggctaagcaattatatctaatacatctagttgaaccaatatatatatagcccaactagtcaagttataacaacccaaggtatcaaggaataaagtaatcaagaacaaaaagggctataacaaacaataggttaattccacccaatgacattcgaaaataaatgcaatagttgaatagaaacgatagctttaaacgggatcaacatgctcaaagggttgtttgggatctgtgtgacttgccttgctgaccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaaatttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggtttcgcggtggaccgggcgcacggcgacggttcacgggaacggacggccgagatcgatcttatccaaaacggacggccgagatcgaccgatccacggccggaccacgagagacgacgacgatgacgtcagcggtgacgtcaccacctgcggcggctcgggagcacaagctcgccggcgaacgatggcgcggcggcgcgaacggagggcaccaggacgtagagggcgacgcggcgaactcaccagcgaccaaaacggcggcggaagatcaacggacggcgacggcgtcgaggaagaagcggcgtcgaccttcggcttgacgacggcgacgatgctccggcggtcttcagcgacggcgaaggggcggacgaggacggcgacgcgacggcgaccacgatggcgacctccccgagcgacggcgacgactggagcgacggcggagcacggctggagcggcggcgacaacggcggcgcgaggctacacggggctagggctctatcggcaacgagaggcgaaggcgagggtggcgacgggtagcggcgactccgggggtccttttaaaggggctaggaggcggcggcgaaggcccacgatgaccggcgacgctatggaaacttcggggttcggaggaaagagaccgatccgattcgacctcgaataaaacactttccaagccgatttagccgatgattccaaaagagaaaaggtagaggagatctcgggaaacatttcccctcaattgatttcaccgggaaaggaaaggatcggccgaatttggaaggaaacggcggcggcgcggcgctagggtttcgggcggcggcggcgcgacgaagacgacgactccgacaggcgggacccacctgtcagctacagcgagggcgcgcgcgcggctgcggactgggccggcttgggccgaggagagagagagagaggatttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatgttggaatttattaattaaaattagatcttctcttcaaagatttttaaaatcatttctaaaaaattccatttaaacaacaatttatatattttgaatttttaggatgtgacaaacctaccccccttaaacagaatctcgtcctcgagattcggaagaactggcgaacagatgcggatgagctgacttcaattcatcttctcgttcccaagttgattcttcttccgagtgattactccactggactttacaaaaacggataactcgattcctggttcttctctcatctatttccaagatacggattggtttctcaacataggtcagatcctcttggacttctatctgttcaagattagcttcttcggtaggtacccttaaacactttttcaattgcgacacatggaacacattatggacgcctgccaaattgaggtaattccaactgataagcaacctctcctcttctactgacaatcttataaggtcccacaaaacgcggtgccaattttcctttggtatgaaaacgatgaacccctcgaagaggcgtgacatgaaggtacacataatctcctgcgtcaaaacttagatctctccgacgattgtcggcataactcttatggcgagactgggccacacgcaatctttcttgaatgattttcaccttttcttctgcttccctcaagatatccgtcccgaaaacctgacgttctcccgtttgatcccacaaaagcggagtgcggcacttccgaccatacagtgcttcgtaaggagccatctgaagactagcttgataactgttgttgtacgaaaattccgcataaggtagattcttatcccaacttccaccgaagtctaaagcacaagctctcaacatatcttccaaaatctgattcaccctttcggtttgtccgtctgtctgcggatgataagcagtactaaagttcagcttagaacccatctcttcctgaagcttcttccaaaattttgaagtaaactgactgccttgatcagacactattttcttagggacgccatgcaaacacacaatccttgccatatacaattccgccaaccgacttccagaatatgttgtctttactgggatgaaatgagccactttggtaagtctgtcgactatcacccaaatagagtcatgacctgatgacgttctgggtaaaccagtgatgaaatccataccgatttcctcccatttccattcaggaatcttcaaaggctgcaacaaaccggcgggtttctgatgttctgccttgattcgctgacaaacatcacatactgctacgtattctgcaatttcacgcttcatacttgcccaccaaaatctttccttgagatcctggtatattttggtactaccagggtgaatggagtataaagtatcatgggcttctttcagaattgcatcttttaaatctttgttgtcggggacgcagattctctcacccaaccatacagttccttgctcatcttccaagaaaccgatagcttttcctcttctcatattcttcttaatttcttgaatatcaggatcattaatttgggcttctctaacttgatcaattagagtgggcttcgcttctaaggctgcaacgaaacctctactgacaattcccaaatttaatctttcaaattcctcgcataattccaatggtaactgtcatcctttctgctaagagcgtctgctacaacattagcctttcccgggtgataatgaattcccatgtcataatccttaattaattccaaccatctccgttgtctcatgttcaaatccggctgagtaaagatatactttaaactcttgtgatcggtatacacctctgtacgagtaccgaaaagataatgatgccaaattttcaacgcatgaactactgcagctaattcaagatcatgagtagggtagttcttctcatgcggacgtaactgacgagatgcataggcaaccaccttcccatcttgcatcagaacacaacctaaccccagtttggatgcatcgcaatacacttggaaacccttctttggatcaggtaaaatcaaaataggagctgatattaagcgattcttcaactcttgaaaactctgctcacattcttctgaccacttgtacttcacatctttctgaagcaatcgtgtcatgggcttagcaatcttggaaaaattttctataaacctccgataatatcccgcgaggcctaggaaactgcgaatctctgaaactgtctttggttgtttccagttggttacggattccacattactaggatcgacggcaactcctcctgctgagatgacgtgaccaaggaacttcacttcagacaaccaaaattcacacttactaaacttagcatacagttgatgttctcgtagcttttctagtgcaaggcgaagatgttctatatgctcttctttggttcgggagtagataagaatgtcatcaataaagaccaccacgaacttgtctaggtattccataaacaccttattcatcaagttcatgaagaaagcgggggcattggtaagtccaaaagacataacagtacattcaaacaatccatacctagtggtaaaagctgtcttaggtatatcttcctctttgattctcaactgatgataccctgatcgaagatctatcttggagaaaacggtggcacctttaagctgatcgaataaatcatcaattctgggcagcggatacttattcttgatagtcatatcatttagtgcacgatagtccacacacatcctctgggtatggtctttcttttccacaaaaattactggagctccccatggagatgaactcggtctgatgtatcctttctgaagcaaatcgtctacttgccttttgacttctgccaactcattggctgccattctataaggtctcttatggatcggagttgttcctggtaccaaatctattctgaactctatatctcttttaggaggcataccaggtaaatcgtctgggaacacatcaggatactcccggactataggaatctcttccaaagttatttggttcagtcttgaccttaaagactcagaagacaatgcatgaattgttacaactcgaccatcatcactggtgagagttactttcctgttagcacagtctatcacacccttatatctggctaaccagtccatccctaggatgacatcaaggtctttggattctaacaggataagattggccagaaataatgatctgagaatttctattctgacagaggggctacgttgcaaagagagtgcttgattacttggggtattaaccatcaaaggacgtctaagatcttctacttccatcacatgatttcccgcaaaactcatagataagaatgaatgtgtagcaccagaatcaaaaagcactgttgcagggactaagttaacaaggaacgtacccaaaatcacatctggagcaccttgagcttctgtagcagcaacatgattgacacgggcctttggcgctggtgcggtagagttgctctgggcagggacagccttcacgcgtcggggcttcggacacttgtcagcataatgtcctgggtctccacagttgaaacacactacgggcttgctgccttgctccctcttggcaggctgttgctgtgttggagctgcaacagggcgtggagcttgattgcggatgttgttgccagcattgttgttgaagaactgacgctgcggacgaacaacagacgaagaacctccctgtggcatggactggggtcctaaagtaagacgcggcctctgattattcccctgttgtgtcttgaattgagcaatccggcgtttcttctgttccatgcgattgtacttgtcctcctggcgaatagccttatctactaacttctggaaatcaggataatccccagtcatgagtggataagaaagctcatcattaagtccttccaagaacttctcctggcgctcttcatcagtgcgtacatcttccagagcataacgagccagacgattgaactcgtgcagatactcggtaacagagcgagatccctgggtgagcgacctgaattccttcttcttgagagacaccactcccgatggtatatgcgtcttccggaaagcagcggtgaactcaagccaagtgataggttcagcagtaatcctattaaggcgggagtgatcccaccattcagaggcagggccatgcagctggtgtgatgcaaatgagaccttctcctgatcagtgcactgaagcaaatccaacttcttttctatggcgtgcaaccaatcaccagcttcaacaggattagtggtactagagaaaataggcggcctcacacgaagaaattctgctaacttgttctggggaggtgcatggttatttccctggttctgctggttctggagttgctgcatcatcatgttcataagttgtgtctgttgagccaggacttaggcaagtgtgggattctctccattgttgttgttgttgttattgttgttgttggggccattcccattgctgcgagtgagcaccatctggcatgggcaggagcataagaagagaaaccggggaaaactacttaggaccgagaattaatttaacttttattgatcttaagtgagtttcattattacaaaactgaagactctcacaccactaaacttaccaactacctaacactcgaaagcaaacaaacgcacgcacttacatcccaccactgatgtaaatcacatgcgagacacacacaaccaaacttaaacaagcaaactaacacaacgatctaagacaacggtttgacaaggcattctaggtcttccgggcatcggagttgattgaaggctcgttcggctcgtcttcatcatcttgagttgctccccactcaatcttggaatgggtgcgctttgattcatctccttcatcatcacttacattgacgaccggaggatccgctagggctggggtaacttctttctccaccacacggacctttggcaccaattggtagcgagggacaaatagagctctcttccttgcggtaagacgaatcctggccttctgcggtggtgcttctcccttcaatgcggctagttccttctccaaacgatccactttgtcctcaagcttgcaaatcttaccacgattccggtcttcacgatcttgggctgctaacacagtctccgcacgggtttcatccatagcccacagcatctcaaccaaatgccttgtggtagcatcattctcaattccctcagtctcaaggtagctgccacggtcacttccctgtggttggcgaggatggtagcgatactcagtgtcggccaactgatcactgtagcgatcaaggagctctcctatggcgatccttgccacctcctgacatgtatggatgtagtttcttcctccggcttcgaacatcactgagggaatatcttcactattactgttcaaggtgactttgactcggcacttctcttcgtgacgatcatgaggaatttgggcatagaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagccaaacttgcaggataagttgaaacagttggaaacaaggtcacaaattttgtacttttgaacaaccggtttcaaaagaaataaaagaaagttataaaatcaacatgctaaatttatttcattgcagcaagattaaactaaacaatattgtaaaacttttgttggtaaaatgagccattagtacagtaatagatgtacagtactaataacgctagaataaattttgaacgagaaccactaaaaaaaatattaggaaatgcatgtgccattagtttggtttaattaaaagagaaggggaggagaacagttctacttttccaatatttttagagggcttctatgggtaaccatttggcataacctagggtcaaggagctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattatagaggtagatagttcctctcaatcaataaagatctaagcagcggaaaaaataagataaacggcgcagacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcattttgcaaaagcagcattt

SEQ ID NO: 1225 - DNA, 993 bp, Oryza sativa
  unsure (1)..(993): unsure at all n locations
atttaaaaaaatttagagactttaaccaactaaatccgagctaaaatgaattagttatgactttttgaagattaaatcggattaaaacacttatatggattttaattaaattatgacgcaataatgaattatttttgaaaaggaaaaaggaatttattgcgtcagcggctagggtttctcggtggaccgggcgcacgcgacggttcacgggaacggacggccgagatcgatcttatccaaaacggacggccgagatcgaccgatccacggccggaccacgagagacgacgacgatgacgtcagcggtgacgtcaccaccggcggcggctcgggagcacaagctcgccggcgaacgatggcgcggcggcgcgaacgaagggcaccaggacgtagagggcgacgcggcgaactcaccggcgaccaaaacggcggcggaagatcaacgaacggcgacggcgtcgaggaagaagcggcgtcgaccttcggttacagtaaataagtatttcaattagagtgtaatgctactgtaattccagttaaaatttacttatggaacaaactatctgatggcactttttcttataatatctgatggcactttttcttttctatttctttctatttcaattagatatgatttgttttggtttttacatatgtactacttttgaagtatttgataccctgttttttgctcgaaaaatctgaaatcatcttgaaattgagattaaactgcattagatcatgatttcatatgaattttacattgtttctttgtagttacatgtattttcaattgaaattgtagtgttcactctatatatttgtaatacaagttcactgtaactagtttcattatattctattttgagacattgaacaaatcaataatgatctattatctgaaatcttcattttgttatctgatgatgagagaannnnnnnnnnnnnnnnnnnnnnnnnnnnnnnnnnnnnnnnnnnnnnnnnnnnnnn

SEQ ID NO: 1226 - DNA, 410 bp, Oryza sativa
  unsure (1)..(410): unsure at all n locations
gttgagaccgaaatacatcttgccactgggtatgaagctgacaaaatttactgtttcgatgattattatgtaaaactacctatttatgttgttcggtttgtctgggaaaaccccagtatcttttcttcgttgaagatactagtaaaagatgaacgtggtacttgttgaaaccagacaaatttgtctattgccagatggaacagttgccctggcttctatgatcaacccctgcccctgggccctgggcccctggcacatttaggttttctcggccgttcacgtacatgtttccaaatccaaatcctgctgcatgttgcaacacaaatcctgtcgagacgcaaatttaaagcatannnnnnnnnnnnnnnnnnnnnnnnnnnnnnnnnnnnnnnnnnnnnnnnnnnnnnnnn

SEQ ID NO: 1227 - DNA, 1537 bp, Oryza sativa
  unsure (1)..(1537): unsure at all n locations
nnnnnnnnnnnnnnnnnnnnnnnnnnnnnnnnnnnnnnnnnnnnnnnnnnnnnnnnnacataggacctcaaacagtacaacaccaaaagaatagacatcagatttgtcagtaagctgctgcctgcggaagtactcaggatcaagataaccaaaactgcccttgacaactgtgctcacatgcgtatgatccattgttggaccagtcttggacaaaccaaaatctgaaaccttggctacccacttctcatcgaggaggatgtttgtcgtcttcacatcacggtggatgatggtgtgctttgcaccagtgtgtaggtagtgaagcccacgagctgcaccaatgcagatatccaagcgctgcctccaagaaagtggtgcattttgggtcttgtacaggtgctcacgaagagttccgtgagccatatagtcatagaccaggatcatctcattcttctcctcgcagtaaccaataagcgacacaagatgtcggtggcggagcttcgacaacatctcgatctctgtttggaactcatgcacaccctgctcagacaatgggtttccacgcttgatagccaccttggttgctcctccgtcaatctctccacggtaaactttaccaaaaccacccacgccaagaaggagggactcatcaaagttgtttgtcgcagccttgatctccacaaatgagaaatggcggcacaggttggatggcaaagacgaagcatggctcccagtagtgtgtgacttggctgagctggaagtgtgtgagttgccataaagtgagagcggcaaccaaccagaatgcccatcactcattcctgaatccttacctgctctctgccgacgcttgcagatcacaaagaagcagcaacatccaagtgcaagaactaccagacctccaatcactcctccaataattggaccaacacttgacttcttcccagaatttccacccgacgctgttggtacaatactagggacagggttgagcccagcaaggctcccattagtaagctgcaacttaaaaacctccatcccattgaggatagcattatagtactgtggcttgtttttgacatttggatgtagatccacccacaaatccataggccctgaacccatggggaacaccacaaaatccttgtacactggaatgccaagcccagtagaccacgcaatcacatcagcgccactaaaagcagtctggttgttgatgtagatgtcaaatgtccgttgattgatcttactgatcccagactgtatttcacagaaatggagcctcacgagatactgataaccagcatccacctgcattgcccaggtgagattgtattgcaaattcacattgttgtcaggccccatcgaccgcgccgtagagtagacatctgccggcgccacatactgcggaatactgtcagggtaatttatgggaacattggtgtcattcgcgtagctcaccccgaatgacgcaaagggtatgtatggcgtgtcatcttcccatgaccgatacccgcccgtgtccttggagggggagatcgcg

SEQ ID NO: 1228 - DNA, 10280 bp, Oryza sativa
  unsure (1)..(10280): unsure at all n locations
cattgacggagaattcgcggacgaggtagtcgaagttgaaggcgaaggcggtctggtaggcgctgaagttggagagaagcgtgatgttggggtcggggatggagacggagaaaagcgcgtcggcggcgttgcggttggagtagttcgccgggtagaagtggagcctgaggaacttgcgcccggcgccgaccgggaacgagtaggtgaagggcgccgcggagaagcgcgcggtgaggtacggcacctgcggcacagaagggtcctgcgcggtggcggccgcggcggcgaggttcgccggcaggtacttggagcccgtgttcccggtccagagccgcccgtccgtgtcgttggcctgccccgtcgcgccgcagtcgagcaggatgttgtcccgcggcacgaacggccccggcggcgacgccgccggggcgctcgagttgccccctcctcctccctgcccccgcgccgccggcgccagcgccaccagaagaagcacggccacaaacctagaactcaccatcatggcttcagcttcctctctctctctctctctccccctgccgcggctcacagatcgcccatccaccgatctggggcgattttcgcggcgtctctgacggaaacccccggctcgatcgctcttagcggcgcggcgtgaagaggagtgggaggctaagattcgtggggggtggagctcggtggggaggaagaggaaccgagagtggcagccgcggcggcggcggcggtggtggagggggagctcgcgtgaggaaaggggggggggggggtgtgatgtgaggcttcgggattacggccgcggcattaagtgggagaggccaccagcaacggcaacggcgacctactccgccctactgctcgtgctcgctcgcttaccgcgtcgtgctggagccgtctcgctaccgcgtgcccactggccggtgggtctggggacgccacgggcccacgtgagcagtggctcggggggtttgctaccgcggtgacggtggtgggtgtggactgtggacgacagctcgcaccgcgcggtgtgtgcaactagcagtggtgtgcgctcggctgcgggttttcctccagcttggaatttttgtaaagcttttcctcggcggcgcggtcgcgtacatgtgcgagggctattgagggctattgggggtgggggcctcgtgtcagtgagtgttgcccagccgcgcacggcgtacctaggacaaagcgttattcaatgcgggctggtaacgtggacagttccgtttattattgcgtggacagtggtgtcaagcgcgatagtctgtgacaggtggggccaatatcccgggcccacgagtcagtgggcgtggcgttagctgccgaatgcaaagctgtgagccagccgaatctagccaaccagcgaggagatgggctccaccagctccgctaaaatgttccgggatgggcgtaatcagggccgtccaaagcggccgatcgacgcggaggggaaggtagtggccgccgcgtgggtccgactaacatgcattgggaacgttaggaagcgtgacacgcaccgtcactaccttcccgtctctcgtatccgagttgggtcgcttttgacatccgtggaactcctagcccaaagggacgaaaatgacagatgagcgataggattaggagcacaactacacatgatctctaccagtaccctccgatccattactgttagctacacagaagaaattcttctctgcttttgtagtgttgccaaactgtacaggatgtagttgcgagcagaacgggaaccaaatttatcaaaatcacgtccttgtcatacagtagtaccaataaatccaatgctgacaactcagtgtcccctagctctagaattataataggcctgaaaatgggcaactgttatgtcctaagattgataatttaacatattcactcccacttcacctgggagctacaaatcatcagttacatggatgacaaaattttcgtagcagcatggtggagcaaaactggttagctacataaaaaagacgctactagttgaatccggcccagattataccaagttgttctgcatctccagcttgatatgccgaggcatcagacctcgtctgctgtcaatccgagcctcttttttctggaggcggcaacttgagctagtttgaagcaaccatatgctctggatgatgtgcctcaggagatttctgggactcattatgcctgcaggtctcttactattttcagttatctgcgggctcgcttcttttgcttatcttcctctcggtacctcacacgcctctcctctctctgccgcttcttcgttagaagttcagactttgctttctccgcctcatatgctttcttcttcttctcatcctgcaatttcttcttccttgcctggaaaaatcgggcaaataatgagcacacattatatcagcgattgacatcagaacaagctgctgtagcatgaccaataccttctcatgttttagcagccttaactgttgaatggctgcatgtgtcttcttctcactgggctgcataaggacagggaccctgttctccactggtgtttttctatgcttgggcgtatccttcggtttagatttaaaaggaagtagatgctgcagttttgcagggatctctataggattaaacttccgcactttccgctcaatgggctgccatttggagataacatgatatgagcatgatattaagaaaaataaacacaaaagatttcgacgctcagagaaccttataaactgaatctgtgttgtgcggtataggaatattatgtgccctccgcagctcagcagtagttctcatgccttgccaagtctcatcttggggttgaagagcagttgtcacaaggttacagtaggtgggaacttcaacattgacccatgcacgcatgaagacaatgtcactcataagaattctgtcttcaaatgtgcaccttgcaatcccgtctatactttccccttttctccttggcatatctcctggttcaatctttgctgcctgtaataaaaggaagatttgttttaatgcgcacacttgaattacccaaaatttatcgatacatacgcttcagagtttatgatccatatcgagctttcgttttccttgacctaacacccaaaataattacttgagcacacattgactaaataaaatccattctgctaacatgcatatactgcaaagaggggggggtgctttcatggcaaaatggcaactgtatattttattattatcaataatctgtttacagattcaaatcaattatcaactcatagctctcatggagtccttttgttacttattttcagaattataccgtacatattgtactcaaggtgtgtttagttcgcggaaagaaaatttttgggtatcacatcggacgtttgaccggatgtcgaaaggggctttcggacacgaatgaaaaaactaatttcataattcgcctagaaactgcgagacgaatttattaagcctaattaatccgtcattagcacatatggattactgtagcacttatggctaatcatggactaattaggctcaaaagatttgtctcgcgatttccatgcaaactgtgcaattagtttttttatctatatttaatgctccatgtatgtgtccaaagattcgatgtgatgtttttgggcaaaattttttgggaactaaacaaggcctcaatagaaggccaaagaagtgaacctgagaaataatacttaatttcatatggttgggacttattgttgatgtacaagcattgattcattgttggcatgcattgttaaagaaaaagagcataggatctcatgtattacctttttaacttgccctcggattccacttactgtccgaatagttgcaccctcaaacctagcaacctctaagtcagatgtgaacatgcctttgactagggcagttttcttaaatatcttgcacggtacacctgtgagcttgattttcttcatgattcgggcagtattgttgaattcttgaacaaagcctgttgcagtaattctaaatggtacctgatgtgcaaggattgggaaagagaatgtcagcgcaaacactttaatagagtaaatgtgaatgctacaaggtaaatggaagaataaggttaatatccattctagggaggttctgcatctagatgaatctaagcaagtcctaaaagatgctagtctgacagcgccatcaattatgatgtttgctcagaagcagcagcactgaaaatatatggacaaatgaatataaattattgaacccacctgactgttggagagatgctggactgccagtacaccactttttggtggagcaagcggtccccaaaacatagcaaagcaatgcatatgctcaggtgtatatttgagcatgcggtgccgaccatttcgatcctctattgcatatacaggagttgtttggaaacgcctccaaccaatagagacaataattgggtcttttgtcttcagtactttcctgtgccacctgtgtcgtttcaggctagcctgtatgaagtgtgaaaaaaggtaaatgcaatccactggcaacataatatccacttgaattatcataacgttcaaagaaacactgttatacttggtatattttatcaatatgttacacataaactgttttattctgggtccaccaaataagtggtctagagattgttttttaaattttccttccaattcacatgggaatatctagcttagaagcaacaaggtactccctccggtttcattttaattgacgtttcggacaatgacacggtctacaagatatatctttgaccttatttttctactataatatatataataaataaatgcatgtttacttttattatagtgctttaaaagaaaaatctatatatgtcgttctagttcttttaaactaaatatttttaaagtttgatggtcaaagttaaaaaagtttgaccttaaccttgtccaaaacgtcaattaatatggaaccggagggagtgcccaagaacattatttcatagttaaattacatattgacagctagaagtaaggatgtactcctatatgatgcatcattttaaaatcccagaatgtcataaccacttaaactatcaagcaaaaattgtctgatctaacactgaatggcgatgcatgtatgttgcactgctgcatccattatttcctacaattactgaacactgaactttttcatacagcaaataggagaggaaaattaaaatagctgacctgcatatatccagtattctcctcaccaaggccaatgcctccaacgagaatgggatggcaaggatcaaaatattcaactagctcaaacggcacaccatgtacctctaatctgatgtaagaaccagtcctaaacccttcaatttctaccctggtatcttcatctaaatcattgagttcggaaatattcatttgcttgcgaatttcaatttcctcctttaactgaaaaggtacaaaatgtgatggttcaataaccaggtaatacaagagttccaacaaaacaaaagcaaaagattctatgacataccttatcgaaatagccccctccattagtttcttctcgtttcgatttctttgtgtcattatcaacttcctcaccggagagatcagatccatcatatgtaggtttaagttaaggaatcagaaagtaagtgcacgcagtgaagtacgctcaaaaaagcaaatgagaacttagactagataacctggaaaagaaaacaggccacggagacaaaaaaaaccaagtctaaggggcagcaaaagaagaattaaacatgcagtgcagagtggaccataaaagcaattccccttttaaatgatagcaaattatttgacaacaaacaaaagaaaaaaaacattcaaaaatgtaagaaaggatattctgcatcaaattttgccttaagtgcgagcttcttgagtcttctttcttccatagcaaggtcatcttgcttgtgagtacctccatttcctgaagtattttcatatgccttgcttgtatgcacctcaccagtctccagatcttcaaaatctccatcgacttcttcgtcatccacatcgttttcatttatttcctgtcctcttagagctgcttttgaccaatttccagtcacgaaacggtcacgaatgctcttgatgagatcttcgtcagaccaatctcttagctcagttttaaaaaacttggagtaatcctcagcatccatatcatcaaagcttgttgattcattctttgcttgctggaaggatagaaagcagtcctttattatttcagataaaaaaaactaggagggctctgtggtcttattaactaccaagcagtctacccacctttgtaaaaaaaagttaaaaggcagattattacttccttcgtttcatattataagactttctagcattgcccacattcatatatatgttaatgaatctagacatatatatgtgcctagattcattaacatctatgtgaatgtgggcaacgctagaaagtcttataacctgaaatggaggtagtacaagaaagaacaaagatgatctgaaacctaacaatgcacctagctaatttcagttcctttgaccatagataagggaatatacaatgttagcctatacagcaaaggaagggtaaaatcatatcctgtcctgtatgtatcttaactataaatgccatgagtagtgtgtattgcagtcaaagtgcaggataacttctccttcaattctgtattagcacatcattaccttcttttgtccttttggtacaaaaaattcttcatctgaactctcttctgcactactgtcatttccttcatccagcttctttgaagcttggccatatacaagttgcattagattggcactccgtctggacagtgttctagcaagcaaggactctttccactttgaattgttctcagtttcatcatctagaataccaaaagaaaagagttttagatttgaaaaacacaaatgctcttcagttgcagagctaactacttcagcaaataaaatagcaacatgattttatgtgcaggtcgagtggatcacaggtgatgggtacagatataggtggtgcctatgggatcccatgtatatgctaaattaacagtagcaagactctatttgctccccatcaacgaaaagatgttacaccaagtgagtaagtgcgtgcgtgtgtgcaaagtagtacctgaatcaagtgattcttcactgtcatctgcggaaccttcagataactggtcatcaccagaattttcactgtcaacgtcatcttcttccgcaccctacaaggtagaccaaggttgaaatacctttaaaagcttgaaattgaaaatctgtagacatgtaaaagaattaaaagcaaagtaccacatcatggttcatggttcatcgcaatgaggtaatttggaagtataccaggcgaatagaagctgtgctagaagtcaagggttacaataaaacgtgttcttctaactattccaaatatgtatctgtaagtaatattagtgagttgtactagaaatcaaagtacacattgcaaatatttatgttaatacggtgctaaaacaaactagatattgtaagtaaatatttagtgttaaatattaacgtaaatatttaacattaatatttatgtatgataagtattcaaaaaatatcattgttctacacttcaaatgatgttgagacatgaactacaactggtgacttaggaatggccaatagctgtgctaacataatgttattcagctgcatagtgttttatgtcaaatttcttggtctggagtagtgatgcaaagccatgtgtttcctggatggattacatcgggcaaaacaaaactaaacagggaacttaagagtaagagagcaagaaaaaaaaaagaatgtgagagcaagagaactattaattaataagaacaaaggaaaatggtaaaaacctcatcatcgtcatcatctttaaaattagctgatacagcttttctcctcatccttccattgcaaaattccacctcttctctcaagccaacttcatggtcattttgctgagttgcttcatcattatcatgttcactatcgctggagcactcagaataagaatgatcattgctctccaatgtgtttgcgttgcatatgttattaccatctgcttcttccaaaatattagcatctccctgatcattctggttgccagagatgtcttcggactgagcagcaggctttctaccaaataaatttataaaactctgatccaacttttcattaagggaatatctggggttctgaagtgtttttactagggttacaccaacatcctgtcctttccctgtatgatgataagtcagtaatctagcaaacaacaaaggatggccatacataaagaagacaaaaaaaaagctagagcaggattctagccaacaaaactaaaattacttccattcaagcacaagcgtgcatctattgtaggaagttcttctatgatagatctgatacatattcctacttgtgttttgatggcaagctaaaattgcatgataaatgtgaatatatgaaaccggacagatactataaaggtaaatagacaaataatctgttaaagatctaactcttagattttcttttatttgctaaaatctcttccaggcacaaggaacaggtgtaacagtaacagtgtgtgccttgctttgcaatccaagctcagaaaacactgaaaaactttcaacgccaaaacattctttcaggttgcacaccactctaccaaagaaataaatagacaagaaaacataagtaaagtgagttttcaacttgatgggtcttgtctattaaagtatgtttgtgcattgcacagtcctcaggaccttatcgtcctaaacaacatacttcaagaaacttcaaatgcaaagaggatgaaggaatgaggtgcctagtatcattatgaatggtttatactttaaacataccttgctttttagatgcatcattctcaccagtctttgagaactgaacaagatgaggattgatgtttatataaactgcatctgtgtcatacagtagatcaccaaggccagacattggcgcgtagaacagcttttccttgtcacgtagtcctctcttctttgcagctgatggcaatgggcaaggatctgccaaacttgttaccccagacaagctaaaatcacctgcccctgtgatatgtacctgcacagataattgtgtgttttactatccaaaagtttagggcactatagtcagacatgaaagaacttagaatttctcctcacagaaaggaaaagtaattagcttcagttttgccaaccagactgaagcataattaatgtagatagtgccacacattctgttagctaatttttcaaaattaaaaaatttttgaagattcatcaggttcattggcagtaaattcatgcttcctgtaaaataagatgtcattatcttcaccctcaattttgtcatatttactaaggctgttcaaataagatcaactagggacccaaaatcatgtactaacattaagtaaagtaacaagttaaataacatctatctgctacaaagtagaatctgggttagtttaacattaagttccagagatgatgaagaacacctttgtccctcttttcatgttacagccacgaaggtagccatacaatgttattttcctgtcacactttctgttcaagcgcacactttctggaggagttacatcttcaaatctatcgactagcagataaggatgtgccatcctccaactcagtgggataggcttgataacagagatgaaccttgcaagattatggacttctcttttcgtgtacctgcatgagacaaaaaatgaaacttctacactaaatgaccaaatagtagaaatgaaaagaacataaaaacaagcattctcacttataactgcagcatgaagaaagataatgtatagtaactccctgctaatatggtgagcttaaatcagcatagatttgtttactgataagtatcgattgatagttcagctataaccactcctccgtccatgatataagggattctaggttattttggagagattttaaggatgaagggaaaagactgtgatgctctttattaaatgagaggtggttggaagtaagattgggtgaaaattacatgagggatggttgaatgggcaagtagtactctacaatccattatatttgtgtnnnnnnnnnnnnnnnnnnnnnnnnnnnnnnnnnnnnnnnnnnnnnnnnnnnnnnnnnn

SEQ ID NO: 1229 - DNA, 1400 bp, Oryza sativa
  unsure (1)..(1400): unsure at all n locations
caacttactttccatgaatgagaccagacaagtagaaaagttttgctccctcctttatctcagcccaaaatcgatgcttcaggcgctgcttggttttcctaagcttttttacatctttaaacttatcaagatgtgtaaggactcccatcaccttggggaatccgtgcacttgcataatatttaggaactcaaatgtatcctggaaacaagcagttatttaggtgccagtagtacaataaagcataaatggaattaatcacgcggatagaaagcagtgaatagatcagcataataaatacagtatgtcagctccatcactagtaggagtggtaggcagtaatggacagcactttaattgctagtaatggaactttagttaaatgtataagatgaaacttttatcggggatgtgctcctaagggcgaaaaaacatatttcagactacatcctaagctagaaatatttgtgaaaatataggcttcaacagcacaccatttcaaatccatagcttccatcaataagcagcagagcaagatcagctattttagcagcatcaatcattccgttgatatcatttggacactccaagaactgtacgcgcctgcttttacctgcacatgatgaaaaaattgcatacattagtttcatatcttcacaataattcaattgttcagaagaacaatatagattgtcctcaagtacaaggttcagagggttcattaacctgacacaacagtgattggaccacggacttcagacaaattttgtttcgtgtagtgctttactagacattttatcagcagcgacttcccaacctgataaataatgtaatgatcagaaaacaatccacatacatcatcttctccaggtggcagagcatacctgaggaggcccttgaactacaacaacaaaaggtggtggttcaccaattgagcgatccataattggcacatgaagacgacgttgttcaatctcagccgatcgtgcttgtagacgcttggcctttgcagctgactgaaaggcaaaagcctgggacaaggaatggtaacctattaaaataaatactccaaaactagagaaggaaaaggttaaacagatagacaaaccattcttgagttgttgagttcgtttgcacagtgtaaagaaccatttagttacagagatctaaccgtgtcctttttaaggaggatatttaccatttttctttaaaaagcatggatcatagccagtgaccacatgacctccaaccaaactcataaaattccatatatagacggcagaaaatatcaccaaagcataaataaataaatgcatctattgcaatagcttgctaataatacgagnnnnnnnnnnnnnnnnnnnnnnnnnnnnnnnnnnnnnnnnnnnnnnnnnnnnnnngc

SEQ ID NO: 1230 - DNA, 1688 bp, Oryza sativa
  unsure (1)..(1688): unsure at all n locations
agactactgatatcaagtggtatttctccccaggcagatccactgaagtgtatagcgtctaccaaattggacacaggtgacaaaaaggaatgttctgcataacatttacctttttagtcacgggggcttcagtaagagcagactttgcttcaaagactcctaatcttgatgccagttcatcaaaaccttttaccaacctctggctttcctcaacagtattgtttgaagcttcctccagcaccttcacctgccagactttgttattaaatagtaatatcagatgatataagcagaactatgtctaatgctgcaaatgaaaaccaaagcaccaaagctttaaatccgacatattcaaaatcgtcacgaataaatcatgacttttaactttacatatgattgaacacctttctggagaggacaaatatttggccacatgttgcagattacataatacacaacaacctatcaatcttagtatttaactaatcatttgcttgcttgaatcttaacgggatatcaaacattaactacaaagaaaaaaaaacacaaatagttggatttgtagttcatacctgtacaagcagtactttatttgtctcctccagtccacttaatctctctttaagagacgtctgaagaaaaggagcaacatgtcagccaaaaacagataggaagggctttggatgcatttgctgcaaatactaaataaaaattgtaacagaacaagtgattcatgcattacctcctgatgagttaaggcatcattgatgacctctatggacctgactttgttatccaaagctacctgaatgaagtcagagaacaaaatttacaggatgaagccacgaatagataacaacaaaaggagcacagcggtgtttaacagttataacaagatttaagcctgacgtacttccagttcccacatgaggggctaagacacttcaaatatcagggggaagttaatgtaacaacaaaaagaaaaatacagacactttgggttctatagtatcaagtgaaatgaaagaggtgcttactatcagaaatgtttgtttctgaccacactttggcaaaagaagtgtggaagccacatctttttttcacaattattagttacccacccttgtggcaagtttggaagtgtgacaggacacaactgtggccatgaatgaaatgccagacatacttggtgagacttagctgtgaagtatcatagtgaagacgacataatttgttgttcatagaggcataaaaacacaaattggaactaaaattaatctgcaaaattcagaactcctgcatataggcaggactggtatgtctacccacacgagcaaagaaatcattagaataaataaatatatacctccttcttaatcagcacatcatacccattctgtaaattattgagcttttcctccaaacggacctagagattggatcacaagacaacattttagctagatttttaattcatatcacctgtccattcactttgtgacatggcagaaaatcttgggtatgaagagtaaggtagtttttctagctatattggttgaatgaattgcatgtggttgcatccaggattccagggcataaacatacctcattctgtgcatgataatccactttgtnnnnnnnnnnnnnnnnnnnnnnnnnnnnnnnnnnnnnnnnnnnnnnnnnnnnnn

SEQ ID NO: 1231 - DNA, 737 bp, Oryza sativa
  unsure (1)..(737): unsure at all n locations
nnnnnnnnnnnnnnnnnnnnnnnnnnnnnnnnnnnnnnacatcagtcatcatacaaaatctgtgctccgattgatgtggaagccaaaagaacacgatagttcaaacttacatctctagtgtatcaagaatgtactcaatgatttgtactgctgaacttttgcttgacaaattatctgaaagacgaagcggcagaattcagatatgctgctttctctctctcttacagaaattcagatttgcacaagcaacaccacatcgagacaacaaaaagaaacaaatattcttactgatatcggttgttgcacacagtgcttggctagaagaagcttctccctgcaaatgctgaaagaacatacagatcaagatgagatgagaacggcaaggttgatgagagttcatcagggtacctaatgactacctagacagacaattacctggatttcttcattcctttttctcttccctcgaacaccagcaatgctgtttcggattatctgccaaggatctaggagacaaccagtggcagtagtgtcatcgttcttctgctcttcaagcttcagtaatctagcacttcgcctctttccttttccagacatctcttcacctcttcttctaagggggccacaatggcaatagtaccacacaacagtagagtttatgttccatgatatacaatataaaggaaaagatgtacctcttcagctggtagcccatctatgcctattattttaatgca

SEQ ID NO: 1232 - DNA, 737 bp, Oryza sativa
taaagcctagcaaagcgcccatcagaaaccctagcaggagcgccgccgccgccgccgccgcccgccgtcgtcatcctccctctcgccctgtaagggtttgtcgcctcctcctcctccggtcgattcccccgacccgatctgatcgctgctcgtgtcccttgcagttcaggtccccagcccgccgcgccgcggatcgagtcgccgtgtgaagaaggccagcgtcaccatggcggacgaggagcaggtggagaggaaggaggaggtctccgaggtgaaaagcctgcccttctcgtttttttttctttttttcatttgccctgcacatcggattcagttcggtttttcggcggggaagggaagaaacggcgtagcgatgggctgggtgcggtgccgtgctgtgctgtctgtgtttggtgtatgcgtgatctggtagggtgttttgggcgtgaattcgcgaccatgggcctcttcaggatgtttgatctgtgtgcttggattgaatcagtgaaatctgtaagagcggattaagcttctgagatgagtgggcttcaaaaataataaaaaaaacatctgagatgagtgatatgccagataaagcaatgatttgttttggtcatctttttgtagagcttgtgaggactgaaccagttagcagtgaacacctatggtgatatttgatggtgtttggacttgtgtctgaatatactgtcagtgcctagcctggtcattatcagtgt

SEQ ID NO: 1233 - DNA, 741 bp, Oryza sativa
gctcggtacccatgcgtgagggttcttcttctacaccaaattggcgctagaacctccctcgatctttttgcccaagttatcctttgccctcgccttctcctcaacacccaaagagccaatgagatcagtaagaccgaactcttgcctcttgtgttttagagaagtagcaaagtctgaccaagaaggtggcaatttggcaataatgccacccgccataaacttgtccggcaactcacaattgttgttctcaagttcctttgccaacatttgaatctcatgagcctgtctccacaacagaacggtcatcgaccatcttgtagtcatagaattgctccatgacatacagctcgctgcggcgtcggaaactccgaacttggcctcaagtgcatcccacatgtccttccccgaaagcatgtgcatgtacacatccactatattgtcagtgagtacactgatcaatgctccacggaacaagcaatccgaagcctctaacttagccttctcctcaggagagagaggcggttcactcggtttgccccgtgagacaaagaaacaatgcatcgttgtcaaccacaaaagtgtacatggtttccatcttttataatttgaaccatcgaaagcatgtggttttagtgatgcaacaaagcccactaccgaaaaagacctagactgccaaataaaaacaaaaatagctataaaattaagttttaaaaattaaattcgactgactgataagatgac

SEQ ID NO: 1234 - DNA, 626 bp, Oryza sativa
  unsure (1)..(626): unsure at all n locations
actatagggcgaattcgagctcggtaccctgtagcatgaccaataccttctcatgttttagcagccttaactgttgaatggctgcatgtgtcttcttctcactgggctgcataaggacagggaccctgttctccactggtgtttttctatgcttgggcgtatccttcggtttagatttaaaaggaagtagatgctgcagttttgcagggatctctataggattaaacttccgcactttccgctcaatgggctgccatttggagataacatgatatgagcatgatattaagaaaaataaacacaaaagatttcgacgctcagagaaccttataaactgaatctgtgttgtgcggtataggaatattatgtgccctccgcagctcagcagtagttctcatgccttgccaagtctcatcttggggttgaagagcagttgtcacaaggttacagtaggtgggaacttcaacattgacccatgcacgcatgaagacaatgtcactcataagaattctgtcttcaaatgtgcaccttgcaatcccgtctatactttccccttttnnnnnnnnnnnnnnnnnnnnnnnnnnnnnnnnnnnnnnnnnnnnnnnnnnnnnnnnnnnnnnnnnnnn

SEQ ID NO: 1235 - DNA, 651 bp, Oryza sativa
ccaagttttacaggcatgaaaaagaagaagaagattcatgtgagtttagttggttacaaattacaaatgcctgttgcaatgtttgttggattaatatttccttctgtactattctatttactaattttgcaaatttcaggtggagcatgatacatctcttactgaagctggagatggtgaagatgctataggtaattgtggcttgctcatatttgccctggttgcgttgttttgctttgtctgatcatatattgttcagatgatcaaatcggagaggatgaagaaggagaagggattgtgcttggaggtgcaactcgatacccttgggaaggaactgacagagattataaatatgaagaggttaatactccttgcctgttcaaatttttgtgattctatatccttgtcatgttcttgacagatcatgacttgtaaattccatataagatatacatatcaaaatagaaagctgtggagttttcatattatgtcacctgcaattatatttttaagttaaactcccttcggttccataattcttgacgttttcgacaaagttgaggtcaaacttttataactttaactatcaataactttggaatattagtttaaaggtctagacaacatatagatttgtcttacaaatactat

SEQ ID NO: 1236 - DNA, 682 bp, Oryza sativa
taggagttggttcgtttaggtggcgattaaatgtagctcgtggcgatcctgtttttcgttcatgcggatatactgcgcggttccaacttgttccagaagatatacatcttgcttatcacgatgaagtctcattttctcggttttctattggagaaattggaacaatattaatttgagcatctgatgcaagccatacagattggatattgtaaactgtgtttaaatctgtgctaacagcgttgctctgtattaatacagtgttatagtccagtgcaattagcttaaaatgtagaatttagatagcattgagtgcccgtgctcgtattattagcaagctattgcaatagatgcatttatttatttatgctttggtgatattttctgccgtctatatatggaattttatgagtttggttggaggtcatgtggtcactggctatgatccatgctttttaaagaaaaatggtaaatatcctccttaaaaaggacacggttagatctctgtaactaaatggttctttacactgtgcaaacgaactcaacaactcaagaatgggttgtctatctggttaaccttttccttctctagtttttgagtatttattttaataggttaccattcctttgcccaggcttttgcctttcagtcagctgcaaaggccaagcgtctaccagcacgatc

SEQ ID NO: 1237 - DNA, 442 bp, Oryza sativa
  unsure (1)..(442): unsure at all n locations
nnnnnnnnnnnnnnnnnnnnnnnnnnnnnnnnnnnnnnnnnnnnnnnnnnnnnnnttcgagcaccagcgccaaatggcaagtaggaatgtagctggggttgtgcattggagaagcgctctgggttgaattctttcacatctggaccccacaggttgggatcaaggtgcattgtggaaacagggatgtagatgttgacaccttttggtatatgtacacccccaaacttcagttcctgaagggcctgccttgatacaaaggcgccagctgggtacaaacgcaaagtctcctggatcaccattgtcaactacaagcagagaggacctggaagttagtgagctattgtaacaaatgtacaatttactgcaaagtgcactaatggactgctcataagtaagtcttgtttggtttgcaagattaaaaaatgcatttcttttattgact

SEQ ID NO: 1238 - DNA, 559 bp, Oryza sativa
  unsure (1)..(559): unsure at all n locations
gagctcggtacccacctgatcagtgcatcctttcacattgtccagggatcctccatagaccttaatccctggcactgactgcgccatcttttcattgccaccagcatgatccctacaaccacaaccacggattagttgggcttttcaattaccacttctctacatcgttgctaatgaattcagcaaaatctggcaaataatattctatgcatagaatgcacctgagagtaatcctaaaaaaaatcaatccttttaatgtatttgtgtttattttatcatatggtgcaaagcacttcctcagccgcatgctcagacaccgtatttctcaatttattataaaatcctaatgcaataaatcccaatctgcaactaactaaaatcactcactttctggtggtaggtgattggtccctgagggtgggattggggaaaattttggcacagcactgattgcatcccataggaaactctggaaggccaacatttgggcggaatttttccataannnnnnnnnnnnnnnnnnnnnnnnnnnnnnnnnnnnnnnnnnnnnnnnnnnnnn

SEQ ID NO: 1239 - DNA, 352 bp, Oryza sativa
gtcgggcaatgtcacggaggaggtagccggcggcggagttgggtccacgtggcgcacacctggagcgctggcggtgcaacttgcacacgcaccggaggaggggtaaggtagtacctaatcctaaagctataataagcaggtcgcgtcgcgtgcatatatccgggccgtcctcctcgctccttgccaaattccatggcgtaatcatgcccttttttctcttgcgtttgtggtggtgactctgcacgtacgccatgggggggccgggcctgcaggacttccctataaaatgcacacacacgcaagttgttgctcggggcatcatcgatcgtacaatatcctgtcccggtccggc

SEQ ID NO: 1240 - DNA, 529 bp, Oryza sativa
taaataagacaatgaaaaattccgtaaattcccaaataccaatcagtagataaagtcagagaaggtgaaaaaaaatatgtattaaaggatccttacatgtccatcagcatccaacaagatgttctcaggcttcagatctctgtgcataattccattggcatggagatgggctacagcaaacaccatttcagcagtgtaaatgcgtgcaagctcctccctgacaaacaaaaggttgcttaattaaatgttcatgcaaagcgataggaataaacataaaataatgtaatgaaataacctaaccaaaccctgttggtaaagctgaaaaaaaagatggccccatttatgaagtccacacaaggtaaagtcggtattttgtctgccaagtaaatactgggtttaaaatttgggacaagactgaaaaatataacatgcatgatagcttgccaacaaagaacccccagagatgataaatgcttccctgaaaggagtacctcagctgtacaacaaaaggatgatcaactttagtcag

SEQ ID NO: 1241 - DNA, 641 bp, Oryza sativa
aatgtcaaaaattatggaatcggagggagtagtaatggtggaaggttcattgtctattgaggagaagcattgctcccttttaagtatttttttttattttgatcttcttatgtttttgttgctattgatatggtattagtatctcatgtagtgctcagctcagcttcaactagtattcaattgtgtttctgttaatgaaccctttcaatctatttggtgacagctgcttggcagagtatttaatatcctgcgtgagaataatcctgatcttgctggtgatagacgaagaactgttatgaggcctcctcaagttcttagggaaggcacaaagaagacagtttttgtgaacttcatggatttgtgcaaaacgtatgatctcacttttttaccactccataccatatgctctaggcctgcttttatttcagagaagataaattaccatgagctaactgaaatcatcgtttacacttccagaatgcataggcaacctgaacatgtgatgatgtttttacttgctgagatgggaacaagtggatcccttgatgggcaacaaagattggttataaaagaaagatttgctcctaaaaactttgaagccatacttaggagatatatcagtaagtttccttaatgtcaca

SEQ ID NO: 1242 - DNA, 576 bp, Oryza sativa
ggctttcggacacgaatgaaaaaactaatttcataattcgcctagaaactgcgagacgaatttattaagcctaattaatccgtcattagcacatatggattactgtagcacttatggctaatcatggactaattaggctcaaaagatttgtctcgcgatttccatgcaaactgtgcaattagtttttttatctatatttaatgctccatgtatgtgtccaaagattcgatgtgatgtttttgggcaaaattttttgggaactaaacaaggcctcaatagaaggccaaagaagtgaacctgagaaataatacttaatttcatatggttgggacttattgttgatgtacaagcattgattcattgttggcatgcattgttaaagaaaaagagcataggatctcatgtattacctttttaacttgccctcggattccacttactgtccgaatagttgcaccctcaaacctagcaacctctaagtcagatgtgaacatgcctttgactagggcagttttcttaaatatcttgcacggtacacctgtgagcttgattttcttcatgattcgggcagtattg

SEQ ID NO: 1243 - DNA, 1384 bp, Oryza sativa
  unsure (1)..(1384): unsure at all n locations
aaaaactagacaaattttacacaaaaaatattatcttaaaaaataaaaattaaacttggtgaatatacattgtgatttccgttaccacacactaatagcaaatccctgttgccgaacgtaaaccgacgataatgcaaaccctggacacactatgccaattattgatccgatcgaatgggtgaaagcaaacaccccatgcatctttaccccttttgcacccatgcattgcttgtgaaaaactagtgactacaggcgaccaaagccccatcctgccatccgtatccaatgatcgatgtgactaatttttacacccgaaaaggcgaaaatataatgagcagctaggttgtcgcacgtctttgccgggataagatcggttagttgagagctgcacttcagctagctctcccctgatctgttcattcatcacagaggcgagatggatattcaccaacaaagctaaaacataagggatccgatcaacataatggatagacattgcactttggaggcattgtattattacacccnctagctaacataacatactacctctttntcaaattataagactttctagcattgcccgcattcatatagatattaatgaatctatgtatatgtatatgtctagattcattacatatatatgaatttaagcaatgctaaaaaatcttataatataaaacggaggaagtagcctacatacatgtacaacatgtgtgagtgcaacttccctccttttttttcagtatctttttttttttgcgccaaagtcaccatttggactctagctctcgcaaccccggcccctctccccccccggccggacaccgtctatacatacacgcacaacactgacgaccagctgaaacacgcgcgcgcgcgcccacacacacactcacattttttttgcacacacacaaacacaaacactaggaggagaagcttagttaattaacgtcgtaaagagagtcgtagtgagtgagagagagatggaggtgggcatggtggtggtggtggcggcaaaagtgttggtgagcctgtggtgcgtgggggcgtgctgcctcacggcgtacctgtaccgcgtcgtgtgggtggcgccccggcgggtgctcgccgagttcaggaggcagggcatcggggggccgcgccctttctttccctacgggaacctcgccgacatgcgggaggccgtcgcggccgccaggcattagctggcggaggcgcgacgccgacggcgagcacgcgacagcggcgatggcggcagcggcgccggcattgtgcacgactaccgccccggcgtgctgcccttctacgagaagtggagaaaagactacggtacgtacgtgctctctcgatcgcctcatcagctgctcgatcgaac

SEQ ID NO: 1244 - DNA, 678 bp, Oryza sativa
ggagacaagcctgccaagggtatttggaggaattgcaccaatcaggcaagcagctggtaccctaagggcatatatgcgtgatcggtccggcgagcaagttacaccatgccatgagcacaaagaaatgtttacatcccaattgagtttgttcccacggtagactgcagaagcaaaagcaaggagcgcttgcttctcagaagcgatgtctgccacggccaatgaggtgaaaagaagtaacgacagtagacccaaagaaccttcaaaaattttatagcccataagaggtgtctctgaatcaactggactaaatgaacaatatcagcatctgtttatatcagtaactaccagtcctgctgcaatgaaaatggaaaacgtcagtgctaaaatcatgaaaagtaacagtagaactgtaaacataactctaattgtgtcttttaactcataaaccctcaagagaatatagcatacgagcaatcacgacagatgtgtgtgtgctgagtccaaaagaaagcacattccatgatcttcaaatgcagctatgcacttatgcagacaagcatgcctgtgtagtggaagcataaagctggcagtttgccccactagaggctcatgccaagaaaaagaccaaagcactttcaaaagaaaaaatgacccatcaaagcctaatgatttaagaaa

SEQ ID NO: 1245 - DNA, 506 bp, Oryza sativa
gggactgcccctttctatgcccaaattcctcatgatcgtcacgaagagaagtgccgagtcaaagtcaccttgaacagtaatagtgaagatattccctcagtgatgttcgaagccggaggaagaaactacatccatacatgtcaggaggtggcaaggatcgccataggagagctccttgatcgctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactgtgttagcagcccaagatcgtgaagaccggaatcgtggtaagatttgcaagcttgaggacaaagtggatcgtttggagaaggaactagccgcattgaagggagaagcaccaccgcagaaggccaggattcgtcttaccgcaaggaagagagctctatttgt

SEQ ID NO: 1246 - DNA, 694 bp, Oryza sativa
cttaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctgccaaggtattgtattattgcccctccatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcag

SEQ ID NO: 1247 - DNA, 571 bp, Oryza sativa
  unsure (1)..(571): unsure at all n locations
nnnnnnnnnnnnnnnnnnnnnnnnnnnnnnnnnnnnnnnnnnnnnnnnnnnnnnnnntttgtgggaacacggtatgtgataatggcaggagagccctgaaacttgccctgcactttggtctccaagatgaagttgtgggaagcagtagcaccactgaaagcacaagaggtaaaaaggattgtcaaagggcaaatattggtgtgagaaagcataagtaactagtaagtgttgttactaacggatcaagtttttccacaatctttgatgtggttccagagataagttgaaaagcctcctgtggccaagagtcgtcgttcaagctaacatcataggcggtcctgtaaaaaatgagagagagagagagagagagtagtaaacaacatgatagaagaatagaagatgaatggttgatggcactggcagtgaagaatatagggcctgtttagatcccaccctaaaattttacaccctatcacatcgaacgtttgaacacctgtatgaagtattaaatataggctaaaaaaataaccaattgcacagattgcgactactttgcgagacgaaatctttt

SEQ ID NO: 1248 - DNA, 562 bp, Oryza sativa
tgggtgcaggttcaggctcgtttgaccctctactgctcgccgccgtcctcggactttgccggctggtggctcgctgcccggcaaactgttgcgaagatcgatcgcaagacgtttgacgccggggtcatcctcgttacatggttgatttggaaagagcgcaacgcacgggttttcgagggaacggcctcgtcggtcacgcagttgtgtgcgaccatgtgtgatgaatgggaaacttggaaatcagcagggctagttacctcgttgaatgttgctgcagtgccagctttagaaagattacagattttgtaatttgctttttgttgtaaaggcggtgctctgacgtactgcatttgtacagtttttccccttttccttaatatacatcggtcagcattcttcgccgtcccggcgaaaaaaaagattgaagattaattgtcccagaaacaattgaacacagctttattaatcattccttccaaatgcatcaatctgtttttgacttattaaaatcattatacaaatatatatatatatatatatatatatatatatatatatatat

SEQ ID NO: 1249 - DNA, 581 bp, Oryza sativa
  unsure (1)..(581): unsure at all n locations
nnnnnnnnnnnnnnnnnnnnnnnnnnnnnnnnnnnnnnnnnnnnnnnnnnnnnnnnnnnctcgttgaatgttgctgcagtgccagctttagaaagattacagattttgtaatttgctttttgttgtaaaggcggtgctctgacgtactgcatttgtacagtttttccccttttccttaatatacatcggtcagcattcttcgccgtcccggcgaaaaaaaagattgaagattaattgtcccagaaacaattgaacacagctttattaatcattccttccaaatgcatcaatctgtttttgacttattaaaatcattatacaaatatatatatatatatatatatatatatatatatatatatatatatatatatttatttatttattttgcttgcattgctgatgtataatttcaccacatagctagtaattaagtaatgggagcttaattgcagggagtagggagcggcggtccgcagaggcacttgttgtggaagaaggagtactgatcgaacctcgcggcgccggcgggcagatcggcgcagaggcgggtgtagctgacgttgaagtcctgcaggctg

SEQ ID NO: 1250 - DNA, 11289 bp, Oryza sativa
  unsure (1)..(11289): unsure at all n locations
atagtatatatatatatatatatatatatatatatatatttatttatttattttgcttgcattgctgatgtataatttcaccacatagctagtaattaagtaatgggagcttaattgcagggagtagggagcggcggtccgcagaggcacttgttgtggaagaaggagtactgatcgaacctcgcggcgccggcgggcagctcgccgcagaggcggttgtagctgacgttgaagtcctgcaggctgctcagcccggccacctgcgccggcacgccgccgtacagcatgttgtggctgaggtccagcgagctcaccccttcctgcagccgcagcccggtcatgtcgaagctcagcgcgttgcgcgacaggtccatcacctcgaacgccacgccgccgtactcggccgggatgccgccggtgaggttgttccgcgacagcctcaggtaggcgccgccctgctgcgtggtgttgagcttgctgaagagcgccggcggcagggggccggtgaggcggttgcggctgatgtcgatgccgctgaggaaggggagggcggcgagcgacggcgggatggcgccggtgagggagttgaaggagagatcgaggagggtgaggctcttgagcccgccgaggaaggaggggacggggccggagacggcggtccaggagatgatgaggagggagaggcggttgagcttggcgatcgccggcgggatggggccggagatctgggggaggtggtgccacgtgagggtgcggaggtgggtgaggccggcgacggcgtcggggatggtgccggtgaggttggcgtcctggaagacggagaggccgacgacgcggtcggtggtgtcgtcgcaggtgacgtcgtaccattcgcagcagaggttgtcgggcgtccaggaggcgaagtggtaggggtcgccgagggccttcttgatggccagcagtgcggccttgtcgccggcgttgcactccttcttcttcgtggtggcagcggcggcgccggccgcggcgagcacaagaacgacgaccatggcgcgcatcttgttcttgtaggatatcgtattaattaggtagtagcctccactccaatttagttgggcatttcagtgagtgagctagatgatgagatgtgttatatagagagaaagggggagagggagattaatttgatggttggtattaatcaactgttgttgttgacttgttgtatgaaattatttggaaaattaatcgcaaggaagaagaatcaagttgaaaaaaaaatccaacgcatgcaatagcgagtcaacaaaaaacattgaccaccgtacccatgcaagcgtgcatgcggatgagaagggtacagctctgctcatttaatgcacatgcatgtgagtgtgaggcgccgcagacgcagtttcttgaagccgccagggagccagccaagccaaagtaggagtaggagataaaatacaaatactgtagcaagcacgggaaagccagggagaatgaaatggtcaaagttggcagtgccaaattgccaaacttgtccaaatggagagtcaacccaggcctaccacgcctgtgcagggacagagcaccttattgatctaggacaaataatattcttctgcttgcttattgatcttcttgtcccacaaatatccagttttctattcttatcttgtgcatctactcgctccatccacaaaattaagctttatcatcttcgtttctcttctatgcttaagtagagaccatgcctccaattgtcagttgcaaatgtcccgtattagagcttggctatgccaaaagtttagccgagcgtcgaagcatagaaaacagtcttaatgaaaggcatgatcatcctttgacatctgaactaatctgtcagatattagctagcttcaaaaaatataatcttttaagatagtcagagtataagacttctataaatgctcatatttctagacaaagggagtatctatggtggagatgatgcgtatggtacaaatgacagaatgatcattttcccattatctaaaatttatactatcccgtttcatattacaagacactttgattttttttccccttagtttgttaactttacataagcacacgcatgtttagtgcgattcaggcattggggggggcctagttggggcgtgcgcgccccccacgcgcgtttcgggactaaagataggaggtatagttaactaatcaattaattagttttagataattatagcttaagataatgacagtagtagttaggattttctttttttcacaagattttttaactaacaaattgaaaagaaatctatttctgaagtcaaattttcaaaattttaaatccagatttgaaaattttaactcgaaatttgaatttttttttaagtcaaattttaaaaacttttaacttttcatctcacatttgaaaaactttcaactcgagattcgaaaattttcaagtccagatttgaaaattttgaaaactttcaactcgagatttgaaaactttgagctcagatttaaaaactttcaagtccagatttgaaaattttgaaaactttcaactcgagatttgaaaactttgagctcagatttaaaaactttcaagtccagatttgaaaatttttagctcgagatttgaaaactttcaagtccaaatttgaaaatttttaagttaagatttaaaaattactagtaaactaatcagtagtaaaaataggagactaatcattactccctccgtcccacaatataaggggttttgagtttttgcttgcaacatttgaccactcgtattattcaaattttttttgcaaatataaaaaatgaaaagttgtgcttaaaatactgtggataataaagtaagtcacaaataaaataaataataatttttaaaaaaattgaataagacgagtggtcaaacgttgcaagaaaaaacttaaaatctcttatattctaggacggagggagtagtaaactaattacgattttttctcccgtgtggcagaaaaaagaaaaaaaaaaggaaaaaagaagagacggcggtgcgccaaaagaaaaagaaaaaagagagagaggcgtgcgcgcgtgcgtgcatgggccgtgtgggccggagtatgcgccggcaacgcgcgcgcggggattagcttttccgggcatcgggtaccctaggccattgtccgaagcctggcatcccatggccttgtgggctgcttttttctaccatggattgacgactatcaaggcccaacccgtaatgggctggcccaggttatggcccaatcctagctcatataattagaaatagatttgctagaaaactttcagataagatctcagtactatgtaaccaaaccattgttgaattcaagttttattaataagttatatcgtaattacattgtagttagtacaatgtaattacacttcaattatactacagatacatctgaaagtttttgaaaaaaaaaaacttgcgacagttttttaagatactcccgttagaaaacttcgtatttgctggtacaatcagttttattgtgtgttgtaaattaagttgaatgaaacacatttatagtagcaatatccactccaatgttcatctttcaagtacatctggaactataatataaaagttggctgattgattgatcatattgcaagacgacatgaacattgttctcttcacttacactcgttctccgtacattaccagttttccagtcgtagctagcacagtacaatactcttaattactagtaggatttaacaaggagttcagataattaattttaagtagcgattagatgtagtttagttgaaagtttttatataaatgtttttgtagtattatttatcgacgacggcaggcggtggcgaggggagcgccgcagaggcatttgttgtgttggtagcagtaggcgtcgaacctgggcatggcgggcaccgcgccgcacatcttgttgtagctgacgttgaacgtctgcaggttggtgaggttggccacctgcgccgggatccccccgcggatggcgttgtggctcacgtccacgtagtacgtctcctccgcgaactccacgccggacatgttgaagacgaagccgtttcgcgacaggtccacgtaccttgcccgccggaacaccgccgacgcgtcgccggtcagcgcgttccgcgacaggtccaccagcgccaggttcgccgccgccagcaggtccgccgggacgctcccggacaggttgttgtgcgacagccggaggtacacctcgtcgtcgtcgtcctgcagctgcaggttggagaagaggcccggcgggatggggccggagaggcggttgcggctgaggttgatggcggagagattggtgagggcggcgagggagggcgggatgaggccggtgagggagttgaaggagagatcgagcatggtgagggaggtgaggttggcgaggaaggaggggacggggccgcagacggcggtccaggagatggtgaggtgggtgaggtcggtgagggcggcgagggagtcggggatggggccggagaggctggggaggtggtgcaggaggagggtgcggaggtgggtgaggttggcgatggcgtcggggatggcgccggtgaggttggtgtcctggaagacggagagggagacgacgcggccagagtcctggtcgcagtccacgtcgtaccagtcgcagcaggaggtgttgcgcgtccacgacgccaaattgtaggggttcccgagggcgtcgtcgatggccagaagcgccgcctcgtcgtcctcatggcattgcaccttctgctgctgctcatcgtcgtccttggccatggaggcagcagacaggaggaggacggacagcagcagcagcagcaggagcttcacatccatggtcatcatcatcatcatatatattggtcgtttaattttaccagcttgagctagctgcttaatcaattgccgactgatcgagtatgtatgtatgtatgtatgtttgtgcaattggagtgaggtcgcaagagatattgagatgcatatggtgcatgcaatgccgtgtatatatagcctcgcctgggccctgctctctctctcgactgaaaagagatcttctttttcaggtgttaaaaggttattaagttgggagcacctgcactactgagacagagataaagaagctaattaagatagataattttggattaaaatattgggaaaaagcgcaggcaagtgcgcgacaaagatacatggaggcaggccaggccatgcaacgccaatgcagtagcgacattcacttactaattgctcagatatttcacccagtagtagcatttgcattgcggacctaacctcatgtgatctgaatctgactgacatggatatgcatttactagtatttcgccggcctttccatcgatggatgcttacttgcgtggacagatagttgcagacggccaattgcaacaccagtattcacgcatgcttcacggattaacagcccttctagtgagggaggaggcactgaattctcatcactcagcacaggagtcaggaatcgtaatggccaaccaactggattgttattgcctgcagcacattaattgttccaacaggggcaaatgctctccatctttctttcttctattagacacaaaaggccttatgttttgtctacagtgtaaattaaatcctagcgatacctaaaattatgtagcccatcttatcctatcaaaacaaaacaacaatcctatggacaaaaaaacatcatggtttctggtcgaccaccggaagctacggtatcaccttccaggaccactgctctctctgcctccctccaatcgccatgatcaacgataatgcttcatttcagatggtttcagaccgtatcgctgctgaatgctccttcaaatgcaaaggggaggcttcaccaccaaattatatatgctctcctttcatgacgcatagcactgaaacagaggcacgcacatccatggtttccttgtcttgtaactttgttatctactaacgagccagctttgtttaaatataccacctttcctgaagttgcgtccatgtggagatgcagaatcaccttgatttcggtagcactgaaaaacacaatgttaaaatgtttagacgactttatgcgcatggtttttttaaaaacaaaagcagctgctagaaaaaaaataatagcacaagcagttccagctcatttctcaaagggttaggcaatccaagtaaaccatagatgtccaatatccaagttgctaagcacagctaatttgataatgctgcttttgtacgagagaattcacctgcaatgcattatcggataataatccagagtatgcatctaacaaccaatcacgttttcattcaaagaagtaaatagcaaaccaaacagcaaaattgttttgagttgacataccctgtagcatacaactgagtcatctgggtacatgacaaacagcttggtgccaaggcgagctcgacatgaatcacatatgctctcgtcagttagctgcacatgccttgacctctcctctaatctggtcaaccgtgcatcaaggttcgttgcgcgtgataaattatgaactacctatcaataggcatagagcgaaagagaaaatggtaagtcaaacttcacataaaagataagaccaacctgggagcaagtttgagttcaagagaaatattaacagtgcagaggcagaatagttcctcaaacagtcacatttcaatagaagacattggctgaaaaacaggaaatgattatgtttacctgcccttgacgatgatggtgcacccgggctctcagcattcgcaaaattgtatctgatgctagctgaagaggcatatcagcagataatctctggcaaaaataattatagctcaggcttcagaattcttgttctaataaaagtagcacaaaataggatgatcataccaatagcagcgataatataaacataaaagaacacggtgggatgcccctacaccagttttctattatccatgtattctttatttctttcaaagaccaatacacagagattaacaaacaggacatctcatttaccttttgttatatatcaactcctaaagagaaggatcacagcagacctctatagaccaggatgattaaggaatatcaggaacccaaaaaggtaataaatactaaatacaacattcaggcaatgaccatttgatggttcggaatcctgttctgaaggaacaagtgcacactcattttttctgggacaacacaaattgcttttctagactcactccccatgatcataaattaccaagggctagaaacactagcccccatgttaactagcatgcacatcacaaataacaaattaatatcatcaaatagattctgatcatacttctgtaagaaagtggtacctccaacacttgtattggatccaatgattccccatggttatggagaagtcgaacggctgctgtaaacatgggtcctttcccatttttggggtccagatacaaatccaacagcctgagttcacaggaagatgtagagaatatgaactaaggaccaaggtcatgatgcatgaaattatgctagtaatactaataagtcaacatagaaaagctaaaatcaaatcaaaacatagagaatgtaccaagaatactaacaagccaccatgtaataaatactgaagtgaggtaataacatactgaatataggcatcatctcgaccaatctctgcacagtactgctcagcagcttcactatcctccagtttccttcatcataaatgaagaagaaccaacaagaaagttagggaacagaacttgtaggggtgtacaagtccagttaaacaaaacattactgctgaaatttacaagtaacaacaaaccaataaaaaataaatgcagcacaggatcttacagcgctaatatctgaagtacaatgttctcttggcccatcttcctatacaaaatagcctgccagaaggaaagagatttttatgtcaaatatgtcagatataagcgatgaggactatcaagcaagcataaatttcaatgggtaggacacaaaatgagctggcatggaacgcgagaaggaagaaataaattgtataatcaccttttccagccatagctcagattctgaaatcacatatagcacttcttctgggtcatacaaatctgacgattgcaaaaaaaattgcaacctttccctcaatagataaatgaactgcatatcagaatcaaattctttattgtttctctcttcattgttggatcccaaacggactgcgtccatggcagatctggagagggacaatgcatatgacgtgtgatagtgaggctcatcacattcctgttcctcaatcaaccattgcaaatatctgcaaaacttagcatattcagatttcataaaagctgaggaatttattcagcaagagtacaaaaggcatagaacacatagagctttcaaagaaacatgcaaatggtaactatatttgattaagaactacctaatataatacgcatatgatacagtagcttcaagtcataatatgttatttcattgagcctcattatgtttccttcgtatatatttagaatacgcttaggtcctgtttgatttataccccaattcaaccatgccaaataattggcaacaccaagaaatttgtcacccatttggtttgcaacctaaagaactgccattgccaaattatttggcatcactcttatgcccatacaaattagaacccactcattcttgccaaaatttttggcaatagacaaatcttgtcattgcccaaaaaaattggtaacactaggaatggaattgatccaaacaggccccccttggttacaactattattgtcagcatttactcgaataatctggcatggaaagacaagatcatcaatcaatcgtatcaatgttcaggtcactctacagtggtgatggatcccaagataccaagtaattagtaagaagcctgacaaactgctattagttcattgtttatgatcatgcaattgtataatgaacaaacttgcacaacgtatacccataattcactctgttactatttaacatttttttaacaaggatcattggaggatcatcatggaatcttgagttctaacttgtaatgattttgtcgattcattatatgtacctttggtgaatgccaaccttctctggatcaatggcagcaacaaccttttctgtagaataacaatcatccagaataaatgttaacgcatgttagttacacccaaaaaagtttcctagcagccctaagtagcaaacacaattttctggatgcaatataggctgatatagtgaaaatattgttagttctaaaataggagaaagagagcccatcgatccatgattacatatgcctactaccatccacactatgttatatacacattcataagtcaaaaggagaaaaaaaactggaaattgtgttgatctgccatggataagccataaaaggcacactggtatagtggtttatctaaaacaaagcaattaccaggagaaagctgtttttccctcatttcagatgttaaaattgcagttgcaagctcttgatcaatgtctgccacctaaacgcaaatagtcagtagaagtacacaaagtggaacagatcattgatcatgaagtccttagtgtgaagtaaatacccatccaagatgctccagaacaaggtcctgatcagatgatgcttgaagtatcttggaggcttcaacggcagcaatttcctcaccagacattttaccaacagaagtttcaagagagtcagtttcaggtaggattgcatgatccttccacaaaccagtgctgtaattccttgctaagatacgccagataccaagggatttggagcacattcctttactgccatataagaatgcaagcgtccgcagatgtccagagtcatccaaaagtgattctagttcctcctgcaccaccatagtatttttattgtatcttttttttaatttgaacacataagaatatcactgaactatatgtagttatgtactgttctcaaatgaagagttaatgtcgatttaagtatcgtaggtgtgtaacagtcttaaacgcttcaaggttgcagatgtttaaaggatttacataccacaacacagctattctgagatgatgcaagcttctccatgtcatcaacaagattgagagctctataaagatacatcagaagagtatcaaccccttccatctctgaagaagataaatccttctctcgggatgcacacaggtacctagtttcatatagcattcagacatcagctggatggagcagcttatttgcaattcgtaatgaataaaaaatgtcgtgaatgagcaaacctgataatatttctgattgctacttccagcagatcagctctgcttggtggatttgaaaggaaatcatcatccacaactgtgtccacacctgcctttttgagaaacaatgcctgttgaagtgttactagcccatcatcaataacttcttcaagaggctttgggggagcatgcaagccccaataacgctttcttggcacctaaaatttacaaagttcacaatcagataaaaaactgctgaatacaaaaggcagccagtcatagtggaagatgagcagtttgtcttgagaacttaatcagtatgttaggtgatgaaaactacagattccatttgacaattacaaaaatatgttgacaaattaatctagcagatcaaaacttaacagatgtgcctaccaatataagctttacgctcaaatttgaaggaaccagctcatgttgatactcaagaggaacgggttcatatatcaagaaattaataaagtcttatccattgaaaaccacattaaagagataaaagaagttgcagcattcaacatgaacttttcacatacagaagaaaaggttaagagagtatcatgagaaaggttgtgcagttagtcagctcctcgagcacattacaggataaaacataaaacaaggaatgtgttaaaacagttgtcttatttatacccagtggccagtggattttacaaggcgtattttgatttcaaagagtctacagtgttaaaccttgagcatgtattttttttgtcataaaatatattctaaatagaaccaaaattgtgtgaaaacattttgaactggcctttgtaacctgtctagtttttggtcaaaatctacaacgttgactttttaaatcaaaatannnnnnnnnnnnnnnnnnnnnnnnnnnnnnnnnnnnnnnnnnnnnnnnnnnnnnnnn

SEQ ID NO: 1251 - DNA, 6809 bp, Oryza sativa
cagccagtcatagtggaagatgagcagtttgtcttgagaacttaatcagtatgttaggtgatgaaaactacagattccatttgacaattacaaaaatatgttgacaaattaatctagcagatcaaaacttaacagatgtgcctaccaatataagctttacgctcaaatttgaaggaaccagctcatgttgatactcaagaggaacgggttcatatatcaagaaattaataaagtcttatccattgaaaaccacattaaagagataaaagaagttgcagcattcaacatgaacttttcacatacagaagaaaaggttaagagagtatcatgagaaaggttgtgcagttagtcagctcctcgagcacattacaggataaaacataaaacaaggaatgtgttaaaacagttgtcttatttatacccagtggccagtggattttacaaggcgtattttgatttcaaagagtctacagtgttaaaccttgagcatggattttttttgtcataaaatatattctaaatagaaccaaaattgtgtgaaaacattttgaactggtatttgtaacttgtctagtttttggtcaaaatctacaacgtttgactttttaaatcaaaatatgccttatagaaatcaacgaggagatacagcattacaattaacatgtggtaatgaggcataccagatctgaccaacgattagggtcccgcatgatgaatggaaatatttctgctggttgcatagtttccgagagcaagaaatgatttacagcatcctcgaaacgcaagtcgaaaaacaacaagaatccaagttgtgcatgcacaaaggaaatcatgtcatttgagatttccccatcggcctcgaactcttgtaacaaagaaatagcttctgcataactctttcttcgtagtagtgccttgatctgttccaccgctgatactttacggtagcaaaatacctggccaagccaataaatgtgtccataagtacagtgtgtgatacaaaatcgacatgataaaatggcgctgcacatttatgagagaatccattgtcagggtttcacttgagcatacaaaatcattgtcttgtcattggaaattgtaattattgagtattactaacaaacacagaacgcagctcagtagctaagcaatccggtagagcagattggaaattttgagtcaagttgcaccgatggatgagttgacatacctacgttaccttataagccgtagcaatcacaactacgtcgctgccaattccggcatcctcgctcgctacaattagtccacctgtaccaggccttgcaaaaggaatagcctgcaaatgtgcgccgttctttcttctgtagacatctaccttggagtccccggcaacaacaacataggggtacacctccgctatacaatccggcgtggtgttaaagacgaagctgcttccaacgggatgccccgatcggtccacgacgaccccgacattgtcgacgagcagcatgacctcgtcgcccccggacaggggcttcaccctgggtggcctggaggactcagggagcgtgaatatatcgccaccttgggcgttcgtggtggagaagagcgagtagcccgaggcagtgccgacgaagacggagtccccgacccaagcgagcgccttgacgccatcgacgagggcgatgtcacgcgtccgcacctccaactcgtcggcgtcgtgtagggtgaggtcaacgaggagcagcttcttcccgacggagaccgcgagggagcaggaggggcgatcatcgtcggattcggaggcgcgggcggcgacggcggcaacgttgcggacggagccgaggcggcggacggggcgggagaggagggggtccgcgaggaggaggaggccgtcggcgaggaggaggaggcgggcgacggcggggagggggaggatggcggagacggggcgggtggggccgatggggaggaggcggaggaagtcgggggagggggaatcgagggtgaagaggaggagcttgccgccgccggtgccgaggtagaggtatggggaggagatggcggcggagcggacggtgagcggggaggaggctgggaggccggcgagggcggcggggtcgagggtggcgaagggctcgagggcggcgcgggagggtggagtgttggatcccatgggtgagctagggttgggagcagggggacgccatagatagctggggaagactagagtgatcgatctcttcgagtcgaaggaagaagacgaccaaacaactactagtctcttctctcttgtaacagtgttaactccgattagattagaccaacaagtctaacaacttagttagttggtgactttgttgttggcgagagatatacaactctttatcccgaaattcattcaaatcttcacaattttcactctaaacttctccatttagcatactatctccgtctcaaaataaataaatctattatccgtagtaataaaaaaaatacctgtgcgttgcaacgggtaaaaacattttttatcatgtacattaagctcccttgattttggaccgaatgcttccttgtttttggaccgaacgttcattccttccttccttttcagctgctaccttcactgctcggcatatctctcttcggctcagcccacaagtgaagctgtaggctcagctcaaacagtctcgtgtctggcctacctcttttcagctcaacccacaagtattgttgtaggccctgctcgaacagtctcatgtccgtaccatgacgaagtcgatcctctccatcaaatgcggtcgaatctttctcaatctccaaaattgttgagatattttgatccactcgatcctcttttttgattttttttatcaaaatcgaagtgatcctctttttcgattttttatcaaaatcgaagcaatccataaaactcaggataaaaaatgacgaactgaaaagaaaattctgaactgaaaagaaaattcaaaagaaagtagtggagaatcgatttttgcaattaattggatgaggcaaatcgacgtggcggcggcgctaggcatacatagctgggcaagagtgatcgacacaaatcaaaggaagaagaagaccttctcttctctctctgtaacagtgttaactcccatcaaaggaagagttcaccagcaagtctttgctgttggtgatagacgccactacaactccttaacccgaaatccattcaaatctccaccatttacactctaaacttctccatttagcatattcccttcgtctcttaataaacaaatctaatactatatgagtaatatttgattattttagtacactttggtctaaaatattcgatattcgtgataagattttcaaatttcaaccataaaaaatctctaaatattcagtttaaaggtatacttggcacgggtatttattatcagaaaaactgtaaaagtttaatcagattctgttccaaacattaaatatttttttaccaggatagtccatttacatttcctatcatcaatatagttacctacctatagaaaacttcaccaattaaaccatgtctaattttgagcttattcatcccgctagagatgaagaacaagaaccaataaaccaccgctaagcattatcatcaaaatagacatacccaaggaatgataaaatagaaaagatccataccataccggtatgcttgctactagtagtactttatacaagaagatggagtacattacatacatatagttataggtgccattgattgtacgctaggaaacataatctccattcatatatgctacaaaattattagtaacaaagagatgagatgaccgtaacataacaaatatgccagcattgctgcagctcaaggcgttgtcattcccattggggcagccatattccagtctctacccatcatccagccgctgctcttcatctcctctccagcttctttacagattcggtccagcatggcaaggaactccctcacactgccaaaaactctcgccatgtgcccttcgtcgccgctgctcaattcaccatggaagtactcagtcacctccttcacacaagacaggcagatgctctcttgcgcctggagcttcaggatctcctcctctgcctgcctcaggaacatgctcattgtgttgtggaaccgcctcgcgctgtccgctgaggtcaccatgctgtttagcctcaacacgtcgtggatctttccaagccctacgccgagctctgaaacatctctgctgagcttcatcatatcgatggatgaagctttcttggtattgctcagctcagccgcaagttttgacacaacctgaagaccatgttttctgtattccacatcatactgctgagtagtatttgcattcgttttgcacaccggactgtggccttcaggtttcacaatttcatggacaacaaattgcaggagagcagccttgccatcagctcctttcacatcaacgatcttcagcagagtgttgggttccatggcatgtgaattcggagatcctgtatcgatactcatcaagttgccaaagttcaaaacagcctcaaggaccttgtggaacaacctgctgtttttcagctcctggcaagctgcctgtatgaaaaacgataagaaaccctcagagatgagtaatactataaacaaggaaacagtaagtgagggtctattccgttcacagattcaaatcatttgtgtaaatattgatatgcataatacccaattgcatatgaaagttttgttttgcttctttcaacaaagggtgcaaaacaatttgtacaaaatattcaaccaagggctcaactatacctcaagagtagcatatgacattctgagctgattgacctccaaatagaagttggcaacatagagcatagcatccattctcttgaacgcaaatggaatatccagcactgcctttagaaaagcttccacagggcaaagtttggtggatagatcatctttgaaatatttcagtttaagctcttcctcattggtgaggaccatttgcatgagcattcgcaaggcttcaactcccaaaccatgtgcattacctatatccagcaaacacaaattaaaccatgtcaactcccaaacggcaggaattaacagtgcaaaccgtacccatattgtattaaggcatagcatgaaaagtgaacaaataatgttatcaggctcaataactgattagctatgatgtttgtaacaacttgaatgcagatctacgttgctgaatcaaaatacagaagcccaccacagggaaacacatagtcaccaaaaaaagtctataccaatatggcaatattggaaaaatgtggccagtactatattgataccagaggatgcaaaatactgaaaacaagtgtttttccccctttacacaaagaggaggcaactacaaagaagagatcagacgatcacaagggaacaaggaaatttcatgtgcacctatgtcaaaagggcgggttgtgaaataaactatttcagtcagctaatcaggccatgtgggacaatcacagggcaagaaacaatcactgaaccaaattgtgcaatataactggtgaaaaggcaaccaaagttgaaaggacagaggcaccatgcatcatctattcatcgttgatggtgggcataataatgcatcgcaaatatggccaatggtaacagccacccattccaaaggcccccacaataggtgaacactagtttcattcagaaagatgacaactttagacagcataattcaagagcacaacattgcgcgccaaatccaattgctaggaagaagcagccacacataccttccaagatggcttcgcgcacttgctccttggaaatacccaatgctcccaccagcattccaatgccatggcacctcggagcgcccagtaagcacacctccctcggcatcgccgccgccatggagttgttcagatataggtggatcatctcatccttcatgctgcaaattaacaggaaaagcaacaggaagccatcaaatcgaaataattcttttaaaaaaaaagttagcaagttgagatcaaaattgagtggttgcattgggggtgcatcttactgcaaagacccgggctttagcttatccgagtgcaaaggccgcgacttgcgcatgctcttctcggacggcgagtgttcctcctcctcttccgaaggaggtgcttgaggcggcatggggacgaaggggttccaggcgtgcgctgccattggctccggaggctgcggcctccgcttggggggcgatggattgggggctcggccacgcggctgcgggatggagggcgggcggagatggacagggctggagccgagcgtgggggaggaggccgacggcgaggaaggggatagcgaggaggaggaggcctcggcggcggcgggtggcgcggtgctggggtcggaggcggagctccgggatgcgaactcgccggaaggtgggccgacgcgtgggagcggcgggagagggcggagctctggcgatcccggacggagatgggaggtggtcgggggcggctgttgcggcggggcggcgagggtgccgaggtagaggaactcggtgctggggttggaggaggaggtgggcattggcggcggcttgaggcggcgtccctcctcatcgccgtctccgtcgtcatcgtggtggtggttggtggctccggaacgggatgagggcgagcgagcgtttgggtgggagtgggaatggtggcggtggcgtaggcggcggaagaggtggagggagaagagggcggagaggaggaggaggcagagggaaaggaaggagaggaggagggcctggagg

SEQ ID NO: 1252 - DNA, 1953 bp, Oryza sativa
gatggtgccgacgaagaagaccggggcgcaggggacgaaggtgaaggggtgggcgtggtgacagtgggggtggggagaggtggaggaggaggagagtcgggagagtggagctgctgcaaggtggtttgggttggggagaaggaccggtggtgggtgttgttgttggggacggagacggcgctgcagtagggtgcaagaagaagaagcagcagcatgagattgagcaaggagaagaagaggggtggggaagacgacggcattgccattgccatcgccatggaggtaggtttgccgttgcaagtgcaaaaacaaaggatgggttttggggaggtttctctactccctcctctcctcacagagactgtgcacaagtgcagtgatgatcctggccctggccagtgtaggggggccagctaagacggtggcaggaacggcagcggcagcatctttgcttggttattggattcttggtgagtgctcctcctcctcccttcctcttgctctgcctgcgcctccgtgtcttgttgtcttgggaatacaattaaagaggtcttctttctcactggtgatggattattaccagtgggaaatgcattttattagccactagtagtagtagcacctccactcttgaaaactggtgtccttttcctgtcagtgttgtctctctttagtttaaataaaatggacaaatgaaaccgaaaatgcaacctgctgtttcttcggctacagctttatttctgaatgagcactactacggctgtgtggatctaaacttcactacttttctatcacatcaacatgtcatacacataacttttcagtcacatcatatctaatttcaaccaaaacccaaactttggatccaactaaacacagcctacatctatttttttttacaaaactcttacaaataataatatcaaccgtttaacttaaatatataaaaattatagataacctgaatgtatttacagcgtgacatgtaaatggcccaagaataatttatattaaaactaatctactaatataatagatttgctgtaagattgttttcgacatgttagcttctccacagtagcataaaaggcggagcgaaccaacaactagggcctgtttggtacagctccaactcctaaatataactctaggagttaagtctggagtggaattgtggagctgtcaaaacccagctccacagctctaatacgttttgtgagagagctctactcctagttttggtagagctgaaattgtttgactgagctccaggagggtggagctggagctggagctgtgccaaacaagcccctactctcattatcttgtggcctggtgcattggcaagccatccttgatcgtatccgtagtggttaggaaagctggtgttgccactcgacatggaagaggaggtcaagcttgtatcgttgcatacctggggctgggactatcatcgctaagagcatcaacaccaacaatagtttgtggatgccatataccttcctaaaggtgatatcactgacatcccgtgtctcagtgtggactctctagctgaaaacttagttatggtttttaggatatttagaatagtgacgatgatactctagatgctatgatattttttgagatgtcgtattgtaggtttcatgttaatgggtgttctggataacttctgtcttcgacagatcggcttcgatggctatggcctatagcggctcagatactctctaacatcaatttttgttttggtttgatgcctgttctcgacaatgatgtgtgtggaattcgatcgacgcaacgatcaaagttgattttagacattctgatttttcaatatgagaaaaacacaaagactacatacaacttataaagcattgagaagaaaataatagttatgcgtattattgtcaattatagatagtaagtcactatctttaaggtattataagtgtt

SEQ ID NO: 1253 - DNA, 9987 bp, Oryza sativa
ttcccaaacaccacctcagtgtagtatgcatgtaatatgggagggaaatttggtttggaacttaaatataatataagctctctatcatagataaaaaaatattcctttcaaatatggcactgtttagtttcaggggtaaaatgttttggcgtgttacatcgtatatacgaacatacatttgaacatttgaagtattaaacgcagtctaataacaaaacaaattacagattctgcctgtaaactgcgagacgaatttattattaagtctaattaatctgttattagcaaatgcttgctgtagcaccacattgttaaatcatggcgcatttaggcttaaaagattcgtcttgcaatttacatgtggtctatgaaattagtttttttctatatttaatacttcatgcatatgtccaaatattcgatgtgacagggtgaaaaatttttgttagggactaaacagggcctgtataggagtactccctccgtcccataaaaatccaacctagtattggatgtgacatatcctaatactacgaatttggacatacaatcctagattcgtttttttgatagagggagtactcccttcatcctctaatataatggattttgatattttgtttgcactgcttgaccacttatcttatttgaaaaagttgtgtaaatataaaaaacgaaaagttgtgtttaaagtacttttgataataaagtaagtcacaaataaaataaataataattctattttttttaataagatgaatgattaaacaattcaagtgaaatgttaaaatttgttatattagaggacggatggactactccctccgtcaaaaaagacaaaccacgagtttccgtgtccaactttgactgtccgtcttatatgaaatttttttataattcgtattttcattgttgttagatgataaaacatgattaatattttatgtgtgacttatctttttaatttttttcataatttttttaaataagatgaacggtcaaacgttaagcacggaaaccagggtttgtcttttttcctttttttttttttttttttcggagggagtagttacgaaggggcacagggaaatcatcaaagatggggaaattgtactcgtagctctgtaagggctggatcacgagctgcataggaatgtggtggtactagcgcaaaagcagggatggtagtggggtgcaacgtgcacggctgcacgcaccaaaaaaatgtgtacgcacatcacctcaccagcgtactgtatggagtacagtaacagcacgcaagcacacgcacacggagacacgagtcgcagagataggcttttggcgggaagcgggcctctgccattccctcccgccatcttctacatcctgctctcctgtggccttctccttcctccatcgccatggttggactggatcactggaaattggatgctaaagctttgtttgcttccaacgacatgcatccaaaagaaagggcgcctgcttcccggcctcttgttctgcttgcttgcctgccactgtgccactgccgaccaatctcctctcttcttttcttgtgatatattcctatataaagtgttactttttgttctatttgtcaatgaactatatattgtgtgattattactgctctccattactaatattcaaacaagaggagaaaattaatgttcaacaaactcgtcacaaattaagtttgttatgtttgtccgcccctctgcctgtcgggatgggatgcatatggatggagtatgaacaaacctgatctgaagtagtatagttggcaaagtcggtgagatttgagacaagggtcaacaaagtacttgaggtcgttgcatgcgttgatgagtcgtattaacgatcacttcttctctttatttattgatgaagcctgctatcttttgcaggaagccggtcggttatccgccgccgaggatgaagagctgttgaggaggctgcgactgctgcggccattccgccgccactggaaaaaagatggacgacgacgaccatgaccaccacggcaacggcaacacccccttctccttggccttggcgcgctcctgcggtgaagttcatctcatcgggccggcttgcagtttagcccagcccagcaaggcccattggcccactgggagtgggaggaacaggaaaccgacctcctcatcctcgaagacgaagacctctctctctcgctcgcctggcgccgccttcctccaccccactctctcctcctccgccgccgcatcctcaccaacccccaacagccctccctccctcctcgccaaaggtaaaaaaaaaacttagccggatctctcatctggagacttgctcatccttatctatcttttggggatttcttcatctcattctcatgcatggtgtaggccaaagtttattgcgatggatctgatgtttgcttacatcctttcctagtcaatttcctactctgcctaggagtatattagagcgagggagtctttttacaaaccaactctgaatctgaacaaaaaaaaacaatacagagacctgtctgtgccgataatatgaaaatctttgctttctacacaattactgcctttggtttttgggtaccactataaatccagtataaaaggagctctgagatatttatgattttagtgtactaacatcatcagtagctgaaacaggtgatgatgagtttctacgctctaatactaaggcccttcactctgaatatgatagcttattttttattttagggagatcaaatactctccctaaacagtaaacacccgaaattactagtctagccaaactccaaccatcaaacctagtttaaatctctaatctttctttggtctaaaattattaatctctcaaaatttactgctgtgaggtaagtcttttccttttccatgtccaaatcaatctaggctatgttctggtatggttcaatcccctccccactgctaagtaagctaatgttatgctctcgaacttgccattgccagctgcacttgtagcagatgggttctgtccaggattgatattctagcactgactagctcgagtgttttctagtataatcggaacttgtattacaaattcccacttttagttatactgtgatttaaagacaaacactagtttaggtggtgtttggatccagggacttaactttagtctctgtatttagacactaatttaaagtattaaatatagactacttacaaaactaattacataaataaatgctaatttgcgagacaaattttttaagcctaattaattcataattagagaatgtttactgtagcatcacataggctaattatggattaattaggctcaatagattcgtctcgtgaattagtccaagattatggatgggttttattaatagtctacgtttaatatttataattagtgtccaaacatccgatgtgatagggacttaaaagttttagtcgcatctaaacagggtcttagtcttgaggctacatcagcaaaccatatctatcttcagtttaaattcatatatcccatatagctctgtgccttggctaaaggtcaactggcatcagtgtggcaccacttcttcctgtttctgtaacattctcttcttcagtttctgcaacaaccggtgcaaactaaagatggcgggattcggcagcctggcacccaagaccaagaactttgtggtggctggaggactgtctgctttcgtcctcggcgtgtattactacaccatgagagcggtgggaggcacagatgagctgcaggtcgccattgataagtttgaagacatgaagaaaaatgatgctgggaactcatccaccgcgggatcctaagaacagggtttagaattggctccatgtccgcctctatactgaactgatgacacttggttttgatcctaagaacatggtttagaattggctccatgtccgcctctagccctctatactgaaccgatgacacttggttttgtacaataatggctcgatactaggttttgcttatgctttgatgataggctggaataatttttgactgaatgatggctgcagagttggattgcagttttaattttctgaaagttcatataacagtatgatgacctgtgtaacttgaaggtttctatttgtgtgtgggtatgcaaaagacaacaaaagtgtagcaatgttatgggactattatcacgttagattccccctcttgtatgatgtatcaatcacctttttattgagtagcccaacgacatatagcagttcacatgttcacatttatttcttaaaggatgaaataatatatttgtaaccggacacaaaagaatgggttgtttggttcatgtgctatgagaggacaagcgtatactaatatcctcttctggaaggaggaagaagaagatgacaaggtccttctcctccaagaagctgtagtattattcaggtttaaggtactgatctaatgaagacaatctatcatcaaattgagctttgatctggtattgccaatgccatattattattccgaggactttgtagtttgacctacaatatgctttacaataatccaatgtactactccatttaaaaaaaaaacctaatatagtattcagattcatggtactctagtactatatttgttttcctttcgaatgaagggagtattattatttgcccttatcaaattaccaaaatgcctctaaacttatcctaaggccttctttggttaatcccatcgggattaaggtgcggaattaatcctactcaatcccttctaatccctgtctcacgcggaataatagaacagtctagagtgagtaaccaaaggtgcttggacatgaataaaaggatagtaaaaaaaaactatcaactatgaaaataacacacgtgatcttttctgcttattcaacgtattattgacgtggattatttgctctatacttctaaaattacgggctcaaacaatgttcttatagtacattgcatatacaaacttaggccatgtttagttcccacgaaaaacttttcaccatatcacatcaaatgtttagacatatgtatggagtattaaatatagacaaaaaaaattaattacacagattgcgtgtaaaatgcgagatgaatctttaaagcctaattgggccatgatttgacaaatatggtgctacagtaaacatttgctaatgatggattaattaggcttaataaatttgtctcgtagtttacatgcggaatatgtaatttattttgttattagactacgtttaatagttcaaatgtgtatccatatatctgatgtgacacgctaaaaattttcacccccttgaagtacacagggccttatactatattcccctacatttctccctcacacacgggagtagttgattcgaccctttttttcttgtgatgcgtattcgttgctgaccatatatatcatgtaagtcaggctcttctagtgtggctacgagctgagtccgacttgagtttattcttgggctattcctcgactctaggttgggtgagagacttgtttgtcacgagatgagatggaagtagcactaatctttggctaagaacaagtttgagttggacttatcacgcaatcacactagatgagcacgatctagcttgggaatgagcaattttcaaagcgacagtgttggtttttgcaatataaataggtttcgaggtagaatatcaaaacaaggatgattaaagttgaggcagtttatgcaattttgtgataaaaaggaaatgggacggattaaaaaaacgtagtggcagtgtcgtaaaaaaaataggattagaggggagcgtgggaaaaaagaaaacgggtaatatactgtctaacttcaacaggtgaccgtctcagattgagatctccccttggcctccctgccccgttaataattacagtattctattctctctctagcaaacaagtaggagtaattttcctctttctttattctactagtctagggaaaaaaaaaaagtagtcgatcgatcgatcgagaggtttaatctgtcctccctctcgccggtcgccgccctcgtccccgccgccgccgccgccgttagattgaagcagagctacaggcaggaggggcttctcctcgcgcgccgccatggtgcttggcaacgtcgccatcctcgtcggctccggtgagtcactttccgccgtctgctccctcctgaggtccacccgcagccctagctagcttctcgtcgcccagcccagccggttgactttcgacttggagattgatagatagataggagtagatgccacttgcaaccatggcgcagtcatagatagattaccaaaccaatccctcccacttctagggaataccactaccaaatcccaacttatttgctcatcttgtacggagtattttgctttaccagattccaatacatagattgatctagccttttagggccggggccggggtttgtttagttcaactaagctttcgcttcaaaccagaggggaacttattacctgggtatcccactgctacatgaaacaccactgtcaaatcccccccaacttagtggcttccccagtacataggctgatcctgcctttctttttatcttaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctgccaaggtattgtattattgcccctccatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagcggtggttgttgctggggctgttggctacgcctacattaagtggaaggtaatgtttgattctttcacctcaatggaagtacagaatgaggaggacataatctttgattattctagttgctatcttgatgtttattgttctgtccgtcattctagatcatggacgcaagtgcatattattacaatcctatctgcttgccatttcttgtttcactgttctagctagtttctaaagttacatagatttgcagggctggaaactttctgatttgatgtttgtcacgaagcgtggcttatctgatgcttgcaatgtagttggcagccaattggacaaggtttcagatgatgtcactgtaagtttttaacttctttcagcaacgctgaactcaaatgtgttacttgtgattccatgttttcattgttccaaccaaaacatcttactggcctttgattttcactattcagtctgcaaggaaacatctcgctggaaggattgatcgtgtggatatcagtttagatgaaacacaagaaattattgaagggacaagggatgaggttggaactgtttttccttttattttttgtgtttacttttatagtttttgatgcattttcggcgacctaatggcatttcatgactgacttgtaggtcacagtcatccatggggatctgagtgctttccaagaggatttacaatcagttaaccttgtagttcggagtctggtatgtgcctcgtaccggaacagattctaccttatttactgaatatccagatttctaccttatttactgaatattactcgtgtacattttttgtatcttgtatcatgcaggaatcaaagcttgtgagtctggaatacacccaggtgagtagaaagctcatgtttttttttttaggaaaagtagaagctcatgttaccactacatattaccaacaaactcatcgacatgctcctaatgctatcttcttaaaatccttttaggatcatacggctaatggaatatctgacttggttgagttcacccagaaagccactattcgccaggcaagtttgaatggtctagtgattccttaatgccatgcttcttctatgctttatttaacaaaaccagttgcacctcaactataagcatattcttttcctatatgcttattctgaagagatgtttttattttcaggtcccagcagcatccgttcctccagctattggatcttcagagcgagttgttaggagggtaaaggcttgcacttttcccagctttgtcatggtcggaacatgccccagtttgttgacttgggttcatgtgtttctggttgcaggtttcttcgttgcctcaatctactgctcttccagctctgccgacaaccgcacctgcagctgaaccatcacctagggcagaggtgccacaggtgtggtttcagtttgatgttgcactttgttgcatgcaatttcagtttcctcttgcgctttccatgattgaaacgagctattgctggacttttgcaggaggaacagtggggttttgtgagcaaagcatcatctagtagggaaggattagggcgtttgcagcagcagcggagtgttgtgaccagaacgtcgtctatgagggaaggatctcctgaatcttcaaatggagcctcatcctcaactggagcaagcacaggaaggaacacaagcacaggaacaaacacaagcacgggcagatttggtgggctgaggcttcctggacttgggtttcttgcaagttcgacgagttagttgatgaggtgtttttatttaagttaaaagatggtgctgccaggagctctccattgctttgcttgtagttttaggttgtacagtaggagagaagagataacagtagcagtgatgtgatggaacaacacatatacgtgcggggctgggctcgtttgttcttgaggaggccaaatttttgtagaaaaaagagaggaaaacatgtgcacctatgtatctatctatctatagccatgaatgcatcatccagggcaacaccttggtctttgatgtcgagatttttaacttaaaatgccaagagtactagtacttggttaattaattttatgaagacgagtcaactggttggttgcctttgttactagtatcttgtatgacatatgccgatatttcatccagcttagggccatgattcgtttcagacttctgttactgtatatatgtcatatgatatatgatttgcttggaatttctggtaagatcccgctactgtatctcgtatgatatacagtatatgattcgtttggtatgtctgttaagatgtgctactgtatcttgtatgtgacatgctgatatttggtactccagtaaagatcttataacaggaaaaaaatatgaaagaaaccaaactgacaaaacagcagccgcctgatat

SEQ ID NO: 1254 - DNA, 18994 bp, Oryza sativa
aagatatgggccgtgtttatatgggcccaagccctaagaggagagtttaggcgacgggacggaaggcttcctcctcctcctcctactcgagactcgacgccgccacctccacctcccgtctcgtctccagaagcttctggaacacccttccggcttcaattcccccctgctcgggtcgggtagctcccttccatcatccatggccgacgccaccgccgccctctcaggtacagtaccatcttccaactcaactgttgacctagtactagtactgaggtctgaggtctgaggtcgcttcgaattcattggctgcagctcggagcaaggtgcaagctttcctcgaagcggctcgtgccggtgatctcgactccctcaagagtaggtgcccccatgccttcctctctctctcctttgctttccttgcgtttcttctcatctcctctcctcatgcgccattgcagagctcgctgcggcgctcgacgaggagggcaagggcgtcgccgccgtcgctgctgccgtcaaggacgccaacaagcgcaccgccctgcacttcgccgcccgcgagggccgcacccacgtctgtcacttcctcatctccgacctcgccctccccgtcgaccccaaggacgacgatggtactactaactatcactatctcttactctcatctgatttcttcacaatctctcatccatcagtttacatccactccaccaggtgaaactccactcatccatgctacgcgccaagcccatctccaaactgtaacctatctgcttcaccatggagcagatccttccgttgcttcttccctcggagccacgccattgcaccatgctgccggcataggtaaaattcatcatctatttgccatttcacttcattctttccatggattgatggtctatactcttttcttttttctcccattttgattgtgccaacgcctctataaatgcgtccaacaccactctccttttttttttgtttgcatctgcagggaacctggaccttatgaaactatttctctccaagggggttgatgttgaatcagaaagcgatgccggcacacccctcatatgggctgctggtcatggacagcaagaggcagtcaaacttttgcttcaacacgatgctaaggttgctcctcaataaatccactatctcctatctcacttcatatctcactgatttaacgaacctgagcttctagtcattctgttcagaaatcttcattatgctgaaattttaatatgtcgccttttaatattgtcaaatactagtagcaactgacactttaacagtaaccaccaagggttctcaagcttgctattgttaagaagatgctatcttttggttctaatagcatctgtatctattatgtttctttgaattggacaggcttctctttgtttagcactcaaccacctttcaatcagccgttcatgtggcctttccttaacttttttactgaagctagttattgcttggcagccaaatactgaaaacgatgatggtattacgcctttgttgtctgctgttgcagcgggttccctcccatgcttggatattctaattcaggtacacaaatctaatttcaagagtaaaataccaaaatctgttgcttttactttaggatattatccacttcgatgccattcattggtcatatggtttctgtatgctatatttccttgtttagtaatctggcttgtgcaatgggggttcagacaagctcatttttcgtgttattgattagattgctgcatggcaaatcatagtatgtcacgttcttatatgtgtgctacctatatcaaaagattttgataagaggatcaaagtgtctgttcttacttttgtcatatgctgtttctgttcttggttttgtttgatgctctgttgcttctacaccccttacatctatgattcgtataaaaaaccgatcatataatctgctacacaggcaggtgcacatccgaatatcagagctggtggagcaaccccattacatattgctgcagatggtggaaacatggaaataataaattgtttacttaaagctggaagtgaccccaatgcatgtgatgatgtaagttgtacattaatcagaattccagtgtatcattaaatatttaaatgtcaatagccaggttcatgtgcattgattggtcaaaatgattcgtaagagggtgtcaagcgtttgctgtttgttccacaccatgtatgataatgaatatccctttcttggtcagcatgtgttactctgaaaatttccaccgtttcattatgcagtgaataactattgtaaccctgtagtgtattgtttagctggattggcaactgcttttgcaattccatcatctgtcctttcttgcattattattgagcaaacagcactgggctgcataatttcactgaaggacatgactgttgattttggtgtagcagtagagctaagtaatgctaatggttgaataactattatattcttctacaggatggactaaagccaatacaggttgctgctttgaggaataaccgtgaagttgtggaacttcttttacctttgacatcaccaattccaggtgtttcgagttggagtattgatggaattatagaatacactaaatcagtcgaggaaaaggtgcaacttcaatcttctcatgatctattactagttgcaagttctttgtcgatcccaatggttgaataaattttgcaggcacaggtaaaggaagctacaactcagaaagcagacagattacaagtaccacaacttgttgaggtgcattgcaatttactttatagttttattcatcttcaaggctccaactatttaataactgtaagactcaagatctaactattgctgcaaatggtgctttcctgacactgtacaggtgtcatctgaggcaaaagagagatcattggaggcaaaatcgagaggtgatgatgccttcagaaataaagactacctagtagcagtagatgcctacacacaggtaagaaccaaaccgcaagacagcgtgtatttttagaaaaggcgcataagtttatcatatgaactcaaattcaaagagtagaatggaatggaactacatttcaggctattgagttaaatccaaacgacgccacgttgcattcaaacagaagcctttgctggctacgggcagggcaagctgaacgtgctctggaggatgcaagagcatgtcgagcgctgaggccagactgggcgaaagcttgctacagggaaggcgcggcactgcgcctgctgcaggtctgttgatttcagtgataagtttgggaactgataggcagttgtgattacctacctatatatttgttgctgaagttgttccggtgataccaacagaggttcgaagaagccgcgaatgccttctatgagggggtgcagcttgagccagagaacggcgagcttgtgagcgcgttcaggtagtaaagccttcctctgtgagcaaagaaaagcaatgaattcctccgttgtttagcaattaacatagacatatatagggtgtcgttatgattggtttggaactcatgtgtgtatgtgtttgttattccatgcgacaagtgaagttgattacttaaactgattgacagggaggcggttgaagccgggaggaaattccatgggacggacaagaagcaaaaggcagatgcatcaacgtgatgtgtttttggaatggcttagacctatacaaggaggaatcactgaatctgtaccactagattagtattagtttggcttggccaagaaacggagcagctgaaatctgaacacctcttttgatgttgctacaaatttattatattagtatcaattactatcagattgaattctgtttgtgtcgtggctggttctagattcgagtggctaaactgtacccatgttcttcagcatttctttaatctacggtattgagaaattcatatcttcctcatcataggatgattgattacctaaggagctcccgcgtccctctgaactcttggcatgtcaagagacaatggaattgatggcatcacgcatggcattaatcaaagaaaatatcatgagtgaatacacagtactatgacgacgataaggttggggggggggaaatgtttttagagaaaaaaaaactccataacaaagatgttggaaggaagaaaaaaaaatgttgggaggaagaaaagaaaaggtctcagtctatatatatatatatatatatatatatatatatatatatatatatatatatatatatatatatatatatatatatatatatatagagagagagagagagagagagagagagagagagagagagagagagagacgcaatggcccaaagaagaaaaaagcccaataatagtaagtagaaagcccgacacagagacagggcagaggaagaggaaaagctgttcgtctccccaaccccaaccgcgacgaactagggcgacgggccatcgccgtcgtcgccgccgccgccgcagctcgcgctcgctctcctcctctggcgccgttcctctttctcctgcgtcgccccatcgacctcgaccgctcaggtaagcatccgctcgatcccctcgccaactatcccttcaattacctactttttaggacgttaggatttgccatcggaatcgcggtgttgccgcgaatccggtaattgatctctcgcccaccttcctgcacatgcactttttatgcaaagaatcctcctaatagccaattgtctaggcagatctggcagccgaagaaacaaagatagatgatcttgaattaggggatgactcctccttttaaaataaaaaaaatcaagataaatgccactacactgtttgctctgatttaacttggcacacagtcatgcctagtttacagcttcttcttctatgctccatactctctgtcagtatcaaccaagctgtataaatgtttctcatcttccttcacatacaaccagcacaatgtgcttcattgtattatgctaacatatatgatgaacatgcgctttttacgactgcatttcaatacctcctgtgtatgtgcttgctgcattgtgttactacttaagtaaacttcatgctgatgcctcaacctggtttccttttggttacttctattgcagcgtctgtttgtaactttctgttatgggtgactacaccatccagattagcaccaagctaatcgaccagcttgctcgtgatgacgagaagatcaaaaagaaaaccaggaaacccaagcctaagaagactgtcaaacaacatcaacaagagccccaggacaactcaagggaactcccagcttctgaacccaaggctcctcctggctggccactgcagcctcccatgtatctccccgtaacccctgctcctccaccacccccacctgctttttcagagctggaagccatccgtgccgttctggaagagagcgaaaaggttcaggagaagctggataagcagcatgctgggatgcgtgatgaactcatcaagaaatcaaaagacctgcgtgacaaggagttcaagctgccgtaccaaaaccccacgccatgcactgaggagaggtcaaactgccgccagtgttacgtgagcaatgcacaggacccactcaagtgtgctgaggcagtcaagagatttgaagcatgtgttcgcctggcgaggcaaaggggcaacacaaaagttgctcagtagccctggaagatttgtgatgaggaaagaactgatatacgattttgctttgctgtgatgatttaataacctggaattttgatgagacctaagacatatttctacaattctaatggcatcgcaccaggctaggtgaggaagctacagatccttgagtttagggattctgtattgcaaatattgggtaaaaatgaaacatgaattctgggtgtttttctctgattggtatcatgagtgaaagcgttatccatacataatctatgctgttgccatttgcgttttgcaaaacccttattactcgtctgctttttactccctggtttctgttgtggtttagctatgctactgcagcatggttcttcttgtggtatcaatccctgattaaaacccaaccattgatagtcatcttgtgggattgagcattttttttcttactggtaaccgagcaaggcgagcatgcattagtaactgtttagtactgcattgttggcttctccaacaagatgtcttggtgtaaagataagatgtcgaagaactttatggtgtagtagtttcagaagtagatatctgatatcataatgcactattacagtcagtcttaagcattcatggatgtttaagatgttagtctttcagaaatcagaatcacctggatggagtaccttaatttgcctggcttacaatctagaatagtgtttttgcttgtgaaatggtaggtaattatggagacctaagagatggattccatctgtgtaggagttggaacttggatttcttttttgctataatactgtctatgttgctgctaaaaataatccactgcgtgtaatagctacggagtacaaaagcaagcccaatatttttttcagcttgatcaactaggtacaagatggaaagctagtgcatgtgctgtttgcagctaatgtttaagtaatgtatactccattttacacttgtgaaggtctttttaagtgaaatatctgcggctgtcgtgatgcccgtatatacggtcaaatgtattgaatatcagaaagcgaagggtataaagaaatggaggaaaaaagaaggcaagaaagagatgttgcataaacgctctccattaaataattcagctttcatccgtgacgtttcagatgaaagggcagggaaccaaaaggcaggcaaaggtgtgagtgaggctgactagcatttcgcttgctcttatcatcttaagatgatggccggtaaacgttcctgaccagacaaggccccgtgcgaaaattcgatcaatcaatctatgagtggtaacaggaatctatctgatagtatggtatctgtcaagagattagttacttgttgtgcttgtcagcttcatcctctaggtaaagcctgtggtgcattgcatatgtacaaaacctcagcttgaagcttcagttgggaaaacagaatggtataaaacttcagttcagctgggagtacaaacaggtagcgtataaagtagagtagtacacatatacacacacgcagatggagtggttggatggatggatggatcatgagcagtgatgagagacgtactacgcattagcacttgcagtgtcaacgtaaagttgatggcactggcgccttgcaatttccctgtcctgatggactctctgattctacgcttcaacgactttatgcttgatgtggttatccattattataactaaatgttgttgcaacgcctgtgttaatttgtttgcctgtcatacatacatacatacatacatacatacatacatacatacatacatacatacatacatacatgcatatatttttacacttacaccaccgaatactgatcgcgttgatccatttcatggatgattctgagcacacgcctttaaactgtacaactagctaattgaatcagatcgagaacaggccatccaatgattacatttatacaggagatgataataataacatgagtaataagagtagaggctgaaaatttgggagaatatatgtgccaaactgctcaattaagctagctatgagatctgaatttgatagcagtgccaactgcccatgcatatataatactagtagaaaacagtaataatttaaaacagtcttggtttatgcatggtttgatgtgctgaacatcaaggaagcaccatgtagatagtagaattaatatgaggtaggatatatatggaggaggggagaagacaggatgagcaagaaagaagaagatagagattacagagggcagggcagacgaactgcagaaatgaagaaactaaagaagaagtaaaaattaatcggtggtgatgtgtactccgatgacgatgacaaagagggtgatgagggcgaagtagatgatggagtggacgacgatggacatggcgctggtgtgcaggttgccgaactcgacgaagtggtgcctcccggggagctggatgagcagccccggcgagagcagcacgaacagcaccaccgcgatcaccaccggcccccagtctgacatccttcctaatttcctttaattaatgcttgctttgctttccttccttaatccttcttcctcctatttctttcccgatagagcttccttgttgttgttgttgttgttgttgttgttgttaggagcaggagggtagtaagtaagcgaggcgagcagtagtaggagcaggtaaggtagggtatgcagatgcaaatgactcactcactgtactagtattggcaacgtacgtacagtacagagagaatgaaagagaaagaaggtgaggtgcggttcgtgggagtggatggatggaaagcacagcagagaagagaagagaagcgcaggttattaggctcgaattcgaccggtgcctgctctacactgcaactgcaactgcacttgttgatcatgctttcattgccattccatatttctttctgtaccggttgtatgcggttggtgcggcttcgctttctgttgcacatgctgcttgcgactcattgctaccgtttcctctttctccacataatactcgcagcaaccatctactgctgttacttactatactacttctctattcacatcccatctattaatctatagtattattactatatgtgtatgtattatctgcttatatatctcgttgattgatttcatcctgcacttgcagcgattactttggtcgtcaaagtcatcattttgctgattacccggaattaaggacggactcctgtctatatagcatatatactcctgtcacaataggcagcagtaccatcgctcgtctttatttatttatttttacatttattgataacggacacacaatgaatgaatatatataatttcatgctgagctcaactagcaaactaaactagtaaaaaattaaatgcttcttgcatgcctgagcctgactcagctagtgctcacctaatgacactcgatcttcttttcctttctgaacaagctcaaacgcatttgaagagagcactactgctaattgcgtagtaattgcgtgtgctaattagttgctagtaatagagaggagcacagactgttcgatggtgctatctagctagctgcagcagcaggagctcctccctttttgatgcttggacggattagatagagggaactattacaaccaatctcaagcttgtggctctagtaagtgcttgtgtttcatgtctcgctttcagccttttctttctatggccggaccaaaattgcagcgcaacaggatatacagatcaaacaaatttttttttcttttctttacttttgtgcgttgaaaaagaaaaagaagccgatcaaggtcggatacgaaaccaaaagccacaagtatgtctggaacatatggattgagctatcaagttaagttgtagctggtccaggaggaggagatgaccaaatacaatcgatggagtgacctggatatgctgctgccattcaaaagcagtacctcaatcaataatgcatggacattttcataccagtgcaaaacatagtattcatcatccatatatttttgtcctttatatatatatatatatatatatatatatatatatatatatatatatatatatatatggtgtgttccatttcattaatcccccccttttatgacgcattcgtggtgatcgacgggtctgtgttgcttcatctgaatgaaatcataactacttaacctttgctctggaaattaagatgaaaattattaagccagttcttaaaccaaatcatcagatagatgaattgatgagagtaaagcaaggaatctttttttggtgcctaggctgcttgcacaagaagatatatatctccatcagcctctccaactaaccattaatttaagagatgatataatccaactgcatttgtgagatgagtagagacaacagtagtacattcattatcgatatcaggatggaaaatgtgcagctcagtgacgcatgcaatcagccgagatgtcgtgtcagtgtgctaatctcaggccacctttcgtctggatcgatcgcctgcctaattcacttacgtttctccaacctgttgttttccctcttaactgtaatccgcgtaagcatactgcagaggtcaagcaaagcggctggcagtagcaggcttgagcatttagtttttggttagaatctaacaacatgattaacaaatcgattaactttcttcagctgaaactctgattaagatggaccgagcagctgagttcagtttgttcagatgctacgttatgctgccagtacctttctggttatttaatcattattatgctaggcagataccaaatttaattcagttccgggtggagctagcaacgccacaccacaccacaccacacggataaaattcttggagatttgttcaatatagattgtgaaatactacactctatagatgtgtgatatatcctgaagcttggttgcaggaatagaataggatggatatatggatggtcagtcggttgtactgtgcacataatgtgtagcttttgttttgtagctcaacttaatttgacatccatccagttccaggtccaggtccagggcagtcgctgtgaatggcgatggggcaactacttcatgctttccattaccattgtgccacgcaaaatgccaccaaaattcttcctccttgggaccctgctgctactgtactgatgctgccctgcactcccaatggttttggttgcacttgcagcaattaattaaactgcctctgctgactatatgttattagtatctccctattatagtacgagataactcttgaggtttacaaactaccacattaacaattatattgtgttgatgtagattaattgacacagttttatacaaaatataattgtatctattgaaaaacaaggtaagagttgtgtatgaaatctaaaacatattcttaaaaatctattgtacgcaaaatacaattggacgtatagacatagaagctagtggttgtatatcaaatgtaattctactttcaaagatctattgtatacaaaatacaaatatctatggaaacaaaatatatgtgtatgccaaatccagctcttactaaaaagaaaaagaaaaaaattggcttcgcctaattttgcgtgggaaatttgctagttgtaatttacttgaaatgctatgaatggtgcacttttgattttgctacatatatatgtggaggaagaaactaagtaatgagtaactctgaaatcaattcctttgagtcacaatattatgccaagaattggaaggaacacacaaatagtagtacaaattaacgagctaaggtgagtagagatgatggatggaggtgcatatatactgctatacatatgcaattgagattacctagaagaaacaaagagagagaatcagggagaggagccaaggttgatctggacgccgatggcgacgaggaagatggcgtcgagggcgaagaagaggatggtgtggacgaggatggagacgacgctggtctggaacttgccgaactcgatcaacctgcacttgcctggtatctggaacagaagccccggcgacagcaggatgaacagcacccaagatatcagcaccggaccccagtcctgcatcttcttctccttgctttcttcttcttcctcttcttgcttgcttcttcctgttgctcttcttcttcttcttcttcttcttcttcctactgatgatgatgctcgaggctttcctccttgtgaacgaaccaaccaaccaaggattggatatgatgatgatataggagaggagaggatgctgcctactggagcagtattacattcttctctacatacaagtatggatatgcagctgaccacaaggtccactcgatgaggaatgtgcggtggagatatatatatctacccaccataatgtttactatactacactagtacttgctgcctatagtcccatcacttgaattgcatataagaaaaagattggatataaactcccctattttttttactagtaattattatagcccagtttcctgattaaaaattgtagtattattaacccagattaagctgtgttgttgcaagtcaagtcacagcaacactagcaacagccccgttcgaatgtcctgaaaacggtggattaaattttggattaaagtggcatgcttttcaaactgctaaacggtgtgattcgtgcgaaaactttttatatgaaaattgttctaaaatatcagattaatccatttttaagtttataataattaaaacttaattaatcacacgttattatcctctcattttacgtgaaacacttaatctttaatctttaggagattcaaacaccaccaaattcatcggttatttcctcatcagctgcaagcctgcaatgtagtacttaggtagcatcagctagttctttctacctagtgcagtgcccagtataaggccaaaaccagaggatgtacaaagagcaactgaggggtaaagttttacgtgtcacatcaggaattatataggatgtcgcatggggtgtttggacactaataaaaaaactaattacagaatccatcaataaaccacgagacgaattattaagcttatttaatccatcattagcaaatgtttactatagcaccacattgtcaaatcatagagcaattagtcgcaatctgtgcaattagctattttttaacatatatttaatacttcatgtttgtgttcaaacgtttgatgtgataggatgaattttagggtgagatgtaaacagggccttagtaaatactccctccgtcccaaaaaaaaaaaaggcaaaccctgagtttccgtgtccaactttgactgtccgtcttatatgatttttttttataatttgtattttcattgttgttagatgataaaacatgattaatattttatgcgtgacttgtctttttaatttttttcataattttttcaaataagacggacggtcaaactttgagcacggaaaccagggtttgttttttttaggacagagagagtatgcagcaacaaaaggtattgggaaaggagtaactttagtctgcgtatgcacgaaaagacagacatttgatctttcatgaaccacaacattatttcctgaccctcgacaggtaagaacgttttattccagcgaacaaatagaggattcttctcaacttagaaatcttggcctcaactcagcatgatctctgactgcgcggagaacatgcgataagttcacagcttactatgaaaccaaaaacagcaaagtctccgggggaagaagattagccctctggcacctattagaccactggaagctccccacactcactgatgaccaccttcttcttcgggcggtcccctctgtcagtctcctgcgattcgatcatcttaacgatgtccatgccttcaataacctgcccaaacacgacgtgcctcccatccaaccaaggtgtctgcattcgcaggtagcagtcagcgcaatgtaattttgagtgagtttcgacactagtacacagtgaacatatcagtacagtgttaccttgacagtgcagatgaagaactggctgccattggtgtttggcccagcattggccatgctgaccactccaggtccagtatgaaccactacaaacattacaagacatataatcagcacaaccacaagataagaagcagaaagaacgatcagattaggtcatttgtcagacgtacatttgaagttctcgtctttgaaggtccggccatatatgcttttccctccagtaccctgaaatattcattttttgaaacctactttatccacatgcagaagttgaaagctgaatgatttgatgtaggctaggtcaaaaattcataattcatgaaaccaggcagctgcatgatttaatttaggccatcaatttaaagaaaaaggatttggtgctaatctccttgtaatctagccatgaagtcaataatcactgcatacacattatgctgatcacaaactaccaattcatactcataatgtacatgatgcaaagcagtataatgatctaaaacaccatagggcaagcactgaagtgcataacacaaagttgtataatgatccaaaacacatatataggtcagctttctatccaaaacagcataaagcgctaacattgataaaacaaatcaaacttttttttttttggagaaatagttggctcaatggtgatagatagaaacaaacacatgagctcattcagtgttgtgagtaatgttacactatgtgactttttccaatagagtttgtcagatgaaacagaggaacaagtgcaacataggagtagattataaagaaagtaaataatgaagacatacgttgcccttgtcaaagtctcctccctgaatcatgaagtccttaatgacacggtggaaactggaccccttgtaaccaaaccctttttctcctgaaaaggaaaagggcaatggtatgtgtatcatgcaccaaatctgggtaatcctgtaaagtagtagatgacagaagagaagaaaagcaagaagccctttgtaccagtgcaaagagcacggaagttctctgcggtctggggaacatcatccccgtataggccaataacgaccctcccaacgttcttcccaacagggtttccgatgcttatgtcaaagtacaccttgtttgtgattttggactggaggtccacttcctgcaatgtatgggagaagtttagcaaaactgaaagaataaatttgaagcgtggtatccagttctcccacatagggtaagaataatcgatacttgcgctgttcttttatgtatgatgttaattgaactaaccaacgtcatatattaaaggaaggaggtagtatatcgtaagttaacatctagtggaggaaaacatgaaagcgcatagtgcacatgggaaaggaaaacccagctttcagtagtacagaagggcacacgtgtttcctcacaatgttgcaggcagtcactgatgatgaataacgtgtttacattcggtgcacatacaaggtaagacctgtaagtagcagaaccctatggtcgaggcaactaaaattattaatcagagcaggtgaatacataataaagcattggtgatgataagcctgaaactgcaattttggtagcataaatttcacctggtgatttaaaaatctgataacaaaatttgacatacaaaggcattactagtattagttttaatttaatggtgttggaaggtcgaggtcatctgtgctaacccaatatctcttcctccaaagaggcaacaaacaggggccggtattgcggaggctgattgcataataatagtccagtaaggtggagtagtaaatttgactgatatactactagacaggattacaagaatggatgcggtgcggcaatagaaagatatatgtagggcagataaaagaagaagatccggggacacagtaccttggggtcagcggtggcggaggagacgaagcgcgcgcggctgtgagcagcggaaagcgcaggagtgaaacctccaaagacggccgatgaggggaggcgtgcggtgccggtgccggtgcggatggagaggagcggcgagggggttttggaggcgaggagggcccgctccgccgccggccgcgcgatggcctgcagtgcaaacacaagagaagaaagagcgacgataataagattgagagctcggtggggaagaagaggagagcagaggccatggatgagtgagcttacgagtgtggcgaaggaggttgcgaccgccattgttgatgttgaggaggagaccctttctctctctctcgctcaggtggattgggattggataggtagatagggcattgcactgggatgaatggatggcatttttgcatatgtgtgcacaggaaatacaataatcacacacaccttcttcattgggggaagtactatattttatttttgggaccaaaagcatctgttaaatcaactctatttgtcccaatccaactatttaaaatttatttatttacagtgtctctttctataatatatcggtaagttatcaattattatacaatataccatcggactatactattttcaaaaatacctaaaatacaccatataaggttaatatttgatttatcctaccataagtttcagaagaaaaaaaatgctagtttatgcactagttttaagattttacatttttatatttttttaaaaaaaattatttatccattatatactgcaagaattttttttttgctgtttttaatgtaacttttttcgagaacatacctcatttctaatgtaaattatcttttgcgtaagtaatttctctctcataaaaaactcaaaaatattttttttaaaaaagtgaaaacttgaaatttatatataaactttcatgttgggtaagtaagctacataaacaattcatatttttaaacccttagatgaataaattaattgttaaccttatatgtattttgagtattttttaaaactaggacctgagtaaatatttttcttgagttttaggttataagacttcacattcatatatgtctagatctattaacacatatataaatatggacaatgctaaaaaataagaataggaggtggtattattttttttttggtagagaggggagggggccgcataggaggcaggaggtagtaaaatgggctgatgggcatagtattcacgggggcccatgtaatagatgggatgggcttgaacacacatgtaatgtaacaatagcctcggtcgaggtgaggtggaagaagcaaagcaatctccgtgagcggtgatggcgcagcagtggcgatctctcctcttcctcctcctcctcctcctcgtgcccttcgccgccgccgccgggcaggatgcgccgttcgtggtagcacagaagaaggttgcgctgtcccgcccgggtccaggcgtggagcgcctcgccgtcaccctcaacctctacaaccagggttccgcgtcagtcccctccccatctcatctccctcttcccccagatttagatccacatctctctctccctctcttcactttgttaacctattattgctctatccgcctttccttattgattaattcgcataggtcaaaaacaacgggaattcctactgttagctagacttgatagatagccgcgagcccatgtttccctttctctgtgtaataatgtcaagctgactcacttgttgataacacaaattatcacgctactattgtgcatatatactactcctacatgacatgacatgattgatagtcacatacacacacatcaatcgctaatccatttctccatctatctaaccacactgctattttagggaaggggaaccggaatcctcattatgggggtgtttacatccagggttgtaaagttttggcgtttccgggtattatatagggtgtcgcattgggtgttcggcactaataaaaaaactaattacagtaaaccgcgagacgaatttattaagcctaattaatccatcattaccatatgtttactgtagcaccacattgtcaaatcttagagcaattaggcttaaaagatttcgtctcgcaaagtagtcgcaatctgtgcaattggttatttttttagcctatatttaatacttcatacaggtgttcaaacgttcgatgtgatagggtgtaaaattttagggtgggatctaaacaggccctatattcttcactgccagtgccatcaaccattcatcttctattcttctatcatgttgtttactactctctctctctctctctctcattttttacaggaccgcctatgatgttagcttgaacgacgactcttggccacaggaggcttttcaacttatctctggaaccacatcaaagattgtggaaaaacttgatccgttagtaacaacacttactagttacttatgctttctcacaccaatatttgccctttgacaatcctttttacctcttgtgctttcagtggtgctactgcttcccacaacttcatcttggagaccaaagtgcagggcaagtttcagggctctcctgccattatcacataccgtgttcccacaaaggccgcacttcaggtacatcaaaattttcatacttacacttcaggtactcatgcaatttgatgcttgtcatatgctttgtttcacaagttaaacttgaattttcgtttcgtgatgctttgtttcacatgccatcacaatcgagtgagtatacctttagtattgagcaccggatgagccttttctaaggactgcagtgtgatcgatctcattattccatggatcatagtgaaaggggctaactttgctcagcttaaatagctcattacgaccctagtacttggtgttctaattatcattttcaccatactattcctgcactattctcttcttgagtttaaactgccaattatttttctcaaggaggcttactcaacgcccatgtttccacttgatattcttgctgagagacctccccaacagaagtttgaattggttagttatctcataccatttgctttcattaagagtaaaacctttcctgattcttatgtctcaacgccttacttttttggtgctggtactcaacttatggatatgcaacttttgcacttgacctttccaggctaaggtactgccattgccctctgttttatgtaaacttatgtgttttatctaagtaggaaataggcgataagaaaagaaaaccatatggctagacattgtgatctaatgtgttaacaaacgtcatctgcagagacttgtggggaaatatgggtcgctggtctccgttgtttcctttgtcggtgtgtttatctacctggt

SEQ ID NO: 1255 - DNA, 2689 bp, Oryza sativa
taatatgtttccctgtctcctgaattgctagttcagatcctattctacgatgtactgcggaaagggaccacatgatgcatgttattgaaaattgacactggtgcatcttgtgttctgcaatctgagccttgatggaaagaaattataattctttgagttagaactaaactgaggtatgaatggctttttttttttggtttttcacggtgggccagcgctcaggtgtgtgttggggggaggagcaaggggatgtaaggaggactctgtttttacaaccgtagagataagtactggtaagtatgaatcaatcatcgtcctatttgtgtgctaaagcttggaaagacaagatgatgcagatgcagtacaaaccgcttactactccaaataacatgatgctggggcaggagccttgtggaagttggcccacccaattaactgcacagaattctagcctatctgcccactatcagtcacataggagtaaatataagcagcagctaggggggctaaagaaggaagaaaagcagatagagacctgaatcctcaactcaactgcaaacaactctttcttacacatagcacatactaggcacataggagttactagagatactactaggagtagtagcaatagagcatcaacataggaggcagcataccaatggagagcttgtgtgggcagcttgagcatgaacatgagcagcagctgcaccaatcctcctcatcttcacttctcccctactgcttcctttctgctccagaggctcttcctgtcccaggcttccctgccggctgcagcaaccttgaagagaaggcagcagcagccatggcggcctatgagtatgagagcagcagctgcagctcccttgaccccacctcaatgccaatggtgtactcaccaatagtgctgcagccacaggagtgccctctttcctttgtctttgacaatgccgctgccgctgccggcgacaacaaatgggtgcctggcattcaaggaagttgcccttgttcattgggctcaactcaagatatggtaattaagctcctactacatgtgctatctttgctcgcactttgccatgaaaatgtatatatacaactagatgaaactgcaaaattcagttatatatatattttttttcacaaagtgtttcagcatacatatgttttttttttacctcaaaggtttagcttcttcccacatgatgcatgatatattgaagagttatttgcttggtgatcatctttatctgaaaaaaatgcggcttcgtcctactagtaccaagtggaaatctacccaaaacctggaactaagtgcatatacatatgtaaatgtagcagtgactgctttctgatgcaagtagaattatcattgatgtttaagttgttaacccctttggtaagtgtccaaatatgtatgatgggcccattttatgttgtgttcatgtaatgatctaccttatgtggtcttgccatttaggatgcaagttggggcaagagtagaaagcacaagaggagcaatgtgggcttgaagggacttgaggagaaaaaggcaagaagggtggtactacatcaacatgatgatgatgtgaagaagaaggccaaggaggcagcaggtggggagccaccagctgggtacattcatgtgagggcaaggagaggccaagcaacagacagccacagccttgctgagagggtcactcactcaccagtcttttgttctcttatctgaatcgttgttatcttaattagtagtaacagctgtttgttagtgcccttcacttaactacaggagtagtaacatctgttgatttgttacttataggtgagaagggagaagatcagtgagaggatgaagatgctgcaaagcctggttcctggttgtgacaaggtcacagggaaagccctcatgctagatgagatcatcagctatgtgcaatctctgcagaaccaagttgaggtgctgctatatgtcactcagataagaattgaaatagcgtaattgagcacgtagtatcatcgatggctcttctgctctgtatatgaagaactgattcattcttttgtgctcattcagtttctgtccatgaagcttgcctcccttagccctttgatgtatgagtttggaccgggcattgatatgcacccagatgttcttcgacaggtaaagtaaaatagggaacaatgacagcatcaatccaaacgcaagcaagcatctctgaagaattctgtgattccagttttgcttctgccatgcatgcgatcaatatctctgactctcttagtacttagtattaccttccttgtttgattaagcttgcaaagatgccacatgagatggtgcagtgcatgggccaaatggggagtacaggcatttcactccaaggactaggaggaggacccacaggctttgctcaggtcaagatgataaccatagtctctctgaatctgaacccaatctgcatgactgcatcagatgtgatgtcgcttctcctgtgttgaacacaaattattccaccaagcactcatcaagagtagtaggagtagcagataaggaaggcaatgtgacactgatcatgcatgcgctgtctgtgcttcacctttgcattgcaggatggcagcagccccattaacatggtggtgatgcaagttggaaagcaaggccagcaccagggctctcttcaccagg

SEQ ID NO: 1256 - DNA, 964 bp, Oryza sativa
  unsure (1)..(964): unsure at all n locations
tcctttggttgctggctcagctgtaccatctcctcctgggctccaaaatccacactatcgatatctctgccttcaccgtcaccaagactgcatgcagacagtaccaagacgaggacatgtactgttgctcctcctgcgtttcgcttcattcattcatctgctgctgtgctgttcctccccctcttctgtgtgttgcatctgtagatactctactcccttttcatgtgtttaatactccagaaatgtgcatgtgtgtgtgtgcaatatgcatgccttgcaaatgtgtacttgatgctgccagcctgatcgatatgacttggcctcctgcctccagtcctctcttgtacactgtaccatctctctttatctctgctctgggatccattcaaagcttgcaaatgcaaaagcaaatgtgtgtgtgcatgcacagaaaagtggaatcttttattaggcaacctgatctgacctgacctgctgcttgtactcctatttggacacatgaaaaatgaaaatggtaggagaagcaagggccatatctgggcttgtagccagtgaacattggacttggaaagattcatcaaaaaaaaattttgctttcccatagctgctgctgacccagcacctttcagaattctcagatcggatgcttgtcttttgagttttgagccttgaccaggttaactacatactcctatgcaacttcctttctgcaagctatgttatgtacagtacatctgtacatgtatgacggccgctgtagataggactacagtgctatgttgccatgcatgctctgctgcaccttttgggctgagaattcaatgttgtttaatccttttctgctagggttggtactatagtagggatagcattcacaatgattcatcagctggagccaatattcagnnnnnnnnnnnnnnnnnnnnnnnnnnnnnnnnnnnnnnnnnnnnnnnnnnnnnnnnnn

SEQ ID NO: 1257 - DNA, 756 bp, Oryza sativa
tcatccagaataaatgtaacgcaatgttagttacacccaaaaaagtttcctagcagccctaagtagcaaacacaattttctggatgcaatataggctgatatagtgaaaatattgttagttctaaaataggagaaagagagcccatcgatccatgattacatatgcctactaccatccacactatgttatatacacattcataagtcaaaaggagaaaaaaaactggaaattgtgttgatctgccatggataagccataaaaggcacactggtatagtggtttatctaaaacaaagcaattaccaggagaaagctgtttttccctcatttcagatgttaaaattgcagttgcaagctcttgatcaatgtctgccacctaaacgcaaatagtcagtagaagtacacaaagtggaacagatcattgatcatgaagtccttagtgtgaagtaaatacccatccaagatgctccagaacaaggtcctgatcagatgatgcttgaagtatcttggaggcttcaacggcagcaatttcctcaccagacattttaccaacagaagtttcaagagagtcagtttcaggtaggattgcatgatccttccacaaaccagtgctgtaattccttgctaagatacgccagataccaagggatttggagcacattcctttactgccatataagaatgcaagcgtccgcagatgtccagagtcatccaaaagtgattctagttcctcctgcaccaccatagtatttttat

SEQ ID NO: 1258 - DNA, 1516 bp, Oryza sativa
  unsure (1)..(1516): unsure at all n locations
gagctcggtacccatatagagagagagagagagagagagagagagagagagagagagagagagagacgcattgtcccaaagaagaaaaaagcccaataatagtaagtagaaagcccgacacagagacagggcagaggaagaggaaaagctgttcgtctccccaaccccaaccgcgacgaactagggcgacgggccatcgccgtcgtcgccgccgccgccgcagctcgcgctcgctctcctcctctggcgccgttcctctttctcctgcgtcgccccatcgacctcgaccgctcaggtaagcatccgctcgatcccctcgccaactatcccttcaattacctactttttaggacgttaggatttgccatcggaatcgcggtgttgccgcgaatccggtaattgatctctcgcccaccttcctgcacatgcactttttatgcaaagaatcctcctaatagccaattgtctaggcagatctggcagccgaagaaacaaagatagatgatcttgaattaggggatgactcctccttttaaaataaaaaaaatcaagataaatgccactacactgtttgctctgatttaacttggcacacagtcatgcctagtttacagcttcttcttttatgctccatactctctgtcagtatcaaccaagctgtataaatgtttctcatcttccttcacatacaaccagcacaatgtgcttcattgtattatgctaacatatatgatgaacatgcgctttttacgactgcatttcaatacctcctgtgtatgtgcttgctgcattgtgttactacttaagtaaacttcatgctgatgcctcaacctggtttccttttggttacttctattgcagcgtctgtttgtaactttctgttatgggtgactacaccatccagattagcaccaagctaatcgaccagcttgctcgtgatgacgagaagatcaaaaagaaaaccaggaaacccaagcctaagaagactgtcaaacaacatcaacaagagccccaggacaactcaagggaactcccagcttctgaacccaaggctcctcctggctggccactgcagcctcccatgtatctccccgtaacccctgctcctccaccacccccacctgctttttcagagctggaagccatccgtgccgttctggaagagagcgaaaaggttcaggagaagctggataagcagcatgctgggatgcgtgatgaactcatcaagaaatcaaaagacctgcgtgacaaggagttcaagctgccgtaccaaaaccccacgccatgcactgaggagaggtcaaactgccgccagtgttacgtgagcaatgcacaggacccactcaagtgtgctgaggcagtcaagagatttgaagcatgtgttcgcctggcgaggcaaaggggcaacacaaaagttgctcagtagccctggaagatttgtgatgaggaaagaactgatatannnnnnnnnnnnnnnnnnnnnnnnnnnnnnnnnnnnnnnnnnnnnnnnnnnnnn

SEQ ID NO: 1259 - DNA, 698 bp, Oryza sativa
ctgaaacagaggcacgcacatccatggtttccttgtcttgtaactttgttatctactaacgagccagctttgtttaaatataccacctttcctgaagttgcgtccatgtggagatgcagaatcaccttgatttcggtagcactgaaaaacacaatgttaaaatgtttagacgactttatgcgcatggtttttttaaaaacaaaagcagctgctagaaaaaaaataatagcacaagcagttccagctcatttctcaaagggttaggcaatccaagtaaaccatagatgtccaatatccaagttgctaagcacagctaatttgataatgctgcttttgtacgagagaattcacctgcaatgcattatcggataataatccagagtatgcatctaacaaccaatcacgttttcattcaaagaagtaaatagcaaaccaaacagcaaaattgttttgagttgacataccctgtagcatacaactgagtcatctgggtacatgacaaacagcttggtgccaaggcgagctcgacatgaatcacatatgctctcgtcagttagctgcacatgccttgacctctcctctaatctggtcaaccgtgcatcaaggttcgttgcgcgtgataaattatgaactacctatcaataggcatagagcgaaagagaaaatggtaagtcaaacttcacataaaagatagacca

SEQ ID NO: 1260 - DNA, 670 bp, Oryza sativa
  unsure (1)..(670): unsure at all n locations
agcatgttcctgatgcacgcagaggaggagatcctgaagctccaggcgcaagagagcatctgcctgtcttgtgtgaaggaggtgactgagtacttccatggtgaattgagcagcggcgacgaagggcacatggcgagagtttttggcagtgtgagggagttccttgccatgctggaccgaatctgtaaagaagctggagaggagatgaagagcagcggctggatgatgggtagagactggaatatggctgccccaatgggaatgacaacgccttgagctgcagcaatgctggcatatttgttatgttacggtcatctcatctctttgttactaataattttgtagcatatatgaatggagattatgtttcctagcgtacaatcaatggcacctataactatatgtatgtaatgtactccatcttcttgtataaagtactactagtagcaagcataccggtatggtatggatcttttctattttatcattccttgggtatgtctattttgatgataatgcttagcggtggtttattggttcttgttcttcatctctagcgggatgaataagctcaaaattagacataatttaatggtgaagttttctataggtaggtannnnnnnnnnnnnnnnnnnnnnnnnnnnnnnnnnnnnnnnnnnnnnnnnnnnn

SEQ ID NO: 1261 - DNA, 1131 bp, Oryza sativa
  unsure (1)..(1131): unsure at all n locations
nnnnnnnnnnnnnnnnnnnnnnnnnnnnnnnnnnnnnnnnnnnnnnnnnnnnnnnnnaattagtcgcaatctgggcaatagctattttttaacatatatttaatacttcatgtttgtgttcaaacgtttgatgtgataggatgaattttagggtgagatgtaaacagggccttagtaaatactccctccgtcccaaaaaaaaaaaaggcaaaccctgagtttccgtgtccaactttgactgtccgtcttatatgatttttttttataatttgtattttcattgttgttagatgataaaacatgattaatattttatgcgtgacttgtctttttaatttttttcataattttttcaaataagacggacggtcaaactttgagcacggaaaccagggtttgttttttttaggacagagagagtatgcagcaacaaaaggtattgggaaaggagtaactttagtctgcgtatgcacgaaaagacagacatttgatctttcatgaaccacaacattatttcctgaccctcgacaggtaagaacgttttattccagccgaacaatagaggattcttctcaacttagaaatcttggcctcaactcagcatgatctctgactgcgcggagaacatgcgataagttcacagcttactatgaaaccaaaaacagcaaagtctccgggggaagaagattagccctctggcacctattagaccactggaagctccccacactcactgatgaccaccttcttcttcgggcggtcccctctgtcagtctcctgcgattcgatcatcttaacgatgtccatgccttcaataacctgcccaaacacgacgtgcctcccatccaaccaaggtgtctgcattcgcaggtagcagtcagcgcaatgtaattttgagtgagtttcgacactagtacacagtgaacatatcagtacagtgttaccttgacagtgcagatgaagaactggctgccattggtgtttggcccagcattggccatgctgaccactccaggtccagtatgaaccactacaaacattacaagacatataatcagcacaaccacaagataannnnnnnnnnnnnnnnnnnnnnnnnnnnnnnnnnnnnnnnnnnnnnnnnnnnnnnnn

SEQ ID NO: 1262 - DNA, 454 bp, Oryza sativa
ctatctagttgttataccaagatatttcgtattaaaatattaaccttaagtagttgtgatagcacagataataaatcgattgtattttattgacaagtttattctactggcaacaaatcaggaactagagtggctaaacttcacagtgtgaaattttgaataataatgatgttcaatgcttatattcacctcatctagaggatcacagtcttctttcttcgccaactcttcctcttcagacaaagtagcttcatcatcctgtcaaaaaagatgagtttatagctgtataagaaaaaaccgcaaaaagagtgagatagactaaatcgatgcaaatgataactaatccatgaatggatgtttctagttttgaaagaccgccacacagtcataggatgcagaatatatgggaaatatgaaagcagtgggaaaaacagatgaagatgttcatggtacc

SEQ ID NO: 1263 - DNA, 643 bp, Oryza sativa
  unsure (1)..(643): unsure at all n locations
nnnnnnnnnnnnnnnnnnnnnnnnnnnnnnnnnnnnnnnnnnnnnnnnnnnnnnnnctacatcgttatttttcagagcaatcgcgcaaactggggtagttgtcccagtacacctgcgcactcacgcgctaactctgcctcagcattcagcagccataagcgacagcacttcgccctaattcccctgtagactacgaatcctctcggtacaaaaggactcaaggagacactcttctactccaagtaagccacacggtagaatctcccttcaaggaagacgacgactcccggagccaatcggacctacaggctacagttccctcagcacgatcaccgacgggaagccccccccccccaccccccccaacaatgcggatggaaccgaattcaaatgcaaaaatgcgcgaaaggagaggtgcggagagatgctaccgattccgagaccgaggtggatggtggcgaccagcagctgcccgcgccgatgctcgccttcggttccaacgagtcccccgccgcggacgccatcctccgacgatcgggcggccgccggttcaccgtgaggggcgtgaatgcatgatcggttgggccttggatcgccaggaggttggacttcacttccccaccgttgatgggctggttgggct

SEQ ID NO: 1264 - DNA, 1106 bp, Oryza sativa
  unsure (1)..(1106): unsure at all n locations
gtcctgaataacaagcctgtatgtagtgatgcatacatggaagtaatttggtttcatccaaccttgacgtttctgttttctctcttttgcacttccaaaatatgtcagtattttaaacgcaggacaccatttgagaaattcagtctcccaatttagcataacactagttggcactacaataagatgtggaccccatattcccttctcacatgcaaggtgtgctagcaaggagatggtcataattgtcttccccaaacccatttcatctgctagaattccattcagcctcttttcatacatagcaacaagccagtccagtccaatgtgctgatattctcgtagagaatgcttaagaaggaaagggaattttgtccgcacatttgttgttgagaacgtgttaccccccggtacgtggctgatcttgcagcagctgcagcatcagcaatcacatcactattatctccattggccatcgctttagtatcagttacatcaccctctttagcagtattttcctgtacaataggctctgatgtttctagttgtagaacactaccactgacatgctcaggtcccagcatgcctgcagattcatgatcttcaaatgtgtcattgttgccctccacaatctctgcagactggtcattattcacttttacggtctctgcagactgatctctggtcagtttcatggtatctgcagaaagatccctgtttacctccacggtgtctgcagactcatcatccacaggcatgttggcattgacatcctcaactgatagtgcaggtgaattttccaattctgttgtgtcatcatctgcatagccatcctaaacataaaaaaggcattacaaatggaccacagtaaagcataactgaagaaagaaatagaaattcagcagataccttttggtatcttgcaagaagttcttcaagtgggatctcactctctttctgcagtaacttaacctacagattaaaaaataataataccaatgatccagaactgtcacaagaaatatgtattgcacaagggtgcctctagtacaccatagtagtatgtcttttgtatcagtnnnnnnnnnnnnnnnnnnnnnnnnnnnnnn

SEQ ID NO: 1265 - DNA, 1143 bp, Oryza sativa
  unsure (1)..(1143): unsure at all n locations
cctctcgtgcggcccagccccgggcgccgccaccgccacgcccatccgcccgacccaggcaccttctcctgcgagctacggccatcgccgctccacaacctctcctccgccgcctccattactcggtgccgctccaggaagctcgccgacggcggacgcttccggtgatcttttcacgttttctttttcacctttttcatcttctcttcaccgcttatcaccacctaatcccaattaccatcctttttagatttttcttctcctttcttactcgcattttgtccatccatgaaaagtctctataagattttatactcccaactccaaaccacttcgttgacatataggttactactgctcgtcagccgaccattactgtaagagctgcttgtttgtttgtacagctagttgtctaatcttgatttgcaaaattgttaattaaccttagtttcttttttttttctttgatgcttgggtttaagaatgagtggacttgttgatgtgcatggactgcacggtacaggtcgtttgtacacaggattaaatgctggatttatgagtgagagggatctgagtagagggggataggagtgtatgtggctttgtgcacagggattaaaagaaggttcttgattgttttgtgtctgaaatgaattctgaatctgatccaatggtctatgaatactccatgaaatagcatcaattcaattcatttggtcagagctttcacatggaggcaggcagcgtatttatgggcgatggctgcctctgcctccattactcccttttctggtgcaccaaaccatactaattaaatggtctcaacctctttgtgcataccgaagttaatagtatctgctcattccattttttgcacagttaccacgtacagatggggaaaaaacaacatatttgaagcgctctgtgcaacacggtgcgcacaggccaaaaatacgctgctaaatcttagaaaaacttgatgggggggggaaagaacatgcattcctctactagcatgacacgatgcaaccactttaattcatccctttcaaatcaattaatcagtgttagagagtggaatcattgcgataannnnnnnnnnnnnnnnnnnnnnnnnnnnnnnnnnnnnnnnnnnnnnnnnnn

SEQ ID NO: 1266 - DNA, 425 bp, Oryza sativa
  unsure (1)..(425): unsure at all n locations
nnnnnnnnnnnnnnnnnnnnnnnnnnnnnnnnnnnnnnnnnnnttagcaccaccaacacgacggctcttcacttcgaccaccggcttgatgttgccgattgccagcgtgaacacctcgatgggcgccttgcctgctttcttttcgatctggtcgaacgcaccgtaaacgatacgttcagccaccgacttcttgccgtccagcatcaggacgttcatgaacttggcgacttccacattgnnnnnnnnnnnnnnnnnnnnnnnnncccgcttggggacttcacgacgacgtggcatcttctttccttctctgttcagttgagaaccgcttcggttctccggccaccaactagcttgtcttccaacaatctgagccgggtgaccacttactcgacggtgccagtgcggtcaaaaaagggtaccgagct

SEQ ID NO: 1267 - DNA, 664 bp, Oryza sativa
attcaattcatttggtcagagctttcacatgaagcaggccagcgtattaatggccgatggctgcctctgcctccataactcccttttttggtgcaccaaaccatactaattaaatggtctcaacctctttgtgcataccgaagttaatagtatctgctcattccattttttgcacagttaccacgtacagatgggaaaaaaacaacatatttgaagcgctctgtgcaacacggtgcgcacaggccaaaaatacgctgctaaatcttagaaaaacttgatgggggggggaaagaacatgcattcctctactagcatgacacgatgcaaccactttaattcatccctttcaaatcaattaatcagtgttagagagtggaatcattgcgataactacattctgatttgaggccttgactaccgtgacaatagacaaacatcatgagattgtagtattcgttttcttgatggcacggtggaagatgtacacaaacaaacatagtattcgttatgagtacgtcctgttattagcgagcataatttccttcgattatacgaaagttgatatcgatttagatgatttggtatgattctttgtattcatttcaggtcatttcaggtcttgctggcgacttgtgggctgcccacgatgtgcatatgtgatggg

SEQ ID NO: 1268 - DNA, 819 bp, Oryza sativa
ccactctaaaactacactcttttagggacgaattcttatgctaaaaactagacttatttagggatggagggagtagatgacatgagtaaactgacctcagatactttcaagatagccttcccagtcccagaaggaaccttctcactgtttgaattgtctgttgctgataagatgtgcttgcagactaattcccggaatctctcacagcaatgcacagggtgacggtatcttcctctataaaatgcaccacctggtacagaatgaagagaatcactagccagttcccaaagagggccgtactcatttacagttgcacaaagaacagcatcttcctcagttgtccacgagtctgaagcacaatcgcgagaccataggctcttcttcttcaatctctcaggcttgattaccatgacacgctttactggcatgcatgggacagaaattcggccatcactcttaattcttgcccccgatttgggatcagaatcattaagttcatctttcaacttaagctgcttgccttcaagaaaatgcttaggtgataaggcctcggaactgaaactcgatttaggggctttcttgagcttcttcaggcttctgctattgctgttctcttcctcattggttgacattatcctcttatgcttgttagaatgatggtgtgctgattcatcgctcattagctctggtgagggtgcattgtcatcaatgctcatagtatctactgatgtttcctcaaccataacctctgactcagatgataaacgtcctttcttcaaagatttgaacttcgctgccttcttcttgttcttttttgac

SEQ ID NO: 1269 - DNA, 994 bp, Oryza sativa
  unsure (1)..(994): unsure at all n locations
aggggcgaagtcgtcgccggcgccgtggggaggagtcgacggcgcggcccaccggatctggcgcggcgaagagcgaaggcgacgggtggtgggacggagtcgacggcgcggtggtgcggagtcggcggtggcgcgatggggtggagtcgaaggcggcccggtggggctgagtcgtcgtggcgcgtggggcgcagtcggcagcgccgacgaccggcggtgaagagaaggggaggcgccgggcgctggggcggaggagacgagaaaaaggagggggagtgggccgaataaaataaagaaaagggtaggagaggaaaacagcgcttgtgtttgtgggctgggatgggcttatcttcgcaaagtatcctcagatttcgtaatatttacttactccgtcctaaaatataacaacttatagcttttaaaatttatcataaaatataacttctccactaatattctcttttcaaccaattataaccctacactatttaattttccacctatctctacttatcctccaatactatactcacacatttaatcctaccaactttcttaataaccgtgtccaactctaaaaatgcttatattatgaaacggggggattaagaagtaaccttcaatagaagtagtgtgtcctactcttatatagcatgattttagagcaagttcaatagtatagccaactactagctccaatttatctatagccaatctaatagctcattcatacaatagttacatactacactattaatatctagtcccacctgtcatacacacactatgtcttgaaatccatgctacagctggctacaaatctatagcccactgcccttctttcttctcatttatctctttaaaatatatttacagctgacttttagcccgctgttgtacatgctcttaggctatatggttcatataagaccactgctnnnnnnnnnnnnnnnnnnnnnnnnnnnnnnnnnnnnnnnnnnnnnnnnnnnnnnnn

SEQ ID NO: 1270 - DNA, 453 bp, Oryza sativa
ctacgtccgccgcgcctatatcggcgtcgcagggcagacggcgccggtgccgcggcggcatgcggtgctgcccggcgtcaagaacaagatgggcgcgctgttgatgcaaatcgagccggacagcccggcggcgcgggcaagcctgttgcccggcgacgtcgtgatccggctcgacggcgtcgagatcaacggcgtcgacgacctgatccgcgcactcgatcacagccggatcgaccgcacgttgtcgatggacgtgctccgcctcggccgcctgcgcgcgatcgagatccacccggtcggaagaaagccggcgaagcagtaagggcgaaactgactgcgcgaggcacgcactctctccgctctggttggagagggctgctttgcgctgtggtcaattttcgcatggttcacgcccgccgagcctgattcgacgcactcaacggttgattttgg

SEQ ID NO: 1271 - DNA, 1395 bp, Oryza sativa
taaggtccctgtgtactgcagtgaggataaactaagatgcacatcactcagttcagcaaacggcaagcatgcagatgtggccatgtgggtcattgccagcaataaattacagtccagcttccttgtcgccttcccagcctccaacctttcccattactacagtttattattctatgtatataaatgataaagctgctgatagccttcaatatgggacagaattgtaataagacaactctcatggagtcatgttaatctgcctaattaataaaaaaaagacaagcaaaccttctgttttctctcgtcctttgttgcttggtcaactacacccttattagctctttgagcaatccttttagccatggacagcttccattttctctcagcatcaaactcctgcacaacatttaatattaaccaagccaagggaataggattagtatatcttcattataaaaccatgcaaattcactcagtgaaagaaggatcatgatctgtcaaatgtactaatagcaagtaacctttgccagccaagccatttctccaagaagatggtcccagtgagttttcgtccttcgaggctccccccttggggcttcaagagcctgcacaagataggacaaaacttttcagtcagtgcaatacaaagaaagtgaaaatggatttacatatatacaaaagaacatgacttaattttccttctctaactaggcctgacaaaatcaaaaacagtattatgcaagcgtggaatagaaagaaaaatgtgtgtgaagataagagaaatagtataacaatgatttgcagctactaaacataaataccaatgctaaaagctaaccttctggcgtctggctcttgtctcatgatctaactttgatcgaggaccttttgatgccatctttccgatattttgtagagaactatctcatgtcttggggcatattcagaaaaatcgtatacaaactgtaaaatacatttagtgcatgagataaaaggtctaaacttttttccaaaaaaaaaaagtattacagaaagaagagaaataaaacagtgaaactaggtcattaagtcatccgtgaatggtatgacatgttttgaactccctacgaattgtccaaaacatctattcacacgtttcaacgagtacccaaaaccaaccatgatcatcatagtcacaatgcaacattaataacccctaataaccaacagagcttattgacagtatctgagcttatacagcatgtgacaacatgaaattcctaacagtacatgttggagttacctgcaaaaacaatatgtagcagaaggcaaattgcacctcagagcaacactagtcaaatgcactgaactcatgttaagtcccatcactctttggtcaaactgattggtcgatcg

SEQ ID NO: 1272 - DNA, 1793 bp, Oryza sativa
caacgagtcacgtcaacaaaaaaacaccctcaaaaccactaagggagtcatcttgcattggttttaatagttatgggtcaagatatctgatatagtagttaagagatacaaattagatcggaccttcaatcatcaaacccaactaatgaaggaaacggtccatttcgcatccctaatttgagtttgcatcactcaactataaaattaggtaagagtatcctctaacttttaaaatcactgcaaatcgagtccctcgactaatttgaaagtggtttttgacctatgtaacctctacttggcacgttggcatagtcttaatctaacatggcacttgtggtaatcacgaaactagaaaaaaatttaaaaaattttaaaaataaggagacccaatgtgagtcgtagttgtgccataatttttctaatgaaagatgtaggactcatatgtttcacatggaaaaaaaatataagagtaaatttcacaaagctataaatactttgattaaattatcataaaactacatatttaaagtgatgtatcacaaaactacagatctaacaataaatttatgacaaacctactggtttaaggctaagtataaaaaagatatagatttgctgatgaaattatcgtaaactacagattttggggtttaaatcctcagcactaatgctatgtttgagttatataagtccaacttctgttattaaattgatatcaaatctatagttttgtgatacttagtcttaaacatgtagttatgtgataaatttagtgctaaatctatagttttgtgatatatcatgttaaacctgcagtactgtgataatttactcaaaataaaaaaaacatctatacaattaccacttacatgtggatacgagtcctattatatattttttccttggctgtaattacatgtaagcattacgtcggataaggactaagttaatctgtcatgtagccgtaggatgaaagcgccgtgtaaactaccgagggacttgatttacattagttttgataatcggtaacgctctatagccggttttgcgctaatggacacgaatgaagctcaatgcatagccaagataattagggtgtgtttgcataggctggtttccaacccggaacagtaacacggaaaactgagcagtcaattagcacgtgattaattaagtatttgttttttttaaaaaatggattaatatgactttttaagcaacttttgtatagaaactttttgcaaaaaatacaccatttaatagtttgaaaagcgtgcgcgcagaaaacgagagagatgggttgggaaaaaggggtgctgaacacacccttaaagtgtactcttccacagaaataataaactttcaactcaaatttggcccagcaatccaaatatggtgagtgctaggcagccaaatagataactcgtctgctactgaaaaataacgatttcatggttttcggctacaagttggatgtgaatccacataccacatttacgcccccacaaacccaagtgggcgcacacaccttatttttctaccacttaactttatttcagctgttcaccgccttgctgctaacaaagggcctatttcgtacagttccaactcctaaatataacttcaggagttgagtctagagtggagttgtgtagctgtctaaagccccgtttggtagggctccaaactccaactcctaactctaaactccaactccagcgatagctagctccggttgaaggtgaaaactcggtaaaagtgtttggctatactttcaagtctagatctgaaaa

SEQ ID NO: 1273 - DNA, 33569 bp, Oryza sativa
aattagagggtagtgggtcttttgggatagagtggagctgtggagcagcaaaaacccagctccaccccgtagttcattttttaggagtagctctgccaactccactccaaaaaaaggtggatctggatcgtttggcacaactccggctcctgataagttggagtgggagctagagctatgccaaacggggcctaaacccagctccacaactctagtacattttgtgagagagcttcacccaactccactctcaattttggtggagctgaaactgtttggctgaactccagctctaggaggggtggagttagagctggagctgtgccaaacaggcccaaagtaacagtgccaccgtgaaggaacagcagtgaattgtaaatagtagaaacaaaacagtactaggcagggaaaatgaagtattattagcactagtatgcgtatcaatcaacagtcggcaatgcacagaagcattgatcagtcactcttgcagaagaaaaaacatgagtggtcagtaacagtcgcgttctcttgttacattggccagaaaaatgtgaaacgatgaaacacaggcgtacatgatagaacaatactgcatctgtaggcgacctcttattctttagtatcgtgtcactatccccccgtgcatgtcctatcatcaacggagacttgtcgtgctaaaccaactcgtcccaatgcaactcatcccctcgaagagtctgcagtctccgtctcaagaaccacgacagcctgccatgcatctatcgagcgcgagcagacggccgattcatcctgacgcttacaccgttgccgccatctgcctgccggccacgccatcctcctcctccccgtcgctccggtcgacgtccaccgtgccactcctgtaccggctcgcgcacacgaggtacacggcgaagtccgcgacggccagcacggcgagcaggaagaagaacttgtcgaggtggccctcgttaaggtcggcggggatccagccggggcggccgcgcacggcggtggccttggtcaccgcgctcacgatgacgtcgctgaagtagttgccgagcgacatggacatcatgcagagcgcgctcccgaagctcttgagcgcgtcgggcatctccccgttgaagaactcgagctggccgacgtacatcatcacctccgacacgccgatcagcgcgtactgcggcacctgccacatgatgtgcaggtcgctgctcatcgccgtggtggcgccggctttcctgaagtgctcgaccgtgccggcggtggccatgggcatcgcgccgagcaccagggcgaggcccatcctctgcagctcggttgggccggtgtggcggcccgtgagccgcgacacgagcgggcagacggcccgggggtacaggaagatggtggtggcgacggtgaggatgtcgaaggccgacatgctggagggcgggacggagaagcccgggaaccgggtggtgcggcgcatcgcggcgccctgcacgacgaacagcgacgccatctgcgtgaacacgaccgaatagaggatggtgcagagccagatggggaggagccgcaggatgctcttcacctcctccacctgcgtcaccgtgcacagcttacaggggtcacgcggttgggtgcacgtgccaagcttcgggttagcgcccaccaccgccgcacggtccaagaacctgcaatacatggcgagttcagtgcgtgcatgcgtgatcagttcacagctcacaaaaccacacaacactttacctgaaacctttcgtgtgcaggagcttcctcccaccggaatccggcttctcgtcgctctcgtagagtgtcacggagcccggcgactcgccggccttacagttcctgcacgcggcgaacgcgacctggaagatcctgccaaccgggttgccgctggggcggatgtaccggtagcggagcgtgccgccgaggaacagcatcagcgcggtggccgcggcggcggtggagacccagaagccgagcgcccagttgccctcgtcctcgaggaagctgaggaaggtgttggagaagagcgagccgaggttgagcgccaggtagaagtagctgaagaaggagaccttggagtgcgactcggccgggtcctcgccgtcgaactggtcggcgccgaaggtggcgacgttgggctggtacccgccgttgccgaacgcgatcatgtacagcgcgatgtagaagatccccagctccgcgccggagtgcggctcgcagggcacgtgctccgtgccgcacccgaccggcctgatcaggtacagccgcgacgacagggacagcagcgcgaggccctgcaggcaaaacaccgtgacgcgaacgagtcagccgcgtgatccacatctcctgggcgtacgcgcaacgcgaccgcgatgtgccttgggccgatcgaccgaccggtcggcgccaccacgtactactctatgcctctactatatggaccatccactttcgacaccagcatacgtgcagatacaatccacccagtacagagtacaggccgaattaactccactctggacagattctcccgcaccaatcgctgttactttgtacgtacgttcctacgcatctatagaccatcatttcccgtgaaatgggcaatcagaacggaaaaaactggtcactgatgattgcccgaccaacagatcagaccgaagtagctagaaacatgagatcaatcgatcgcaccgagaaaggcgcgtggttttcagatagaactgcggagagagagggatgtgccgtgtggtggtgcttacaaggacaaagatggcctggaatatggcgcaggtcttgtagcggccccagtaggagtcgctgaggaaggcgccgatgagggagaacatgtaaaccgtgccggtccatttgctcacgttgttggcggcgtcgccgttgctctgctgcagcaccctcgtcaggaacaacaccaggttcacgtttaccccgaagaacgccagggttgccagaccctggttcactgcacaacacacacaaaataaaaaggtgtcaaggccttcaagaataattctaaacaaacataaaacgatgcacacatgcaaacagtgcgccgcttaactcccccatgaaagcagcaataaagccaaactgtggtagggcgatatcgtactccacataccctacagatcgatcgatcatttgatcgctatgcatggttgctacatcgtggataccatgtccgatgtctcctacggagatcctaatgtggcgctagtaatgcgtgcgcccgaatcccccgtggcgaggaaccctccagttgtgggcgttgcatggccgatgtcacctcgtcatgcagcattccgcgtaaagacccggcgcctaccgccactttaagcctcaacgtcgagtcacctcagaccgacttgcactgttgcgaaaacacttcactggaaagcccagtcatcgactttgtctccattttttgctggcccgtctcagccgggaaggagatggtgaaatcagcagagttcagcacaaagtacttacgaagaataaggccgccggcgagccatccgccggacttgcccttcaccgccggtgagcccttgatatccacggagccatcgagggtgtactcgcagcatacatccttcggggcgttactcgtctcatcgccttccacgacgatcaccctcatcttcatgtctccgtcgttgccagactgcaaccatcaagttacatgctgtcagttagtttccagtttcatgtgctgccatgtatacgcatggtgtttcatcactgaacatggagacaaaactgaatcttggctacagaccaacaagctacagaaacaagctgaaaccgtgtagctttgctaacatatatgccaagaacgatcaaatcatgagcacgtactaaccatttcttgctcctcctcgggctctcctcaccggtggcctccgtcggctaatgcaacgagaagctctgtgtgaggaagccgagcaggaggaagaagaggaggggatctatggaagtggttgtgtctgagcagagaggtctgggatttatagagctcagctgcagctggctagctggctctgcgactgtgagtaggatgtgcagatcacaaaagggaggtggaggagcgtgcgtgtcttgctcgcatgatgtcacaaacaggtattcttaggtatgtgcatcacaccgagacgtcgcgctcgacgatgactgtcgccgtttttccacctctctttttttttttttatcccgttctcatagcccggccatcgtagcacgcaagagcagccttttcccaagaaaaattcagatcgttcctggcaatctcaagtgtgccttttactcttatttgtggtcggttggtgtggctgctcgtgttctgtttcagtaacttatgtgactttacctggttagataattggcaaacgacgaaaaacttagtgccgagtccagcaatttgtctggttttaatcagggtttatctgcacaggaatactacatgacagcatatatagcccgccgcatctttttcactcgccagtctatttatgcagggtaattgcaagctgctagtcgaccctggaaatgggtgcacgccaaagatgcccctcacgctttctcttggaaatccagaaatggagtggcattctacattagactgctacgcttagtcgtggtcaaccaaccattccttcatataatcacatctgcttgagtaaatgaaggccgagactggaactctggattgtttgcccctgaatatgttgccacttgcctgtgtgaacacaaccgcacgatgattattctacgaggctgtacggaacacgagcctcgtctctactagtagctggctagtgcatcgtcacttcgtcaggtagaaatggcaaaaaagaccgaggccccaaaaaaaaactgaaccgaactaagatcagattattgtcatgttttttcactagccaaaattttaagttgaaggttgtaattgctataattaatgctatctcgatgaattgatacgttatatgatgtttgctactattatcttgtgatgtttaattgataagttaaacatgtcctcaaagaggggaaagtgatgccaaaaaaattgttctcatttccgctaattcttctgtctcttaaaaatagtcacatattctggtcataacctaaaatagtcacatgtaagaactggtattgatttaggttacatgcagcggcagcctactgaccttatgtattggatatccgtagattgaacgggaataaaaatataaactagatgacgtcattgatttgtggatatatatatatgtttaacgatttgtcttattaaaagatttacataatatatagtattatttattttgttgtaagttgttttaagcataatctgtatcttatctatttacacaaaattgtcaaataagataaatagttaaacatatatataaaatagttacagcgttacctacaacggagggagtacaatgcacgagcctagataggcttgcacaagtggcaggtgagtgttactactgtgttagtcccttagagatagggatagcatatttactgccatccatgagtttaagctgcgcggaatggatcgagctagctagcgcgagctatcgtcgctgcatgctccgccgctcggtgtcggaggttgcgtcgacaccagtggactggcgccagtggctgccaatgcgccaccagttgccacactcccttatctcgtgcatgcatttgtcattttcgcgggtttgcgcagcagcgatcgatcgatcgatcggaaagccgttgtttcgggctgccgcctgccgccggctggctctcgccggtttcagggaacagttaacagtgcgcggattgacgtccagggttcttcacagtggccgctgtgctttacagctcaacgtgggctctcttccactgatggcatgcagggtagtgtgacgatacatcatcggccggttgccatcgatcggatcatatatcacacgcacgcacgggcgtcatcacgccggttgaggggtgggcgtgtggtggcgcctagttcgctgtggtattactgtcgtcaagcgttgtcaaatctttgcttctgtttttctctagccactggtggttgcaacttgcaactagaggaggaggctaagagagatcccacatatctcggtcactgtatgtgtcgctatatatattgaactgaatcaatatgcatgccaaggtgtcattcctaaggtcatgtgcgatgtggtcgggacctatagagtttacggagagtgctacaaatcgaaagtctgatattttttaaaatatcggacggtgttgcagcgcatacggagaaatgtttcactgaccaataaaaattgtttcaagaggaatgtttcagtgccgcagagaaatgtgtcattgacaataaaaaattgttttaatataaatgtttcagttgtttgtattttggagagaaatgtttcatcagtcttgagaaaatattttatcaccgggttaaaaagttgtaactagatgcaacacttgaaaactactacctgcaacataaagacaacaatatgtgcaacatcgattaaaaacacaatgaaacatcattccacgacaagatgcaacaaaaagcaaataatgggacgactcgatcaggcggtgggtgaatgcaacagttgaaaactactgattgcaacaaaaagacaataatatatgcaacatccaataaaaatacaatgaaacatcatttcacgacaaaggtgcaacgaaaacaaataatgagacgactcgacgaggcggtgggcagcgatggagccgtcggcatggccggtgaagaggaagaagaggtgtggcgcggagagaggtacacaagcagggcagtgatcggcggctcgttgcacaccctaggctccagctcgagcagcgcgtccacggcgacagagaacacgaacacgcggccgcgggagtcgtcgacggcgaagtacttgatgagcccatccgcgtcctcgtagggcagcgtggtcgccgcggcggagtacacgccgtcccccgagccacgcggccgcgacgaacccctgcggtgccctccggtcaccgggatggcgagaagaaaatggggagaagaagataagacataagagataaggatggggaatggcgaatgggaaatggattggttgaatagttaaatgactgggtcccaccatacgcagccgtccggcattttgttttctatcgaacgtcaggaagcattttcgagagtctaccgtgtgccgaggtaaaatgcgaaagggctaatctgcaaattgccatagttttcttccttatttaaaatggttttacgtagaatgtttttatgggtgtgtttagatcggggtgtaaagttttggcgtgtcatatcggatatatggatacacatttaaaatatcaaacgtagactaataacgaaacaaattatatattctgtctgtaaactacgagacgaatttattaaacctaactaatctgtcattagcaaatgtttactgtagcaacatattatcaaatcatggcgtaattaggcttaaaaaattcatctcgcaaattagtcgcaaactgtgcaattatatattttttctatgtttaatactatttacatgtgtccaaacgttcgatgtgatatgttgtaaattttttccctgggaactaaacacaaccatatcaaaagtacctaggaaaatgtttcacagtggaccataaatatacacttggttcagtgtccagacacttcacacgaccgcgcacaagcatccggccattaggtctaccctgtaaattgtggtaaaacacgcaattgttacaaaacaacttctaaatctgatgcattgcaatcggtatagtcaaagtgagaaagaaaacactagtgaactatttcctccgtttcacaatgtaagtcattctagtattttccacattcattatggatgttaatgaatctagacatatatatctatctagattcattagcatcaatatgaatgtgaaaaatctatcttgatgctaatgaatctagatagatatatatgtctagatttattaacatctatatgaatgtggaaaatactagaatgacttacattgcgaaacggagtactaccccaggacgtttactcctacattgcatacggtcttacatcatgtaatattagaattgtttttctcatttcacatgaccaaaggccatcagcaatgtggatagacaataggacgtcagggcatataagagtttcatagatgctaattaaataagtatggtaaagaatggaaggctctgtttggtaaacctctaactctaaaatttagttttaggagttgtgttcagagtggagttctagagcagtcaaaacctagctccacatctctagttcattttgtgagagcactctacccagctccactcccattttaggtggagctgaaattgtttggctgagctccaggaaagatagagctggagctgtgtcaaacagggccgaaatggattataattctttgagaagatgttttctcctgtcgctcttatatgtcatctaaatagtaaaattatgatagattaatatgtgatatatcactttataaatatgtaagtttaaatttgatccccataagttgtaacaaaaataaccaatttaacttaaactagtacacacaagcatatctatttattttaacttatagaagtcaaatttaaacttgtatatttatggagtgatatattaatatatcttgccaaatataattatcttaattcttcaaaactatttatttgataagcacgatacgatggaacatccctctatgggttaaaagagtttcctgataaaacatgcaattgttggaacaaattggccgaacaatcatggcaagggctcccacccctcattggagagagcctaaggttggatataggagatagtcaaataggaggagaggagggatgagagttagagtaaccatatattcatgggatggattgggatcccccttgtctctggagggccctatctattcattgacaacggaaaattacattattgcccttgactcgttacatgagagtgacattgctctaggggtgttcaatcctctatctactaacttattaaataatagaaaaaaggctccacactttctctcacgataaagaaattctcatattaatcaagaataagaaaaaaagggagtccataataaagtacaatttaaaaatagctgaaatttgaaattaaaaataagtaatattggaagaggaaactagagtccacattggtattcaatttagaaccaagtgaaatttagaattaaaaataaaaaaagtaaaagtaaaggttagagtccatatagaaatacaatttagaaataacaaaatttcaaaatttttaaaaaatattggaaaacaagtctagatttcatatagaaatatagagtgtatttagttcacgtcaaaattggaagtttgattcaaattggaacaatgtgacggaaaagttggaagtgtgtgtgtgtaggaaagttttgatgtgatagaaaagttggaagtttgaagaaaaaagtttggaactaaactcggccataatttagaaataactaaaattaggaattaaaaaaataaggaatattgaaagatgaatttagagtccatataaaaaatacaatttagtaataacgaaaattcggaatttaaaaataaggaatattataagaagagtctaaagtctacataggaatttaaaataaatttggatctaaaataaaaatactaaaattgtagagtttaaagtccctatagaaatgtaatttagaaataactaaaatttaaaataaaaaaataaatattggaagaaggacctaaagtctatatatgaatataatttagaaataactaaaattcggaattaaaaataaaaaagtattaaaatatgagttcagggttcataaaaaatacaattagaaataataggaatttagaattaataaataaggaatattgaaagaggaatttagagtccatatataggagtactatttagaaataattgaaattcaaaatttaaaaataaaaaatattgaaacaagtgttaagtgtttagaatccatataaaaataaaatttataaataatgataatgcggaattaaaaaataaagaatagtggtgtcatggttatggatactacatacctaatagtagttgactaaatctcggcaggacccaccacataccatgtcctatacggaaaccgacttcagatatggagggagttccggataaggaaagacaaccagagttctacatggaaacgacaaggactactcggattgtatccatattggtttccctagttctacttggacaaggggacacctatgggtataaatacaagcccccctaggaggacagggggacagacactcaccatgagacgatcaacacgatcgacaaccaccatgagacgatcaacacgatcaccacgatagggacgaccacctcatcaacacccaacacaatcaacatacaagcctacatacgccaagacacgccgccggatatcgacttcagggataggcatggctattcccctacggtgtctccggataccgtcaggagatacgaaagcgctatctctgatctcgtcgggcacggattcgaggaggaagactaccttgttgtcgactacgagttagaccttcaaactgacatgtcaacaacagttagataggctacccacatattgtactggtgtgattatggtgaataagagcaataccggcttcggccaacaggatgtaaggttattacctaactactcaggggcccgaacctgtataaaaatccatgtctccatctctttacctcagtctcacatatatcctagcaccaacgatccccatactgtccaaataccgtagtcgtgacatcaaacgtcgacaagtggaagtagaggttagagtacatgtagtaatacaatttagaaataactaagatcaaaattgaaagtaattaataactatcacgtatgatcaatttagtaaataatttaaaactatgttgctattttaataataaaatgtgaaatatatatatatatatatatatatatatatatatatatatatatacacacacacacacacacacacacacacacacacacacacacactattatataagaaaaaaaagatacttttcgcgcaatttgcatgggccatcaatagtgtagttatgttattagttaacacgataagagcaggtacaatagtagactataagccaggtataaacatattttaatgagataaaggaagagagagaagagcagcgggctacagatttgtagccagctatagctaggtgtaggactaggtattaatagtatagtaagcaactattgtatgaattgcctattacattggttatagatgattcgtagctagaagttggctatcctattaaacttgctctaaccctaagagtggggtttatccctaacacagtggttaacactgaatgtggaacaatatatatacttaaaaaatcatgtcatcctcactagtcttgagccaacgcttggaaaacaatagtaatgattttcatttgtttcaaggtccaaacctggacctggtacagagtaaatttgacgcatgcaatgggtagactgtagtgtgagaaagaaaagaggtcttccgccctcgcattgcacatgacctaatcggttctactgtacactcgtaacagtagatgcaagatgtgctagctggtgctcgattcggactactggtaactaatgtcatgcgatcattgtccaaggccagtcctaacttaggtctgtgcctgagaagtaagaattgatcacatccacggttgcagggttcggtgagatgaccaatcgatcgatcattgtagatgggactaattatcgctgctgataatgactctcaggcagctgatgggcgccgttcgcgtggtgattaacctgacggcacgccgctgtgcggggtgaggcaatgaactcgtgtaccttcatgctgataataacattttcctgacagtcctggtctcaaaatatcattgcatgctgcttaattcagattgcccgtctttgaccgttaaactaaatgcaaaaaacatggagagatatcacattggacatgctgtcaatcagatgggcgccatacgtttggactctgtattttctagtgtcctggttcactggttctggaatgaatacaattacacaaaccgtcctttgtaatgatatttcgagaaaaataaacctccgctaattatttccccccagaaagctacatatatatgtcttcaggctgaatcaggcagacgcctctgacgaattccacgtacgtcctgatagatcgatactactaacatctgagctgagatagctatggtccaagctttgcagcgcattggcagtacgccagatcgattaaacccagcgaccgtttggaatcctaaagggcatgcatggtcgacggctcaagataaccaaaggttactagctgaacaatcctacccgtcactgcctttatcacgcttaaaaaaatataaaaaccaaaacgtgcctgttcttatagctatactatgaacgatcaaccaatgcaacgtaagtgcacgcacgctagcttactgctactaaccacatgcatgctgcatgcatgccagaatcactatattcactgccgtgccgatgataatacatcaactaacccttcgtgacatgtggttaggccaaaagagacaacccctgatccaatcgatcctccctctccgaaaccgtgcgcgaaacgacacgcgcgcatacatgcacagcaacgcgcggctcgcgagcactggcccgcgcgcggcccacgtacgtcgacagccgaatcccacgcgatctcccggccaggacggtcgcgcgcgcggggaggctaggcttcgggcttcctttttccggttttcccccgcttttctcgcggccgtataagcggaggagaatatcaacgcgcacgtaggtgtacgcccgtactactacgcctctctctctctctcctgtggttggcatatcgctcgcgcgcacgcgtgggctttggctgccatgcatccgccctgtcacgctccactcaacccccccgatcggctatcgcaagggctgggcctacccgatcgtgaccgttccgaggggcacatcgccgtcgaccatccaatgcccacgaccggggcggtcacgcatccatccatccacccccttgtgcagcagcacgacagctactactttggtaggggtcctagctatagctactgctccctgggacgtggtacgcgcttctgctcatggacggatccgcgacgactgtgatgctgccatgctcgcacgctgcgcgctaaagccgcgggccacgcgagaccgcgagagacacgaagaagttgggccaactgttttcaggtttcctggtcacgacccccatgtgtgaccagatcgcgcgcatgcagcatgcacacactccgccggctcggcgagcgtacagagctggctgttcccctgttcctgttggtgcaggcgaatcgattagttggttcgacttccgcgcatatgtgttcattgcacgcgcgggcaatgggcgatggagggactagggagccgcaattcgggagcagggtgtactgtactcgcggtgtacaatggtggcgagcagcgagatcgatctatcggcgcatcccctttctggtcctgcacgggtagacgctcgcatagttcaagcgatcctgacctaccgtttcctctgcacaggtcgtccctttaggctagctaccttttagcagagtttagtgtgtgacagtgtgttccctgtcatatggccgagcttttcttgtgtgtgtgtgtggggggggggggggggggtttacagttgaatgtacccaaatgttcttgtcggtaagccagatatgatgatcgggggaatataggccatccatacgacgacatattgtcaggtgtgtgtatattgtgagtcgttatcacttttgtctgcactgtactagtgatttactcctacgtgtctgcagcgctacatgagctgcattttgcatgactaccatgaaagtgtgtcgacaggtccatatactgtgtatccagattaaaacgtagtagtacgagtgactatgatatttgctaaagaaagcaattgcattgtgctttccaatgcatttgcgcacttttttccttttaagaaaaatgcagaaatgttatctctctctttttttttgtctttttaaaaagacatagatgcgtgcactaggagggctggacgtagaagccttaccaggcatacgtccaggactctaggcgtgcaaatttttcaggtaagctaatccaatcaatctttcctgtgcgttgcgaccagatgagtagcaagcagtgggtgaataaaattgctcgacagtgattacagatcggtttaactaatggggattaggactttccaatcattgctttccttccgatttccctttcgttgatgaactgcaatcactgcacgcctccatattttagcataaaggcatgcgtgacacgcagctacgtttttcaggtaaccaagctcacgctggttaagtgcattctagatggatcgcctgacagcggctgcagcctactttataattcgaaacgacgactgatttatttcaaatcgactttcgctttaccatactttcgtgattaatgaaataaacaacgctaaaaaaatcttctagacctactccagtctgtcactgaaactaaccatagaattcgccttcgatcttctaattatcatcagctacacggctagctcagctaggcatacctgattcttgatgtaaacggtatgacaccgacatacctaattcttctcatactcccgccactttacgtggttggctatattacagagtttacctctcggtctcattctcatatatgctctgaaaaaccaacgtgacgttcctatcattgcatttgcagagggcctcctttagcaggacgtcgcgctccgattgcgcccccactagcgcagctagctaccctctcgatccccgtcgcctttgtccaccacgcgttcgcgcggggatgacgacgaagagtcgacgacggcgaaacgactgcaggggactgtgtggcagctccccgagctgtcgctgcagcgagtccgacgaagaagagatgcgatgctacgaagccaccgaattttcagccagcacggccgtgaactgaccaccgctgctgtccggcgggcagcttgcttgctggctgagaaatgcacgtcttgaaggttgcagccggggctaaagtgccacactggcatgcataaacctctgaaattctgatggctacagccaactaacactgcctccccggcctatggccatgatctttggatgaagcctggctttagtggcttccatgcgatgcagagagagtgagataagccttctcgagataagtagggagttgagagtgactcatgtatatgtgctgtggtaggtctgcttgctactttatttttctccccctgatctaattaatggcttcctcctgtgcccggaaaatgacatggtcgtttgttgttatgtatactgagcatgagcagtgaacatctgaaggattttgacggttaaaaatgcgttcatgcgtcgtggagaaacaactgtagcagctcgttttttccccccaccacttgtctcgaattcactgtaccttgccaccaattcaactttgatttggggtcatgtagaattgaacaacttgagataagtcaacagtggtgactacctggaagcaaattccttggtctgaaatgtcccggggggagagaaacagaatccagtaatatcgtggccaaattttaaggttaggtgtgttccctgcctcttcctgatagcctttttcgattatcagaattcagaaaatgatcgaattggggtagataaacagagctacaattaaactggggcagtgaactgtccaagtttgttacctcgaatcaattttcaacgattaaataccatgattgcttttgacaaaacatgctactagaataaaaatggggcttttgatttgagtgtgtggggactatagaaaatagtgcatgatctgaagactttcagtatcgtgggtgcacaagctccacaaaaaaccttttggataggtcgtacagtgtatgacctaaaaattatctggttcactcctcaacaaaacgtggtctgaagcaacttgccaactcgccccttcagattagtcatgattgtgcagtgtcaactgttgatcacttgttctcgtgcccataaagaaaaaaaatgttgttcatggtcctatgctgtttagtggaccatatcccgaatgtttttcatttcacattttctatgcagagcatatactagtattagaataggctgaatagctatcgtaaggaaatagatgtgaaaatgatacagaaatatcatatggtgattctgtaaatggtattgtcctgtagacactccatgtctccatggcagcggagtacacaaacataaaagcaacggtagtacattacaagtaacaggtgaataaaatgagcatgtaaattagaaaaaaaaatccattttactcgcccaaactaattcaatagaccatttatcctctcaactattttttggctcattttatatatcccctaaactattaaaaatgattcattttactccttaataacatttttttactcattatacaagctgtattttaagctgatattgttagagccatagatgacaccattaccaaagtttaaaaatattttaaaatttttcatggtgtttgctcgaactttagaattttgatgtttaaatcagtttgaagtgctttcaacctatgtaaacagtgagggaaaaaaatcacaaaagaatgttgacgtaaaatatgacttatacagggagaactaaagaagagaggtagcgttggttgggggggatgtgaagtgaaccattttcaatagtgcggggtgtaaaatgagaaaaaaaagtttaaaggggctaagtgctccaatgaaatagttcagggagtaaaatgaactttttttgtaaattaataaggaagaaggaaaaaaagtccttacgaggctaacatagttgaagtaacaacgatttattgttacccaatcagattgtttgtaggtggtggagatgatgcaagatgggggtttttcggcaacaacggttgtggtaattttctatgaatgccagatttttgatgtatgattttgttaaagtctctgtcgagtgttgtaatagggaagccaattgtgtagcacatgttctaggtaatcatgcttttaagtttaagaattcttgtaattgggttgatgaggccccaattttcttgtggaacattccagtgaacgatgtaactatgtttgtagattaataaagcacgctaaatgactttcctaaaaaaacatagttgattgtaatatgttgtattacagtgcaacacactcaagtcatttgtgcgtcagagtgagccgtgtacgtagcgaaaagtgagattgactcgtggcgccgtcctggttgtggtcgtggccagcgcgttggcgcaggtgtgcaacaagtacacgcacatccggggctccgggccatgcgacgcgtaatgattgaagagggcgctgccaagacgccccctgcatctagcttcgccagcctcacccgcttccacttccacgactgttttgtccaggtgagctagctacactaagccatgcctccacacaacggcacggcacgccgagtaggatggtctgacgagcttgggaaagataagtgggggataagagaggaggaagaagaggaggagctgataagtgggtcccacagttttttttaaaaccttagtcatttacatgtggtcccacttcaatttataactaggttgtcacatcaacataggtagatcaagtcaacatgccacgttagcgaaaccaccctaaaaaatatcaagggaatcaaattgtactggttttattattttttttcgtgggggggtcaacatatgcaatattgcgtttgagggatataaatcagattggccctacaattgaggtagttaaattggacttatttcttaagtcatccctagtgatccttacagaaaaagtcttccctagtgactagttagccaattacggagaaattcaccctgtacactgaaatctgcagaaggaacttctatgacatttcaaagtttgagcccggaagcctgcaccagtgtctacagaatatcttggcccaatggaagtggcccatgtgaagagtttcgtttaaggccatgtttgttttagcttaagattattgtaatctaaattattaaatcagattactctaaactggattataataagctgacataaaataagctgtgagttgtttgtttctatagattattacatgcatgtaagggtaatgagtctttagtcacttaataatctggaaaaagctcctccaaaggagattattagattataataatctggcttatagattataataatctatcaaaataatttacttgtttgtttcaatctacttataataatccagattataataatgctaagctgaatcaatcagggcctaagttaaagccaacacataaattaaagagtggatatgccactaagtttgtcacatgtttatgatttatcatttagtcatattctacaatacgctatcggcttttgtttaacttcgacaattcaacatcatcgtctgatgagcctccattactaatgtacaattttatccaaattaccaaaacacccctaagacaaaaagttacaaaatttggatacaaattctgaaatatcaaattttaagtttttgaccaaattttggatgtttataatcttatgtttataatatgatatcttggaatttttgtccaaagtataaagtcaatagcaaatcgcatgtgtctataatgggttctctcttggaagcatttcttcctttttcttccccaaatgaccacatacgttcccccacggtttgtgccccttaattcgtagtaatttcaatagatttacattgaaagcacaccttttcaaatatttatattttgggttatcccttttatgaaaagaaataattaaattgtaagtgagatgtggaagagtcacatccgtcccttagagctaagccatgcctgtgttaaaccatttataaactaaagtttttttaataaaaagtgtgcatcaccataagcatgagcggaacatgagcctttcgtgaaagcaacaggcaacaggcaacagggcaacatggctaatgtcataatgtttgtctgaatcatctaccattttgacttggaaatggagttttggctggttgagcccagggtggatttagacagtgctttagcttggctatggtcgtgtagtaataaaatctatctttacagaaaaaaaaacacgatacaaaatgcttatgctcatatgtacaatttaaatgcacacttacacacatacacacacgacctatttctacgagtgccccctcccttgctctgctggaagccacctcccctacccatcggaggccaccggcggggtgtctagggtcggatctacccgtggggtaacggatccgcacgtaggggtgatagtttcgatcatgacgactggatctggcctgtacaattaccggtcacccaaccacctcgtgtcgtggccgttgaccgatcattgcaccgccatagcagcctcgctcactttgccttgctctacgccatccattgctcgcggcttgctgctatgccgaccgcatctcctatgcgagaaaacgacgctaccatcatggctcgccgtgcggttggtcggtggctcactctgacggcggtgaggtgaaggtggggggctgggggaggtactttggtggctagggtttccaccccgagccgcccgcctggcgggacgacgtgggggttagactcactctatatcatattatcatattataagctgttttaattttttttctcagtcaactttgtttttttaggtttgatcaaatttattaaaacttaataataattataacattaaatcagcttcattaaatctaacattaaatatctttatatattatgtttgttttgtattgaaaataatgtcattttttaaaatttaatcaaatttaaaagtttaaccaagaaaaaaaaaatcaaagtcacttataatatgagaaacggagagagtattccgtttatcctcgaataattgttatcatctcagtatcattacatatattatctactcctatcaatacctattggtaacacaccggccaaaaatcattcacctcgatggaaatctgagaggcccattggatacttaataagctaaactaaaaaccaaaatttgaattttcagacataattttaagttgatcttaaaatatattaacttggtttttttatattagcttttaaatcactaagaaaagatataaattaatttttattttataataaatcattttagttttattagaaaatatgggtaacgagggcctcaacaagaaacaatcaaacactcgtacataccatgtggacttgagaaaaatagtttagaaagtcattccgacaagctaccgttattatttcttcccgtcacaatccaagtagccttcctcctcttcttcctcctctcgcgacggcaacaaacgattcacttccccattatttttccttacgctctccgcctctccgccaaacacgcccaaaatcgtcctgctcctcctccgctccatctactggatccgcgcgaccggcgatctcccccgaacctcgactgatctactggtgacgaaccctaataactcgcttgaatatattgttcggagtttttcttttcctggtcttcttgagcagtagtataatcgatactctgtagcatccatcttcgtgcggatcttgtatgctaaagttctcgagtagtactagcagtttattcatcagaatcatcaggggttgaactgaatccccatgctgtaacgttaggtccgcctcttgtttggtgaatcaattcatacctcgattctttcagggtgtgaatctcatgtactagtattgactagctgtagaaggctattcatagtcatagctttactgttggtctaagtttggtcaacgggtactattcttaggctttcctaccgctgtttctgcgaatggttagcgttgaaacgcagaattgtacaatctttttttgcgaataggttatcaaaccaagttttgatcatttgctggcatctataaagctaaactgacttccttacattggaggttggtggaagagccagcccctaccttcgttagagttccttcaaggagctaactctaatgaggctagaggttgtttcttgtaaggtgataggttggtactagtaaaatatagaatcctttgttcattcttgtccttccatcacagtcgtttctacagtttggaccgctttccaggtaagttcttttactaatgtccagtgttaagaaggtggtttgtttgacggacctcaaatcctcaataaaggaacatttgattctgaatatatagcttagacagagatttgctcagtaaagctaatatcagttgtcaaggcgtattaatttaattttgtgcttactgctaaaataatcagcacaactaatgcatatttagatgttttcaccattctcgcttctacagtccttttcagtggtagaggtgaaatgaaatatagagctagaaagtttcatgtgttcattcttcaacagcagtttaaaaagctttgttgtgttgcctacgtattcttgcatcataatgcagagtttctgtatgttctccttaacacagtacaaaaacaaagcattttctccttggtacagtaatgtgcaaagcttttatgtgttttcaaaaagcggcgcaagaacgaaccatgcctgggcgatgcatgcatgactacagtttgggctattgtggcaggctcagttctctcaaaacttgatttctaaaggaatctttgttattcccgaaacctatatttacctcaattgaccatagatggcaacaaaagttggagcaactgggtcatatatgtatgaaataaaatcagaaggtcaaattctatcaagtcatatgcatgatctcactgagaatctgacaactacctgtgggtcttcttaagttctatttacgcgatcagtcactatgtatgaattccattatctaaaaaaagacacaatgtatgaatatgatgccttgggactgatctcttggttgttggtgctgtattaagtaaatgcgtactgataatttcatcaaagacttaaaatgtttgataaaggtgcactgtgcatcttcattctttgatctgccaaatcagcaattgatgtgttagcttggcactagagctctgggagaatcactagtcaaaacttgctcgtgtttcttggttatctcattcattactatgttcagtacatattatctatttccttactgttgatgtttcaagtcttgagagttaggatgaccccgagacaaagatcaagagttctgacatccttccttttttacatcaaatgtagcctttgaccgatggcatcgcctgcagcgccaacagcaacggagttcactcaggaagctgctcgtcagtctctcattgagatctctcagtccctcccggagaaaccttcagcccagaacctggaggtgaagtcaccgagcccacgtgcagcaaacgaagatcatgaagatggagcagagaaatacagatcaaagctgatctcaatctcctacctttctccggatgcccaaccgacgccgtgccctcccaagaatgtcctcacttaactgtgacgatgctcctactcgtgcgtgtgtggcacagtatatcagtgttatacctcacttttagctggaaagatggaaatggaatacttttgggtgcttatgtttctaaccctaagaaacattcagggggaaaaaaaagaacagatagttgtacagatgactttgtgacgaagaactatttaccaggaacaggcttgcttaatccttgcatgttattttgttgttgcataagcttagttgtttccttataatgtatggttattcgaagtgctacattttgccctctttcagagtgaaaataaaaatctcttgcggttatgaacgacctgctatgaaacgaacactggcacgcagtccaattgctaaccttgttggtctcttccatgcgccattcttggtcattggaagagtatcaagcacaacgactaacctcttgccttatccatctactagtattctttctgatttagttcaactttgttcagaaatacagaacgtctgaacaatttttgtttcgagatttgtaaacttttctgaagaaaagggaggcgaaggctcggttaattcaaaggcccaactcataagaagcccaaccagcccatcaaacggtggggaagtgaagtccaacctcctggcgatccaaggcccaaccgatcatgcattcacgccactcacggtgaaccggcggccggccgatcggcggaggatggcggccgcggcgggggactcgtcggagccgaaggcgagcatcggcgcgggcagctgctggtcgccaccatccacctcggtctcggaatcggtagcatctctccgcacctctcctttcgcgcatttttgcatttgaattcggttccatccgcattgttgggggggggggggggggggggcttcccgtcggtgatcgtgctgagggaactgtagcctgtaggtccgattggctccgggagtcgtcgtcttccttgaagggagattctaccgtgtggcttacttggagtagaagagtgtctccttgagtccttttgtaccgagaggattcgtagtctacaggggaattagggcgaagtgctgtcgcttatggctgctgaatgctgaggcagagttagcgcgtgagtgcgcaggtgtactgggacaactaccccagtttgcgcgattgctctgaaaaataacgatgtagctatgcgattggctgcatagtgcatagctcggtctaaaagtgtgaagtgtgaaagaaggggaaaacccccatgaacaatacacttgttaaatcaattttcttctttaggatttcgttcttctgtttttgctttatcctttgatttagaattttatgtttgggaggttactgaattgataaatcgtaggtttattatggagtttttcttcctcaaggaaaagaaaaactaaaagaggtttggttttcacgagctagagaaatgcccaggggtcttctggctagctccacaaggtggtgggctagacgacctgggtttgaagcctcatcccttctaattatttgatattaggtacttccctaatattcacgttttttttttcacaagccagagcttgtactcagtagtatatacgaagatatatgcttggactccgtgttgaattattccatatatctactttcacttctgaattcatatatgcatccaagcagatatagaatggagtgaattctatacacaccaaatatatttgaatttgtagtgagtgaattctattcataccaaatatatttaatgttaactgaaaatttaattgtgtttgatgtatgcagacatcactttagatgtagagttcttgtgcagagaaatgctacaatttgatttcacagaaaactctgtccccgcttttctattggttattgctataagattccatgttttgcattgtgcatgcagtttttccaatgtcctttttgtactttttgtttgtcaaacttctagtagctcttgccatttttaaatttgaaatgtggtttcattttctttggaaagtttgggcataaatttccaagaaaatatttatcctttcccatcctactctgatggttgttagatggtttcaggtgaatgatgcatataaatactaaacaaacatatgtcttctacggccaaatttctgcaaatgccttctctaattgatctcctggttaatctttagttactaaccatgaatattgcatacagcttccatattcttgtcctttaatttgcaactttcctgcatttgacatcatagtagcagaccaagttttgttctgattccattacttaaatcaaagacttggccacggccaaggtagtatttccaatttctaaaacctctttgttatgtttaatctcagttctacattcattattattgtgcatattttcagagtcatattttgtagccatctgcctgattattgcatgcaaaacacattagtatttgttggaagatattttgcaaccgtaattgacatactggaagaagtcataaccattattgtttccatcgctgtataggttttattttcgcccacccatttgccttccactgtttagggaaaagaagagccttgatctcgccatgttgcatttgctttccttcatccagtggttatctgcatgaagtaacttcgatgcttacaggtgattatgcgtgtgttcctttttcctctattagttgccttggtttttgatattatcagttctgtgatatcgttttcctgcaacttggggcttagggcaggtaggataagactcagaaagcaagtattggcagtgactgaaaggtgtcctttactcttccagagttacatttgttcttaagaaatgaactttctaattgcttgtgtcttatactaaaaagatacttgtctagtttgcatttaggtttttcgtggtacatcatgttgaattccaacaagtgcgtattatattatatgcagaacgagcacttcgtgattgttcgtatggaagctatgttaacacatcaacctgcaattgcgtgcaacagtggtggtcatggaagttgtaaatgcattaatggggtttctctatgaggcctcctggttaaatccttgaaagaatgtctggtaaatgatcataatataacaattttgatgggaggaaataagaacagagcattgtggtgcaggaacaattgctagctcctcagctgctttattcttaacctttaccatcagatggtttgatagcatataatttgacttatcacatacagtatgaaagaattttccaggctagacatcaatttcctgaagttctagacatagctagagagtcagcaacaacaacaatcattacaattcagtcagttcagctattgtgagtaaaccaaattgcatggtacttatgggtctgtccatctttcgtactactaggttgtgtctaatccaggattaggttgctatattttgggatagagggagttcgcattaaatctggacttctagattatgaagttccggacgtaacacttatcaactggaatgattaaaatacctagagaactcacttattaatctctatctatcttctgttattctgccatgctgttaggacttaggatggaccaatatcatctgctattcctgcacctgagctagaatgtcttagaaatgaatatgatactagcttgagttttttttaaaaaaactgtttggtttccttcgtgtcctatctttgttattatgggcatgaatccataacatttcttgagtggctatttctaagtggagttctcttgccgccaatctttttccaatggaaagttgactagctgacagtttattgttctatggtatactattttggtatttataccatgttattttatccaaatcttttcttggatgttccaatgccaaatacttcttatggttttctaattctatatctgggacatccagaatactcataccttgttgtacctgtacggtcttattatgggtagatccctgctatgctatttcacaattaatttgatgttttggcctatcacttcatattattgttcgagacaaaggacaatttgcaaagaaatagttggtgtactattgataaattaatgcaatttatgtttcctccatgtaggttgcataagagcacagttttctgataaaagattttacaaaactgcaaaagttgcaagtcagagactcggagtattactgaagtgagtccaactcttatagaacttttttgttggtggggttcatccttcgaactataccttttgccacctctgggaatcaattatttcccggaaatatggatttgatttcttggttcctgcagctttgctgatcgtaccacaatagatctgctggcttttgcccttcaagacccaagagggctagcttgatggtacatttctttaatctttgttctgaagcaataggtcaattgtgaatagtttcttttctatgctgcaaaaggtgtaccagacttctttaccttctttaacaatgttgtagttctccaaaaggcccatatttctaaacattttcaatcttttagtccatcggtaccccagtccagcgatagacctggcatacccttaccttattctatttacctgtgttggacttgaggaaatatattagtgttgcaatcttttagccctactcccatgttgttttattctactttaatctatggttatcttaatgcagggagactaatcaagtccaagattcctttttcacggatggatggtcccagttgagtggaccttttggtgggaagcggacaaactaaagcaggttcccacttgacaccttaattttcttcaaaacaactttcttcacaagatctcttgccaattaaattgagacccagaggtaaaattaccacataatcgtcactccgaaaaaaatgtcactaacatcgatagttagtcaaaaaaaaacatcgatagttcaatatggctgacatgctaattcacaatctttgtttgcaacccatcattttaattcaactatatatatatttctctttccgagggagtaatatgtgaaagtattccttttcttcgaggtaaaaaaaaaggtaccttatcgtaggcgcaatcaaggattgtttgtttagggcatgtttaattcgcgaaaagaaaatatttgggtgtcacatcagatgtttgaccggatgtcgaaaggggttttcggacatgaatgaaaaaactaatttcataactcgtctggaaaccgcgagacggatcttttgagcctaattaatccgtcattagcacatgtaggttactgtagcacttatggctaatcatggactaattaggctcaaaagattcatctcgcgatttccatgcaaaccgtgcaattagtttttattttatctatatttaatactccatgcatgtgtctaaaaatttgatgtgacgtttttgggaaaaaaattaggaactaaacaaggccttatatcgcttgcttgctgatggagtgatggttgattggtgattggaccaatctatcatttcttcatattggcaattgattcaagtcattcatcgtttttgttctaacaattaataatacatccaaccattcttggtaattttgatttggaaagaaaaatatctacctcactttattaaggattgcactccatctacttcagatactaaatcaggtattgaagaaccacccaaattacacatgaggcagtagaggtgtttttaggtaagacctttatacttatatccttagctctaaaagccaagtctggaaaataaaaaacaactaaacaagccccctaaattgattcaaattaagttttaaaatttgctgcagctcaaattaagttctaaaaaaagaagtttactatagattgtttgtacagctggttttaagtatttaaggacattaacttgaaagtagaagtgttcagtagaccttataaattagaaatagttgatgtcttgaaatttctaggctcatgtttcttgtggtctattagtggtgtaaaagcactcaatccatttcaaccctattgaccaagtgctgtcacgtgggtccaaatatcagttaaagttaaaacctactactacttgccttccacttccctatgtcaagcgaaacaaaattttaattgtagttcagtatattaaactccgctagattcaatagattaggcttgcctcaaagacaaccactgactctctggttgcaaacagtttgtttcccatggcttggttggtttgagcagtgttgtagtaccctttaaaatttttccttgcatgtgatgcgagagagcggatgggaaggtgaaaacgcaggaacagaccctatgacccctgcccctatgcttaggtcgtgtttagttgtttggtcaattttttttaagtatacggacacacatttaaagtattaaacgtagactaataacaaaataaattatagattccgcctataaactacgagacgaatttattaagcctaattaattcgtcattagcaaatgtttactgtagcatcacattgttaaatcatggcgcaattagtcttaaaagattcgtctagcaatttacattgcaaactgtgcaattgattttttttcatacacatttaatgctccatgcatgtgtccaaacatttgatgtaatatttttggccaaatatttttggaatctaaacacacccttactggatcctttgcgttctctcgaaccatatatatccatgctgtctgtgccggatacatgcattgcgcaagaacaacgtgccataaatcattcatactgtgccatcttagcttaacttaatgcttactgtagctcattgtgatgtgactttcaaatctgatatctaatcttaagagcaagtttaatagtatagtcaaatattagctccaaatcatctataatcaatttaatagccaatctatataatagttatctataaacatatactacacttttaatatctacaaattgtgtcttacagtccgtgttatagctgtctacaaatttatagctccctgctcttctctcttctcctttatctcctcgaaatatgtttattgttggcttataatctgttattgtgcctgctctaacattctcgtgctatagtattatagacacatgtcttgactaattttgtctaaattatagcgggcaatttgattaccgccgttttttaagctatacttttatcttatcagttatggcattggccaaactctccacgataattattgcctattggaacctggaacattagtagcgtagattgtactcctttggaggaatcctaacttatggttaaacctcatggaaaattcactttgtgtccatacgtggttgaatagttcttttgttttacaatttctaatgactatagatttgacacttcaactcttgtgttttcctaatcccgtttttaaattcatgagtcccctaacatattgttgtgtgttccacacagcagaacaaagaatcaacctgaattactgaactccaccgtaatagcttaagtgactataatttttcctattttcctgcgcactgtatgctgtaccaacacatatagaagtatctgtttaagccattgacaacaatacatgaagcatcatagtctatgttaaagttagccgtccttcttttgcctgttcagatgctaacaagctgtttcgtcaaagattggttcctacctgtcttccccgcaggtgaagtcgctgttttttttccatgcaactttgcaatcatgcttttgtcttttgcctgttgagattttcagaatggaacttgggggtaagtatcaggttagcagcagaaaacaacggggccgcatttcggcacactgcatccatcaaggaactgttgagtttgacttgccaggtacccctcttcttccagaatccaatgccccttgcccttgaaccctttatttttatttttgaaacttattgaaccctttattagacgtgctttcatttcccgtcttctttcatgtgaaacacccagagaatatcatcaggtcatcaggagcaacttttttttttagggaagtcatcaggagcacataaatgttttatcaagaaagccattttgcatagtataaaaagttcgaaattaactgttaacatatattgtagtaaacgaatgttagcatttggtagtaactgtcattaaaattaaattaatagaattttcactgattttttttctgttttctggatttccttttctagcaaaacttatccttgtgaattctagatctgtagattttttttttggcatttatctcaaatttaatctatgtgaaaggttttattttagatttttgttgctgttcaaatgacttattctaatggatttttacgagatgaacttttattatattagtagtgagctataaaccaactataaacttatgtgtaagagaaaaacaaagaaaatgcatgagtgttggctcttatacaagagaaagagaaaagcttcacattaaattcatagtaagaaaaagattcagacaaaaaatagagcaaactttatagttaatttattatacatattagctctaacatggactaatagctaattgttagctctattattaaacttgctcccatgaaacaccatagaggtttcaagaatttctcttcctcggtgcctctaatattgactgttgccccattcagtagaagagcctacggagttattgcagctgcagctacaactaggcaacaccattctagaccctcttcattactgcacatgcaggactgctcactaacatgtgggaccgatggtcagtggacaatgggacacatattattgttggcttgtaattgtagtaaatgggtagccgaataggccctgtatagaatgatagaataatttttgggagtagattacatgcacgtgaaaatttattaaacttcagtataactatcgttttgttattatatatgggtttagtttaattttgatttaagtttgaatgctttttccacgtaattttgtatatttatgaactgtaagtttatttcatgtttagggtataataatctactgctcaacattttatgaagaaaaaaaaaggttctcttttaaatgagtaagtaatggagtaacggaaaccattgaatcctcatctactccctccgtcccaaagaaaaacaaaccctagtttccatgcccaacatttgaccgtccgtcttatttgaaaaaattatgaaaaaaattaaaaaaacaagtcacgtataaaacattaatcatgttttatcatctaacaacaatgaaaatatgaattataaaaaaattttatataagacggacaatcaaagttggacacggaaaaccagggtttgccttttttttttgggacggagggagtagatgagaacttttaaaaatttcaagcacctgaaatctgatactcccataattctttatttgcgccgtgggccctctcatttatttttttatataatatgtggaaagaatattctatccttatttttttcgctcacaggttttctcttaattaccttttttttctcttttttttcgatggtgcatgaaaatactagtactatcttatactgtcgcttttcctctttctacgagtgtcagatatggtggagttcgagttcccaatgcttcagttggcccgccaaagccatccaatttgccgagacggacaccccgcgcgcgacgccacgccaccgcgcgcgaatttacgcggttgcccctcggtggagtccccttcgccgtaattagcccctacaaggaggggcagtctcggcgcgaaacgttgactcccctgcactcccccaatcccctccacgtcaacacggccctgccacgtcactggcgaactcttcccctgctccccggcgtgagcggagcaggtgcggacaaaacggcccctccaccatactaccagcaccacctgacaatttgcgttctcaccccaagttaaactcgtaattacgtgtagccccctcctaggctcaccatttataggagattttttttttcaatccggtacttgagaagggttggaattaggatttggggttcttccttggtgcctggtaatggctaaaataatccggcctagcgcacggtgcactcacgaacgaacgactgcctcggccagtgggggcgtactggtaagaaaagcccactcgttactcgttagtgctgcctccgcatcatctgcttgctacgctttcctttctcctaagagcattcccaatagaaaccacggtagcagtggtcttatatgaaccatatagcctaagagcatgtacaacagcgggctaaaagtcagctgtaaatatattttaaagagataaatgagaagaaagaagggcagtgggctatagatttgtagccagctgtagcatggatttcaagacatagtgtgtgtatgacaggtgggactagatattaatagtgtagtatgtaactattgtatgaatgagctattagattggctatagataaattggagctagtagttggctatactattgaacttgctctaaaatcatgctatataagagtaggacacactacttctattgaggttacttcttaatccccccgtttcataatataagcatttttagagttggacacggttattaagaaagtggtaggat

SEQ ID NO: 1274 - DNA, 5211 bp, Oryza sativa
catcgaccgcgccggccagctttccggcccgctcgaccccgccgtgcccttctctggcccgctccccgcaaagcctcccaagcccgcgtcctcctcatcgagggggttctcgaggaggttccggaagccgtccttcggcagcctgcggcggagcgtgtcggagaagaaccgcccgtgcgccgtgccgctccgccgcgacgacggcgtgcagtgggcgcacggccgcgccggggaggaccgcgtccacgtggtggtctccgaggatcagcggtggctcttcgtcggcatctacgacggcttcaacggccccgaggcccccgacttcctcgtcaccaacctctaccgcttcctcctccgcgagctccgcgggatcttctacaaggaggccgacgcggacaacaagaagctctggcagtttctcgtggacggcgacgacgacgacagcgagctcgacttctcgggctctggccggttcgcgctgtcactcgacaggctcaaggagagtcggtttcacatgtgggcgcacgccgcggccgacgagagcggcagggaatggggttccaggaggttggcaccggcgcctgcggtgagggaccatgcggcggtgctagccgctctcacccgggccctggcctcgacggaagcggcgtacttggacatgaccgaccagtcaatgggaacccatccggagttggcggtcaccggggcgtgcctgctcgtggccctcgtgagggacgacaacgtgtacgtgatgaaccttggggacagccgtgccattgtggcgcagcgtccggacgatggcgacgatggctgtgtgtttggaaccatgcggcggatggaggacgtcggggtgggcttggagatcgagacaaggcccggcggatgcgccattattgggcttaagccactgcagctgtcgactgatcacagcaccagcatcgaagaggtacattctcgttgacataggggaacaaatgcttacacgtgtttacatgcaattgcctttcttgtatccattggttggcacaatggcacgggcgtatggggatgctcatgtcgttgtttgggaacaatgtgctgacttatctgaatgcgtctgcaatatgactactatcctcttgcacttcaaaagccagaccattgccctttttcacttttgctttttatatttcagtacttcatataactagttatggtaagcattgttagtcgcttcctttttttatcattatttttatggctatgcattaatatcctttgtgttggtctgcaggaagttcacaggatcaaacgtgaacatcctgatgatgatcagtgtattgtaaatgatagagtgaagggtcgcctaaaagttacccgggcttttggtgcaggctatctcaaacaggtaattgtgatactgtttgagtgggtcagccattcttttaatttgattcttatacttacgatgtttgttttgtgtggtatacatatccatcttcagagcaagtgcatttgttgtcagtactttgtacttttaactagaaactatatctgtcatgtgttctgattaatccaatgccctgattgaattaatatagacactagataattcttgatcatagaacttcgtgtatttgtgcaggcaaaattgaacaatggattgttagagatgttccgcaatgattacattggtgatacaccgtatatatcatgcacaccatcgctttgccatcacaagctcactgcaagggatcagtttttggttctttcttccgatggcttatatcagtacctgagcaacgaggaggtagttttgcatgttgagaatttcatggagaggtttccagaaggtgatcctgcacaaagtttaattgaggagcttctctctcgtgcagcaaagaaggctggtaggctctcttctataccatacctcttgcttatttcaattcctgattgattctcgggtggttttttttgtcattgtatataacatcatgcgtatagaattggatgattatgtgcaaacattgatttgcctgcacatgtttgtctcggttgtcaaaacttcctatatcagtccatggcatgtgaggaacttctttatacttttaccaatcattcttgacataaagttctgtttgatgaaatagtcagatactcatgcaactccctcaagtttgtgatttgataaaattctaccagtgtatccttggcttattgcattgcccacctgtatatgagaccaagatacactttacacttttactacatcacaaactccactatggcttagagtgttagagatgattgacattgtcctagcttaacaattatggtttctcgaaactgtttgggccagtgagctaatcagcctgcatgctcgcacacttggagcatctgtccctcttgccaagaaatgaactacagctggattttgcaaactgggtatactgtttttcagcactatgtgtcctaaggtgcaagctggttaagcaaaacaaattttgcattgttggtgtaaagaacaccatggttcagttggtaattttggctctactgtaggatatttttgtattgattgttatgaacaacttgcagtcatcatcattggtacacgtttgtgttgaatatttgaatttcaatagatgaatgtcttgtcgaaacggtttccagttgtctttaatgtcaaatacatgtacctttttttttctcctttctccctcagtaataccatgatttaacttttacttttgtttctttaggtatggatttttatgagttactagatatacctcaaggggaccgaagaaaataccatgatgatgtcactgtcatggttatttctctggaagggagaatctggaagtcgtccggaacatatgtgtgatgatcagttggaacaatgtcgatgtcaatatttatggtgacgcatcaagtgatctcagctggtcagagcctctgagcaactgcatttatgctcatcaggggagaaacacccacagatggctgacagatgatgcactccatacatttgtcaaagcgattggagttggagccagcgttggtctagatcttagcttcagcacaaaacacagtccatgaatgtgctagagagttaattctcggttggaccaagattgcagagagagatgacacatatgaggaatccctttgcaaagcagagttaagaacactttcttttgtgacccgcttagttgattggttacatactcacctgtgacaattccctcacccccctcccccctagctggctagctatgctgcatagagattgacacttctttcatttttggagaaagaacgtctttggaaggcgccgttttcatgttcatgtcaggaatgggaaggaaatgtaatatgattggatattcatggtgaagaaattgaaaatgtgtccctcatgtggtgctcaacatcgttttcgtaaagtcctgaactcctgatagtccattggtattttgcgtgctcgaataattaggacagcagttgttatttgttcggttggtcctatatctactgttgttcgcagttgcctggaatgggccgtggtttttgctggctggatcgatctctcttggtatgggtcgacgccagcttgttttcaaacaaattgcaagtgctatccatttgatgattcagtcaacgattcagcaccgtcgaccagaagatttctaacatttgattctgatttcggtatcggctaagcaagaagtaaaaggcaaacttaacgctccatttggaatgatggcaatttgcatgaatttcatatctgaaacgttttcacttcctgtgtttggcgtaaagctaggtatatttataagtgacactctgagattacaaatgtgtgcactcaattctgaaactgcatgcttgttccaaccggatttcccagctcaattcaactttcaaccgtttgatctgaaatggatagttgcaaccgaactccataagattgacctgcagtcatctatgtaatccattcatccccagtttcaaagtcattgcaaagatcaggtaaaccttgtaacggaggaatcccaagatgaagatatcaaatctttgagatactctagcctatggttggatctttaggtaacaagaaatttacaggagaaatcacttgtacgactagcacgatctcttggcagattagtacgaagcatctgatgatatattataatggctttacgatcggtgataattcttaggatgcattttatatgtgcattagtcaacgtctggaatgattcttagcgatcatgagctgcgtttaaatagtcctttgataaattttttttcaaggatttgaaagccatctgcttgtgacgtacctactggctactgagatacgaatcgcattacagggtcaatgcgaacatgatctgagaggtatagtgcgttccatgtatacttatgcatcctcagatcagagagtttttctattggtgtattgcacgttagctcagcgtacacaattgtgcaaacaaaacataatcacctttctaattattttcgtctgcatcactgcaaagacgtttgagattttcagtacggaatccgttcttgaaaggaaatggtatcttgttcttgacttgtaaatgttaagaactttcggcgtttgacttgagcaagtggtggtatcttacttgtttactccgaggagcttagagcgcgcgcgtctcacttctaggacaggaaacatcgtcgtgcgaagcgctcaaccgcctgcaactaaaatcatatgaactgtaagcaaaagagttcaacaatatacagccttgcaagagaaaagcatgaaaatccttaaaaatcaacaccaataatcggaagatatctgccgtccacacccaaagtgtctgccgtctccatttaacaattcatgatatgcatatcacatttgtcattttcttatgttttttgttttaaattaataccatgcatattgcatagtctcctcctaactactccagtaaaatttaattagtggagatattaggattgcacttggtcatcatttgtcaagtatggccacaaacatttccaatttccatcagatttatggatgtggcatggcatacatatctcgaaaaatactacataatactatatactatgttttagaaaatggaaatgttttgcacgtcacttgaaaaagtccaatttacaggtcacatcaagcttccatgagaccatgaccttctcaccact

SEQ ID NO: 1275 - DNA, 31063 bp, Oryza sativa
  unsure (1)..(31063): unsure at all n locations
tttacaggtcacatcaagcttccatgagaccatgaccttctcaccactaattgcaagcatctcttacctttgactattgacttgcacacttgccagcccatatgcccctacaagtatatataatgagcccaccgtgtcattacttgctcagcttcagctctgtgactgcgacgcgaacccatggccgccatggacgagcctcctcagctattcctctgcccgatctccatggagctcatggaggatccggtgacggtgtccaccggcgtgacgtacgaccgccggagcatcgaggagtggctcttcgtctacggccggaccacctgcccggccaccatgcagcctctctccaacttcgacctcactcccaaccacactctcaagcgcgtcatctcgtcgtggctcgatcgcggctcgtcgtcgtcgtcgtcttcgtcgccgtcgacgtcgacgctgtcgagcccgatccacgagctggcgacgccgctgtcgcgcgcgctggagcaggagcggttgctggctgcgctggccgagctggaggagacgccgttcaaggtgaccaagctgaagagcatgagggcccgcatggcgggcgacgtggcaatgcagggggagttcgtcgcctcgggcggggtgcgcgtggtggggcgcgtgatggcgcaggcgctggcggagagcggcggcgacttctcggcgttcgccgcgtgcgaggaggctgccgcggtgctcgccgcgctcccgctctcggacgaggcgtcggtgcgggtcgtccttgcgccggagtgcatcaggcccgtcatggcgctgctccagcgcggcggcgccgaggcgaggctgcacgccatggacatcctcaccaagatctccagctccggatcaggcggcgactggaccgccggcgtcgacatcgacgacgtgatcaagtccctcctcgagctcctctccgacgaggcctncacgaggctcagctcgcgcgcgctcgacgtgctcctcgacgtcgtggagcgggcgcggggcgcccgcgccaaggccgtcgaggtcggcgccgtgcacgtgctcgtcgagctcctcgccgacgccgacgaccgccgcgtcaccgagcgggtactgctgctgctgaagcggctgtgcaagtgccccgaggggcggctcgccttcgcggagcacgacctgtcggtggcggccgtggcgaggacgatgctgcgcgtgtcggagctgtccacgcagctcgccgtcaaggtgctgtggctcgtgtccgtggtggcgccgtcggagaaggtcctcgaggacatgatgctgaccggcgccgtcgcgaagctcctggggctgctccacgtcgagagctcgccgtcgacgaagcagaagacggtgaggatggttaggatccacggggtagtctggaggcagtacgcgtgcttccctaccgacttcagggactacctcaggctgctcgattgattctttctcccctctctttctgattaccgtggctaagctgtaacaacaaagcagatggaaattgtgtttttttttctggtccctcgaaaaaaagaatgtgtattttttacagaaaaaaatcggaaatgtgttttctcatcacgtacaaaaaaaaagggaacgtaatgcatttcaagtattcaaggatatcatcgagattttcaggcgacatttcccctggttttttcgaacaaaccaatcaagtttgattcggatattatcccccctgatccaaattctagctgttggcaccaccaatctataaattgcggcatcggtattgatgaatagagcttttttacaggccacatcttctagcgataatacgtgacacttcgttcgtttcacaatataagaatttcttacctgtatttatatagatattaataaatctagacacatatataaaacatatacattcatcaatgaataaatgtaagtaacaccaaaaggtcttacaatataaaacggaaagagtacttcttaactccaacacttcgatggtaagttagtgttgcataacaaaatgttcctatgcgtgagcccgttgtctacattcagtctggcttttgtcacatgtctcatacaaccttcatcctaaaatataattatttctaactatgtactctacctagaagtatgtaaaagtatatagctaaaagttgctatattttgagataatggtagtataatattgatgacaaacttagaagttacggttgagtttgctaggagcttgtttagggagcaggaggagtaaattctagagggatcttagatggtcttattgttgaggctgcatttgaaaagaggcattaattagataataattcacgaccttttagatcaggcacataatgcggtaatgcccatgaaaatagagtagagtaggctagacatcctcgtaaattatggtatagtctagtccatgtaagttaattttatgggcttccaccacgaacaataggttgttgggaaccctcagtgagggaaaggagaggctgagagggtgtattgacaatatcaaacaagttataagtgtttaaaaccttatattataactatcgaatctttttaaaaccttatattataactatcgaatcttactttggtctaacaaatataatcatatcgggccatggaaatcaagaaaagtggcaattgatcacttacatgttcgaatggatgaatttatgtgcaaaagaatgtccatatatttccttttaaatcaaaacattctcttaagggtaaatagacgataccacaacaaaagtataccaagcatcttaccctatgtcaagactttatttaattggcaacaacacatgctactcatggtgtaaatctcaacaaaaggaatatcatgttatgagctaaataacttgaatacgaccctacgttaatcattaaaaaaagagtgaatttcgtataaccacatgttctatggtcaaaattgcagaaaactgcatgcattatgacttttgacttgtgacacatagtcacatatttttatggtctaaatgtttcataaaaccccaccttgattcaaatttcaatttgatttatcatatatgaaacaatatttttcaaagtagtaaaaaattaagctaacaaccttaatcaaataggagtagacctacttaaaagcaaatgttttgggacgatggtttttccatgtcttaataggtattgaagtctttcttacttccagtaaaactatgcaactctgtttgccttctgatttttattactagtagcttaattaagaatgaacataattttacataaatttcaataaataacttgaaaaatttagaaaaatacttccttccaataaagtctaattacgtatgcatgactaattgacatatccattatattggtctatctttcatcccaaaagagagaaaaaattgtcttgtttgttaaccaactccacaagactacattggttctgttcttgagaattattttcaggtctacaattattgcattctggatttgggactagtaaaatttcttcaggattattgctgctactactgtttcagatgcgatgaaatttgaaacttctcgtgggggccatcagtccaacaccaaccgagcttacctacaataggcgaccacggaaatatgctctcttgcgaggtccatctcgaaaaagtacacgaaaaagctccccggaagggaagacgacctggggctggttgctcgtgctgcccccgagatctaaccaaaacccgcgtcccatctcacctcgcctcaccttaccatccgacgagcccccggatcaccggctccgacctgtcgccggcggagagcgccgcgggatccaagcgttgaggttggggagcggggtgtgtgtgccaagcgctcgggcgggggcgagcgggcggcgactatgccggtggcggcgtcggccatctactttctcaacctccgaggggacgtcctcatcaaccgcctctaccgcgacgatgtcgggtgcgtagtaccgttcgcaatcattcccccctcgcctcggctagtcgtctcgccgcgcctactgggcccgcgccggtagtggtttggagtggtagatctgaggccgttgggatcgattagctccgtttcctagctcgccgttgcgcggatcgcgcgaggtctagtggatagctcgtgaaattccgctcggaaaggcttcgattagcgaacgggatgcggggattgactcgttgcgtgctgaaatttggcccctaccctcaggttgtcgcaataccatgtggttgaatttcggaatggtatctcgttctttagcttgtgattgtggaagctacatgttttgcagcatgaaggaagatgccactgactgaaatactgaataggagaattagttcgatttcaccttggatggctgtgctgtggtggtcgattatctgaaacaattgactttatactatttcccctccacattctgaattcgatgttgtgttgactgaagcatttcatataagctgactgctgcatagctcatatgatctttcctagtggtttactatcgagaaagatatagcaagtggccttgttgtctttaatacgatagccattattttctaagggtgctaaaaatgtaaactaccactaaacattttcggtttgcttgtcttacttaaaaccctcttttttttggtatttggttgcgtgcaagtttactgaccacctgttttgctcattatgtatgactatacaggggaaatatggttgatgcattcaggatgcacattatgcaaacaaaagaactgggtacatgccctgttcggcaaataggaggctgttcattcctttacatgaggattagtaatgtctatattgtgatcgtggttagcagcaatgctaatgttgcttgtgctttcaagtttgtcgtggaggtatgcaatttatatcatctttgaataatttggaataaaataaatataacatgcatacatattacatctctatgatctagatgaatatgaagctcaagaagtcaattgttgttttttccgctagaaatggtatgtctatgttagtgtgttgtagcatagatggctagtctaattcctcaataagtccagagcaaaagaatctattagttactaaagaggcatatgatttttctgaagttacctgtttaataataataataattttaaattgcaatatgccgtcgaaaagtttagacagttttaccatctaatgatggtatgttttgggggcaactagaattttctatcgcttaagcgtaattgcgtaaatggtgatgattttttgaggaaccaaaagttttttttttccttgaatggctacatggtcgatgttccttgttaatcattgctggaaaatactccttaagccctgtttcgatgctttctataatttcttaagccctgtttgatgaggctgactgggcgtagaattagtttaactagttggtagatgtgagtcaataatgaagcttcagttataaattctagacatatatccttctgatacctgcatatcatcctctagtgttttgaacggttttttatgtatgattttttttgtaaattaccaggcagtggctcttttcaagtcatactttggtggtgcttttgatgaagatgctatcagaaataactttgttttaatctatgagcttcttgatggtaagggacatcttatttttggactttgtttcatcaatttgcactgtggatgcttctatttacctgtagaactgtctctctcatctaactgtgcagaaattatggacttcggttaccctcaaaacctctcacctgaaatcttaaaattgtatataactcaagaaggagttcggtcgccattttcctccaaggtgagaaaaatgtgacattgaaataagataaccggataaaaagtcacatcaaatagtttgttgctcatttattttgtgtgaaagcatctgaatcattttttttttgttctctgcactgatagccttcagataagcctgttccgaatgccactctacaagttactggtgctgttggttggagaagagagggtcttatgtacaagaagaacgaggtgcctgttccaaatgccacctccaagtttcatctgtatttggacatattatgcattgctagctagctagcatttctaataatcccagctcagcatagatgctagtaatgtcagaacgctgcatgtatttcgacatgcagaatagttttcatacatattgtcaatgtgcactagattgcctgttacagaagtagtccatactttatttgttgatttctttgttgccattttggttctgcatactttatttctttttagcactttgcatgactctttttagcattgagatacactaatatagtattcttttctcttgaaaggttttcttggacattgttgaaagtgtaaatcttcttatgtcttctaaaggtatttcatggattactatgattttattgtactgctctgatgtttttgttgtccttaatgttgctttgactgatgtttaatgtggaaattgccttctctgcagggagtgttctacgatgtgatgtgactgggaagattcttatgaagtgcttcctttctggaatgcctgatctgaaattgggattaaatgacaagatcgggcttgaaaaagaagctcaactcaagtccaggcctgcaaagaggtatcactttatcaataattagtacatgaagaaaaaaaattgagcatctggtttttctgattagtatagtttatatggtatgtacacaatctttactactttaactgaattgtctgctggtcggttctcctttttcctcaacagcggaaagaccattgagcttgatgatgtcacattccaccagtgtgtcaacttgacaagatttaactcagaaaagacagtcagctttgtgccgccagacggtgaatttgaattgatgaagtaatattatgatccctccttatgcttgtattagttttcccctgtagtgacatttttattctttacttggcttttgaccacaaaattctgttgtagatatcgaatcactgagggtgtaaatctcccattccgggttctaccaacgattaaggaattgggccgaacacgcatggagataaatgttaaagtaagtgtgcatatctgaaattgtgaatgcatgaggccattatcacgttttctgacacgatgaaccttttacacaggttaagagtgtttttggtgctaagatgtttgcacttggtgttgtcgtcaaagtccctgttccaaaacaaacagcaaagactagtttccaaaccacatctgggaaagccaaatataatgcttcaattgattccctagtgtggaagtaagtgcaaattatttctatatagcagtttatctatgagaaagatgttctttggcttttctttttatgggttaggtcttgttctggcagagcataaacataaacctaccaatttttgttggttacggtgtacaaagctgtatccgatgctatattggctcaattttcttactcttgaagagctactccttgccaattttgccacaaatttattagcatgccttttgcactcataagtcttgacacacttctgcaattataggatcaggaagtttcctggacaaactgaggcaaccatgagtgccgaagttgagctgatttctacaatgggggaaaagaaatcatggaacaggccgccaattcagatggaattccaggttaattttacctccttttgaacaaccctcttatcattagcaaaatctgtcagccagttcattttatttttgagcttacagaaaatgcaatgttagagatatcataacagttatgaattaaacttgagcatgcacaagaaaaaaaaatggtattccatcattcgttggcctttgagtatgtttattatccgaggtgttatcttgaagtgttcttacaaaaaaaaacatcttctgcttcattgttatgctgataaaatgtgccttcgagtttggttatcttgtttaaccatgctttctgatttgttgtttctgtaggttcctatgtttactgcttctgggttacgagttcggttccttaaggtacgtgcagggaatgctaatatagaacctttttaacacataccagacagttcagaactcatgttgagatgcatattccaggtgtgggagaagagcggttacaacaccgttgagtgggttcgctacatcacaagggctggatcatatgagataaggtgttagcgatgaagaaaaaagtcccaggtatttggcacggttatttcaaggattcgcggagctttctttctagtacggcgtcatgaatgatcataaagcatgtatattacatatgacaccactttttctttaagctattactttggcaaagggtagagcagagcagacaaattttcctgggttcttgtaatcgttttgacacgggatatctagtatcccctgagtcttgtttgtgtggtagggcatattttcatttgtatatgagaagatggcggtagcgtttgttcttgttgatcaatatacatatactcattggcagtttgtattgctttcttattaaattgatgggtgaattcacttgcagaagcaatgtgtataaacatgtgactcgacggtgctcgagacatcgactcctgaagtatacagtgtcttaacattttttgaggttttttttgcccttttgcgaatgactatttgtgattgccaccggagtccatgcgttttatagggcttacattggtatcgaatcaattttcgtaggaatctgaaatatttcctgcgtttcatcatagtagttgatgggttgagatagagatagagaaaaactgaggagtcagctgatttttatgatagctatttattaagatacaaacgaataaattaattcctacagagttgaaatcaaaaggtattctaaaaaaatattactacacctagtacaaaggtgaaaacttattttagaaaaatattttaagaatagggtagtagcgcatgagcatccgattcgatatggcacgcatctccgtggcgtcgttgacactaacaatgtcgcgtgattcgtacgggagtcgggacagcctcctcttgatctcgtaaaaatattagaacttcataaaataacagaaaacctatacaacgatatcccattagattaggatacccttttatgagatagtatctgattcttttgtgatactagctgtatggtacccgatacctgtaataccatgttacatggtacctataataccgaggacatgaaacctgtgatactcgcaagagaatagttaatatgtctatcccgttgtagtgggatcccgttttatagcagccctcgataataaagttagatagattttttgaactttctttttttctctaatttgcaaatctatttttcgatctcgttttcatgtccaactttaattgtccattttatttaattttttttaaaatctaaaaatataagtcatgcataaaatactattaatactttataatatactaatagcaacaaaaatattaatcataaaatttttttaaataagatgaataattaaagtactattcatgttttattctaatatactaatagcaataaaattattaatcataaaagaattttaaataaaacgaacaattaaaattaaacacgaaaacttatagctacgcttattttggatagagggacttgattggctgagtttgagagtaaaggaaataagaagattaagaagagacgcaaaataaggtgagctattagcgcatgatgaatataactattttaaaattttaaaataaattaatatgattttttaaagtaacttttcaatagagttttttttaaagaaaaacacatcggctagtactcctccgtcctataatataaaggattattgtttgaccactcatcttatcttaaaaaaatttgtacaaatataaaaaacaaagttatgtataaagtaatttgaataataaaataagttaaaaaataaataataattttaaattttttttaataagacgagtggttaatctttatattttatattagggtcaattgcatatttgccatcggtttgaaccggtacggtgaatttgccattataaaaaattttattgcatatttgccaccaaacacagatagaacccaacaaccttgccattagactcacagatcagactaacactgttagaaggttggttttgatgaaaattaggacaatgttaccttgccaaggaaattgaagcaacagagtctttcctctcctttttcttctgccgccatggtgctgctacaacatgttgctgttactgcagtccgaagcagcaagccgctgcagctgcccaagatgcagccgtgctcgccgatgttgtttgccgcagcttcacaagcctctgccgtgctcgccgctgctgcttccgtagcgtcacaaactgccgccgcgccgtcacgccgtggccgcccgccttgctgccccgcaaaatccatccccgccttgctgccttaccatatcctactttattgcaaccaatttttgtttgatttgctcttgatttggaagaagagatgagaggatttggggatgtagtagggttcgaggatagggaagggaatcggccaatcgggacctgcctttctgggagatgggggcttctgcgtgcgagaggggtagggaggggggcaaaacggtcttgttgtgcagctttgtttttcacattagttttatgaattatttttgtcttcttatttgcactagctcaaacggtaatggtaaacggaaggtacacatatcagttttaatggcaaatttgcagtttgcgtttttttaatggctatttcgaattagagggtaagagtagtggtatatttgcaattctccctttatattatgagatggacggagaagtagtttgggaaggtgttttctctcactcaatctcccagcaacgaatagcaacctaggttcccatcgcaactgaccgatccccagccgccgccgccgccgccggcgccgctcaaggaagcgcatcagatggcatcgccgtcgctcagggacgccgtgggcggcctcgaccgcgaccccttcgtctccctcctcgggaagctcatcggcgagtcccgccgcctgcagaacgacccgccggccctcgtcccgcaggaggacctcgtggcgcagcacgtggtcgacgcgctcctcccggtgtccatggagaccgggggcggcccgctcgtcgtgcggaaggtgagctacgccgagggccggagcaacgtcatcgtcgagtaccccggcaccgtccccggccgcgccatctccttcgtcggcatgcacatggacgtcgtccccgccaaccccgacgaatgggtaggttgctatggagattgttctcctgacgctgtcaaaaattgcttctcaagtttatgcttctttatgaattaatgatttgagtggttgcttgatttggtgtgtttctgccggatattttgattttgtgatcttatctaatttcgttgatggttgcctaaattgcatcattctcatatttacgggtggattatcctggtgagtagtgaccttgtttatgtgagctggtgatttctccatagtaataaccgctttgttgtgtggttgttgtaagaaaataataagttgcatgctagcgttgcataagcatattgatagatatgatgggatatagtaatgtgaaaaatggcatattgtttacttccactgtgttgtatactgcaaaaatctttgctcaatttcatgatgtttatttttgctcgtgctagctttgttgcgtcaaattactaaaaggtttacctcaagtaaatttctccttggttctaattggtggcccaaacgtctctacttgtccaggatttcgatcccttctcactaacgtttgacagtgaagacaaggacaaacttaggggccgtgggacaaccgactgccttggccatgtggcgctggttgctcagctcatgaggagacttggtgaggtcaagccggtgctgaaacattcggtcattgcggtgttcattgccaatgaggaaaactcacttatcactggcattggtgtcgatggccttgtgaaggatgggttgctggataagctcaagaatggacccttgtgagtattgtgctgtttgatgcatggagggaatgtccgactaaactaatgtgttgttcgtgaggaatatgtgctgatttggttgtcattgttgtgtggcattgtgaaggttttggatagatacggccgataagcagccttgcatcggcaccggtggagtgattacatggcatctgaaggcaattgggaagctattccacagtggcctcgcacataaggtacctgatttgaacttgtcagaactcagaatagtgtacttgttgtgttatatagctccagtaggttccagcaatacactgcttcgtggaaagaatgcataaagcatatggttcattttctatgacctgtgttcttttaaattgtatagctgcataaattaagcttgcatccttgtagttagtgcaaaagcaacaatttatattgatcaatgccaaattgaaatgacacaaaaaggataaggaaagtgactgcttaaacatgagttatgttgcaacttacagcgtgatcactctgcttttgaaatgttatctgttgcaacattaccccttggattttttttggggggtaaaaagtgcagaacgtgtcttcatcatgctagggaagattcattcgaatattcaattggcttagagggacaaaacaatttcaaacatacaagttgggagacaacaaatattgtatttgtatatgaattacttttcttttgtgtgtgtcaggccataaatgccatggagttaaatatggaagcactgaaagaaatacagactatgttttacaacgatttccctccacatgagaaagagaagctctataagtttgctaccccatctacgatcaaaccaacaaaatggagctgtatgttcaagttttacttgtgttttctaatgttacaactttttagttgtgtttcctaatgttaaagaaaaccactgtgtacaatccatgcaattaacaaatggtgatttgcagatcctggtgggggtctgaatcaaattcctggagaatgtacaatttcaggggatataaggtccaactattgctatatggttcttgaatgcactttaattgtactcaaaagaaaaatggtccaagcttttgttttattatgttcatacattgttataggcatggggacatgcggttggtgaggctttgttcctcccaggggccctaccataaatttgcttggtcatttaggcggtgttcttttctactaaagatgaagttagggcacataaaataagaaagccaatagtgcatgattaattgagttttaattattaaaaacttgaaaaatggatttacatgatattttaaaacaatttcatatagaaagcttaagcacaaaatgcaccgtttagctttttaaaaagcgtgctaacagaaccgaggtaaaatctatgtcttaatcagaaaagaacggggccttagtgttacaatgcagcagagtatcactgcacaaatttttatatgtttgcaggactaggggaaacaaaataatgggatcaccagtatttcacaagtcacaacattcaataaagactgatgcttctgttgtttcttccatatcattgaaaaatagttttttaaattatactgaccatatttttgtacatattacaggttgactcctttctacaggtaaagcccatttttcatgcatggactgttctctctcataattttgtctccacttctgccgaatgttgttttaatttgacagttgcatgttgccattcatacagcacgacatctgtagtgaagaaattacaagagtatgtacatgatataaatgagaacattgaaaagcttcctactcgtggtccggtatctaaatatgttcttcctgatgaaaacctccgaggaaggtgaagcatatatgactttattctcttatggcagtaacagtaaccatcataatttacagattgattatcaattcgccattacttaccattgatcttgctaggcttgagatcactattgatgaagatattatgaatggggtggcctgtaatctcgagtcgcgaggctttcaagcattatgcaaagcaactgaggaaattgtcggccacgtggaaccatattccattactgggagtctgcccctgattagggaattacaggtttgagaggaaactggtgcaagtgttatcttgggaacaatcgccatttaactaaaacaaattcctcttcaaactttgcaggatgaagggtttgatgttcagactgctgggtatggtaagtaccttaccaaaaaactgtttcctgatttctttaggtcatgtcatcaatgaacaattaatggaaaagtctgttaacagtattcacatggttgagagtagtatagattaaattatgtataccgttcattttttgttgagttccacttggcatcctattatattgatatactatcgcggtaaacaagtggaaatgtagacagtgtgctgtaaatgtttatctgatgcttcttctgttcctgtaggcttactcaagacataccacgcaaagaacgagtactgtctattttcagatatggcccaaggctttcaagtatttctgagcatcatttcacagttggaagcagatgtttgagtcttgttttagggaggaaaaaaatgagcgttcactggtacttattcctgttacttgttgctctaataaaggcactcacagtgcaagctacccaaaatgaggaacctcaggctaaggccacacctcctctcccacggtgcaaagatgctttagggtgttcttagtttttcatgtaaacccttgtcatcttctattctagtcctcacatgttttcaaacaacataacatacaaaatttaccactaaacaccctaaaatgtacaaactagtataaaatttctcccccgccctcaatctctccgttccccaatccaccacaacagcgccaacggaagccggcggctccccgacctcttcccagccagtggcttggagggcgacggcggcgtcacgagaactcgctggggccccttctctccctgctggcaacgagggtgacgggggcgccgtgagagctcatcggtccctccacttccggtcggcgatgagggcgcagaggggggcggcggcgcgagagatcactagcccctctactttcggccgacaggccgatgacaagggcgcggagggcggctgcggcgcgagagctcaccggcccctccacttctggccgtcgacgagggcgcggagggcgactgcagcgcgagagctcacagggcccctctactcctagccagggtttgcaaaaccgtcagtaaccgcgcggttaatggaaaagaaaaaccacgataacctccttaaattcaaataaatttaaaaattaatttgaaattttgataaattttacacggtttcgtatggtttgccatggttaccgcgcggtaactgtgtttaccatcggggcgtggtaacctcggcggagggggggggggggcgacgatagatccacaatgccgttgaggctggggacaagacgacagtgtcctcggtctcgtctccacggcgcgggagcggagcacggggacgaactcagcgaagcagagcggagcaagggggcggcgacggggtcggtgacgcagagcgggagacggtgacgaggtcggcggcataggagcgggagatggcgacgaggtcggcggcgcggatcgagaggcgattctcccttgaggtggagccgacgagctcaccggttgccgctgaatcaagtttccctggcgacgaatcgagtaagctcgccagagtgggtctacctcctcgccctagtcctctcctcgttcattcctctccgcccattcctccctagccatcgccatcgccgcgacccaacctgtccccgccgctttttcccgtcctttggcttctcctcttcctcgtcagcacttggcacccggcgagctccaagcctgctcagatcttggcatggcagcgtgggttggcggggacgaatggggaacatttgggagtagcaacagagaggggaccgctcgcactttctttttcaggcatgaggaacccggaccctagctaggaggcgcaaaccttgcaagggcacgagacccacctccttttctcctccacgtcaacaaggtaacgctccacgtaggagcattgtgaaaggcttaatagttctctgctcttggactcagtccattgtactaggaaatcgagctcatgttagagcataagcaatgggtggcttagggtcgtgcccttgctcatggccgtccgacccagttacctttcgcgcctgagccgtctcctctgctaggcacgcgactactagcggggggacacgcccctcggtcacttttcgttgagacggcgtgggggcacgtgttgggtgcgcggtggcctggcgtgtgtccagtggacaccgctcccacccctatattttaccgttccacccctcgccctcgtcgttggaagtaggcaagaggcacacggcagtgaggaggagctagaggaggcgaggtggtggaggagccggcgaatctgcgatgaccccgcggtggcgacggccccacgacggcgacgggctcaccagatccagggccggcgacgaccccgcgatgccaacgggcggagggagagcggtggcggcccggcactcaagatccaacctccgcgtgccgctcgccgtggtggaggagctgttggccaccctgcgcaccatcggcggccccacgaagatccgcgacagcgacgacctcacggcagccgacgacgggagagagaggccgatgggagagagaggccaccccgcgctcccctcgcggtcgtccaccccgcgcgctgctcgcctttcgccaccgtgcaccgttcgccatctatggaggagacgagaagaggagaggaagagacaaggacggcagcgtcggtgggctgatgagccctttagctgggctatagaagggtactttcataatttttcactttgtgggctggagtatctttatcaagtggtctcagattttgaagaacccattggaggtatccttcagtgagagatgagttccctagaaaggatcctcagttagtgaagacactctaagggtggctttggatgtagatgcccttgtaccacgtagaagctcttgtcaatatcgaacaattccattgtgtgtgacaatcaaggatggtgcttttccgctgggccattttcgtgggttgttctgacaatggcccgaacttatgaagtctgacaggcagcatttgttcagtttctcgtttcatgggctgcatacctgatggtcatcctcaatagccaggttgcaatggaaatccatcatcttggtgcacgaaatgggaatatgggatatcactacatcctgggcctagggttaccacatttagggtccatttgattgttagcaaaaacataggaaattagaagattttgatttgtatgaaaaacatagaattttagaagattttaatcgtataagaaaaaaatccaatgaagtcttttgaagcaaaggattaaatcatatcttttccttggagattcgtacggaatgaacaatcctatacgtattttgaagaaaagttagcaagaattctaatatctttttcatccgattcctgcgtttatctcacgtcctaaccaaacaaccatcttgtgtgtttgcaattatctattttgcatttgttttccttgtcaaaaaccttttttttctattttttttgttttttttaatttttgttttctattcgtttcaaatgaacctttacactttataagctcagtaagtcattgacttgtccctagactgtcatatgttcctaagtaacctggatcacaggacgagctaatgttcctgtcccgggaacgaagcatctgtttgttcctaagtaacctggatcaccagatgagctaacgttcatgtcctgtgaattttgttccctgatcgagggtcgtgattgatgtatgggatgagcagggtgttgcacctagcacaaggccaatcgtcatagtaaaaaaactagaatcggtgggtgacccgaccgacctctcagttcactagtcttggcttgggcggtcgtagttcacgtatacatttatgttattattcctttctattcacaaggtgaggaatagtatgatggttagggaatgacgtgttggaaatatagtcatatatcggcatattttaatccaaaatattaagacaataataatgcatgaacaatgtgggatgatctagtgataaaatctaacataacaggagcatgcttaagatagaataagcatcatcatcatacaaagaacgcaatagaattgcgactaacaaagatatcaaaaattgaaataacagtaaacgcagaaggttatacctgtgaatgtccctccgctggattgtgaggctgaaggtgtggaagaaccccacggcctcggcccggcgcgccgcgcgtgtggctttccgatccccacctcaaccggtcaatagggagcctccaataactccctatttaagttgagatactcctcttttaattcccaaggtggtattattatccttaacatttattatgggcctttgagatttaatagaataaatcgggcctagcccatttattctaacatgacattgtcaactcgctagccaatcagtagcgattttgctatatatttgtcgacaaattttctcccaaaaatttgacagatgtaattacagtacaatcgtagtgtaattacgctgtaacttgcatgtaattacactgtaactatagtgtaacttgtatgtaactttcaaaaatctctctgtaatatgttatttcggtaaaatggaggttgtgggaacaaatccttatacatatgtgtgtgccgtgattttttttcttcctcagcaaaacaaatcttgtaatagatataatgatttaaaattacatgaaacttacgtacaagttacactgtagttacatgcaagttacagtgtaattacatataagttacagtgtaattacactacgattgtattacaattacatctgtcaaatttttaggagaaaatttatccccaaatgtataggtggtcccatcagtagtggtttaatgtctggttcacctgaaaaccaactggttctctaaatgcatgtctagcgagttgatttttaggtgaaccagatattaaaccgttactgtttggcagcgagttgacaacgtcattccctaaccatcatgttattgctcaccttgcgagttgactagagcatttgtgcaattattgttcattcatccataatacaaccaagcaggagtggggtttattatcttccgatgacccaacctaaaatatttttgtatttgatttagtgatcatagccccaaaaccccttttgccaaacaccaggtccctcacaaatctatctgtcgactacagaacatcgacaacgaccatcacattgcctcagccagcagacatgttactagcaggataaaggaagaggtggtgaagagaagaggaagggatggagatggaggttctatgttgcctggtcgtgcaagaggcactgactgatagcaaccgagcaggagaacaaaagattgggagctgcttggggaaataagtgaagggggattatgttaacgggccagacaagtccatctgccctagctaacaacacaacgagagaaagggaggagcttggcactagatttgctcgcaccacctcttcttgtgcgagcgtcactcgagttctctggtctcgacgctatgttataccttgccttcttctccaatgtcctctcgttccgatccatcgtccccaagaatgtatatggtcatcgagccacgtccctaactagcatatcctaaataagtagtatacccctgttgtcccatgctttcgaagatgtcgtcccatatttctcgttcctgttcctcaaagcatcaaaccccgcgggagcattagcgactagggttcattccagcaaggataccaaagcaagcgcgcagacgcagaccagaccatttgcgcgcctcgcggtgcagcagcatgcagtgctacctcatctactccctccggctaaaaaaagacaaactctggatttccgtgtctcgtttgactgtccgtcttatatgaaatttttttataattagtattttcattgttgtcagatgataaaacatgattaatactctatgcgtgacttgtctttttaatctttttcatattttttttaaataagataaatggttaaacgttggacataaaaaaccgagggtttactttttttttttgggtacgaagagagtagctgttacgaccacctagcaggctagcagtaacatgtgttgatggtgcgtgcggaatgaacagccgcatgtggcgaaccacgataggacatgacatttcgtttcacgtaccgtacgccgtcggtacgtgcaggtctatcgaccgcgaccgaaaacagccaccagatcgatcgtggtcgtggatcagctcaaccacgtaccagattctctgcccgaccgatcgatcgattggcactacgtgctgttagtcctagcctagctagctcgatagctgcaggggcagcgtcacatatgcacgagatgagagacgcgcaagcgtacactccgtgcactgcccagtttccttcttttgatgcaccagggggtccagggccggatcgagctgcacacgcaccaattaacacgtacaggatgccacagcttttgtaccaaattacaatgtagtagcaaggctcaccagccgcggaatgggttaagctcccgtgcggtccccgacctgggcgcgtcgtcggctagagtagcgctgggtacgcgattgcatgggagtactcaactggtcgggtaattggggcatggatgcatgagctgtttcggttggttctgcggttggctgtgacctgtcacgttttgttgctttgcttggacacatccacagcccctgccacgcattaccccacgactatgcgactgatagaccactatagtgtttttactgtttttacagggcatgcagagacctcgtacgtccttggggttacttacgcatattacttttcgtgatactagtattcaaaaattgagaatggatacatctcaagaaaatgagaatgcatcaagcaatggcggagaccccaaatgaaaggggccaactacagagatgaaatcgatcgcttctagagaaaaaaaaaggaaaatgaatcaattacatcagataatcgttcttaagcatgaatgataatgtgtgcctgagagcacaaaacctctgtttccatgtttgattaatacatgatatataatatatgaccgtcatggacatgtgatttttttaatggaacatttaactatttaccatttttaagacgtggcgtgaataatttatcatttatagtttatgacaagtgggtccaggtaaactgttaaacatcacatctaacattggtaaatagttaaatatctttttaatgggtacgcaatgtttaaaattattttgagcaatgagaaaatattccatgatataacaacggaagaatatataaaagaaaatattttcatatcgctaaaagtatatcaaagcctcttatttatattcgtagtactaggatgagactcatcttataataagttgttaaattttatgccggagggagtgaatagtgataaatgtttcaaaaaaaatagtaatatagtcatataggacgcatcattaattgatgctatgcatgtcctaaaatgtcatctgtctaagatccaggcagtactccctccgtcccattttaaacgtagccatgacttttcgtgtccaaatttgatcatccatcattcgaactttttatgattagtaattttagtgttattagatgataaagtacttttatgcataacttatgttttttaatttttttttaaaaaaaattcaaacaagacgaacgatcaaaattagtttgcttggggtcagaccgccaagaatacatttccttatagttagctgccaagaaatctgaatatccctgactctttagacttagcggtatttacatggcggtcggccaacggaataattaaccttaatggttttcaggctatttttgaccgccaaggacattatattttcttgtagtgcacacgaaaacttatgtctgcgtttaaaatacgacggatggagtacttaactagctagcccctcctgcaaagtgcgaacttaatttatcttaacctgtgtatcaaggaggttccacagaatgacatgtaatcgatgcatgcatggaattaatggatattggacccctctatgtcttaaatatatatgaaaatgacgtggagcattgtagtccctaataatatgccctaaatagtactgtgactatgtaatgccgctaacgtactcagggacactgatactcttacactaatttgtctcaagtactgaaacccaacaccaacagtgcatgctaagcgcctaattaagcatctagccccatgcttggcgactggcagagcgttgaggagtgacttcaccagcttttgctgaccatccagagctagccatgacgatcacgaattcgctgatatatcgatctgccagccagtgtggatagatagatctgcatatatactagtcacgcatgctccttggcagggcgccccccagcgtagggcagtgtacagtggctagcgtctgcctacgtacggctgctgctgcgtgcaatcgagcaatgcatcattgcgtcgatctgcacgatgcatgcatgtctccgctcttgtgccagccagcgaatgtaatggacacgtactatacacacaccattgattgatctcgagcttgtatagtacgtcgtgatcggccgatcgaacgaacgcgtgcgaatcgcatgcgcgcgtgatggccaatggatcatcgatcgtatgcatgcatgcaatgcattcgcgtgactgttccatccaacgggctaatcctttctttcttctgttcctactgatgatatgccacttgccacgccaatcaacgcatttcactgtcccagaacaagggttatagtactgttagcgtacgcgttagggccccaagtgcggtgcatacattattaatgaagaccatctgacatgaaggtactcacgctattagatctacagacccacctctgctcggtcatactgacttgtactgagctctccatgcttcaaacagttctgtgtatggtatatagtatgtaagatctgtctaggaggttacaacgacttacaagttgaaaccccccatactcgtatgcgtgctttaatccaatgcgatgctggtgctttcgtacgcaggagagcaaggaccaccacgtgaccggaaccctctgtttcggagcacggacacgagcgattgtaccgagatgtggcgtacgtatacgttcctatcaacatcaccgaaacggacgtagacgaccaaaaaccagaaggcggaagggtgggtgtggatgggccgtcggctagctcgtcgcatgcgcaccgcgtacgcctacgttatcgagtcagcttccacgcacgtacggttccaccacgaacgaggacagcgcggttggtatacgtcggtctaaccatccaccggtccactactagctcgccatgcatgcagctcatctgtctcggcctagaaaccgggccggggcgcgcgccggtgaacctactacttgctggctgccgcagcgcccccgcccgcgcgcgcgcatatgcgtccgttcgcgtggcaccaaagcgcattgattccatcccttgtctcgcacaggccggagggggggccatccgcgccatgcgatgcatgcatgggcgcgcgcgtctgcctccccgcccgcccgctgcgacgtccctccaaaaaaaacggccggccgggcggcacggtgcgcaactgcacatgcccacgctgcatgcgcctgcgccgagagcgcgcagcccggccggcggcgcgtgtcagcgagggagggaggggtgatggtgggtgagcccggcctgcctgcctgcctgcatgcctcgcgcgcgcaagcgcaaaccgcacacacggcaggcaggcaacagagcgccttgttgttggccgccgggaacgaagaagcccgtgaacgaccgagcgaggccgcgccctcctgcgcgcgcacagtgacgcccgccgtgccggccgggaggatctgtcgttgcgctgcccgcgcgccggcccgcgcgtttcggacgcttgtgcttgtccacacgttcgtcgctcacgaaaaacgtaccgatgcctagtccaagggctgatgttacttactactactactactacaactgatctcgaagtagccggttctggatacatgtagccgtggaccgtttgcaacgtcagatcgagtgcgtacagcgtagcgcgctatatacagtgtgtacagagtaaccgtgtatcgatccaaggacatgggtagcaggaggagcaatacagagaactgactgtaagatagagtttctttctcttcgcttctatacgcagtacaagtattagagcaagtttaatagtacatccaactacaagctccaatttatttatagctaatttaatagtcgatttgtacaatagttgcttactatactattaatacctggtcccacatgttatatacacatcacgtcttgtaatccgtgctgtagctggctacagatttgtagcccgctgatcttctctcctattttatcactttaaaatatgtttatagctggcttatagcctatacctgctcttatactgtactactattgtgttctaagattggaccatgtggtccaatttgtcaggggaatccatgtgacgagcaacgatctcgaaaaccgcgtcacagagcagtgatgggtacaaatctcgggcagcatagacacgaacaaacttgcgagtgtaggtgtgccatgcactcatgcaggcagccgtaaactttttgggacaggtcagtctcaccaaactttctacgagtactttgccagtttgcctggttgaaacgtcgggattttgtcaatttaaatgcatcgattcgtgtgaaatttaggggttgtttgttccctcccaaacattgccaaaccttcttgccaaacctagccaaatatatggcttataaattgatggacacaccttagacatggtttgactagaaaatggttgtatgacacgtgggcctttaaattagaaaactgtggcatgccacaagtttggaagtgaaacaaacatatgtcttaaaaagtgtggcaaagtttgttaaagtgagggagtgaaccaaactccctccgtctcacttacgagcaactatgagtttccgtggctaattttaatcgtttgttttattttaaaaattataattagtattttttattgttatgacatgatagaacatgaatattactttatatttgacttatgtttttaaattttttaaaaaactttttaaataagacggacgatcaaagttgagcacggaaaattatggctgcacttaaaataggatgaagggagtacaactatgtgtttaatatagtactactagtattccctctatcccataaaaattaatctagtactccctctatactcgtaaaggaagtcgtttaggataatgtttaagtcaaatcttatgaatataaattatgaatatctcttaagttgttgagtttaaaaatgtaaaaattatatgaatagatttgtcttgaaaaatactttcataaaagtatacatataccaattttcaataaataattttatagaaacaagaagtcaaaattgtgttttggagaccgtgccgctgtccaaaacgacctcctttacgagtacggagggagtactggatgtgacacattaatttggacatacctctatttagatccgttgtactagaatatgtcacacccaattctaagttcgttttttatgagacgaagggagtacttagagtgggtttagaattgtttttttcttatttttgtaagaaatgtactcgtaattgtgatgttagttttctaaaaaaactaatgggacctggttttcatatgatcctggtaaaactttataaaaagaactgctcatctcgtttggagtacaaaatcctaaaaatgcaagaaaataaaagcacaagattggaatgtcacggcatttcaaatcccatggaaaaaaatttgtaagaattattcaaagcatgtattccgatggctcatagaaaaaagagtaaattacacgcgaagatgtcatattatcatctagactcgtaaacttgaaaaattgcacattgagatccactatcttgttttaatgatccataagtggtccaaagtgtgtttgactatagccgaacgcctatgtggcgctccacatcttaacgtggtggtaattttgtaattaccccctattgctacaatagtcatcgaaatcccccaaaatattctaaatccctttgcattcccccccccccgccgcgtgcttccatgggagaggcctaagtatcacgaggatgatgtcggcagtcatcggcggtacgagatgattgaggtgttaatttgggttgtgcgacaaacgatgctcgataggcgacggacaacgcaccttcctcgtcgacacgacggttgcgatggacctcaactttaagggagaagattaatcggtgtccctaccgtcgttacctcatcgtttcctgccgcctccgaacagcatcctcatcattgcaaccctagtcgtcaggggaatgcaaagagacgaagggattcggggggatttcgatgactacattagcagtagggggtaagtacaaaattatagcctcgtcgagatgcggaggaggctggatgcaaaatgctgcctacgtggagcgccatgtaggcagccaactctggtcaaacgcgctatggaccggctatgatttattaaaacaagattatggatcttaatgtgtaatttttcaagtttatagatctaagtgatatctttgtttaagtttaagaaccggtcatgtattttactctagaaaaaatatagaaattttgtgatataggttagttaccccatctgtctctaaaatacttagttcctagaatccaaatgcacattttgtaacgagagtaaattactctaatgcctctaattaatagaaaattagtttggtgagttggtagataacggggtattgaaggataaattttcttgattcgtgaaccaatattaagtaataaggtactacgtatgagttagatttattttgaacaaagtttaagctctataaatttattttttttagacgaaaggagtagattagagtgagggtaaagagagaaaaggatattgcatcgatatatcaaaggaaatgaaagccatgaggttggagttcacgtttaaaatctaaagatttgaatcacacttggtattccacataaatttgacaaaccctaaatcctatgatccaaatgatttcactaagaaatttcctatgaattcatatccattatttttcctttaaaaatactataacccaaaggtctcggtcctacggaaattagggagacatcgtgtttgggataggctgatttttcctttactactcaaaaatcagaaactacctaaaattgacagaatctgacctcgggtatccttgtactccctgtcaaaaaaatttccaattctactcccttcgtactaaaatataacaacttcgtattcaaaatttgttccagaatatatataacaatttcttcacctacattctcttcttaacctatcacaatcttctatcattcaaattctataccaactttctcttctcaatcaatcacaactttcttccatttaattctaccatcttttttaatacctgtgtctgagcctaaaactctttatattttaagacggaggtagtatatatgaaaataactcctctctcggtaaaaaaagaactataaatatgaatctacatataggacagcgggagtatatgatggacggaaagaacggcggactgaagctacaagtgcagaaccacaaaaaggatggttaagcacttaagcttatctaatccttcttgctttggaagaactgcctgcttgcgttcagtatataaaaaatttaactctcctgtattaaaaaaaaaaagaacaggcagttctcctgacgatcttcactaaaaaaaagcaataaaagctgaaaagctgggcagattcttgcagaagattatagtactcgtatgatcttgtctgttggagtagtcgctacttgtactggcatgtgcacgcttccatgtttctactcctacaagtttaatactagtactaatatatataccatgtatctactctacgagttcagtactagtatatgtacaactcatcgtgacagtgtgagtagtaagcagtgcgaataatacttgatacacggtgaccgaatgtagtaaagtaaagctagcctagcatgtaattatttttcggaattgctaaaagactgtcccaggttttttttgaggaaaaaaacttttaaatgtaactatagcagtacaaacacgcccaccattattcttaataaacgcacactatacatctaacgagaccatatatgaattgaagtgatttgttctttaaaatttagaccagtacagaccggttttgcaataattacgtacactacaaattttgaaatgaatatgcttatatgcctcaattatttgtctctgtctggttcctgcgacccagtgctcattgtgtctccatagcttggacaaggacaacaatgggtactgtggcaaaagtagcatgagttaattaataggcaaaaagttaatcgcacgagttaagctaagccctgaattttgggcgatgcatgattgattgctctagggcttatggagctatggtcattgctcgcatcactgaagtactgcttcatgttactcatgtggcctccttgtctcctcgtcattccctgtactgttaatccatgtgacattggtgtatatctgttgttcctaccctgattctcgtccttcatctagctggaaatgttataccttaagaataacaaatcacaaagttggattgttaactttcggagactgtctgctagctgcctagctggaccagttcctcaataatttacatattcgggaagataaaaattccatgtgccaacatttctgtcttgttttcaaccttaagatgaacatttcaggtcttgaaacccatctagaaattgggaataaatttttgacagaactttacaaattcaaacaagaactttaggggcaatttcctttgcttcgttgctcacgttgaatatcttttgtcccttgttgcctaggaaggagcccattctacgatattaaacttctgcaaatgtctaaaaaataaaggaatcataaacttcaagctttaatatagtttaatctgaataattacatcaaatgtttcgttttccaacattggcctcttctctttgccagcgtgtatgccattctctgtagtgtgaattgatcaatcttcctcaaattcactacttcttccttgttctctgcagcttcaggttcttaggtgtagttttattttgcttgtttaggacttccttaaagaattgaatgggtaggaaacgctcattctcaaggttaaggctgtgttcgtttgtgtgagatagggtgagaaaacacctcgttttccgtgcgcacgcttcccaaattactaaacggtgtgttttttgtaaaaattttctataggaaagttgctttaaaaaatcatattaatccatttttgaaatttaaaatagtttatactcaattaatcatgcgctaatggctcacctcgttttgcgtatcttcccaatcttttcaatcccctatctctcaaattgtaacatcctgaaaattctcaataataaaaatcactaaaattttgaactttttaaaacttttgcatcatgctggttgttataactgctattgctttccaaaccgtaaatgattacaaagaaagtaaagaaaagaactacatttaagcaatagatataatttaagagagtatattatttatgtttaaccctacaagtatttatgcacaaaagttccaaattgcattcgggggttgaaatttaatagattaaacccctccataaaataaactaacatataaataaattgagctaatgtgttactgcgttaataacggtctcattaggaaattatagaatctttaataaatcttaaatatcggacaatattaaattttgggaaaattcacatttggacacttaatatggtcacccaaatgcttaggagtaatacaaatttaatttataacttttcccaatttataaatcaaccaaagccctaaaagtaggaaaataggaatacttagaaaaatatataataaaaataaaaataagttcaatattaaatttgaatacaaatttcaatggaataacttaggattggtgtatttttacattgtgacaaaattagtggcaacaatatatttttcctaattgcaaagtaccctctaaattcaaaaatagttggctagcactgttcattagcccctaggtgttcgatttggtttctagccatcctagctctctttctccccactgttgcgccgccctagccggcctcgagccccgcccgcaccggcgccgtcgccgtcgcctcgctctgccaccgctgccgcgccgccgcatcatgtcgcgtcgccgtcgccgcgccgtctccaacccgccgtcggctgcgccgcgccgctcgtgtcaccgtcgccgtcacccgcgtcgcgccgagcctcgcaccagtcgcgtcgccgtcgccgtcgcatcagtgcctcgcgccccgtgcgccgctgccgcgccatcgcgtcaccgcgtgtcaccgtcgccgccttgagccccgcgctgccgtgcgc

SEQ ID NO: 1276 - DNA, 9639 bp, Oryza sativa
gttgtcgcctcccttgtccttctcctccgatctgtgatggtggtggtggtggccgaagagcgtggcgatgacggagaacttccccgcgcgccgcttctcgtacccgatgtccccctcctcgagcccgccgctgctgccgtaggcggggccgacctgcggcgtccggaagaagaggaggctgggatgatgcttaagcgcgccgccgcccgaggaatccgacttcctgcgggacacgtacggcgacaccgacctcgggaacgccggcgccgccgcggccggtggcgcagccggaggaggaggcgacgacgacgccccgttctgcgcggcggcgagcgcgagcaggcggtcgttgaggcacgtggcgcagacgccgccgcccgcctggtacgggtgcttcttgcacctcatccccatctcatcgactcatctcgccgccgtcgccgccgccgccgccgcgcgctccggccacgaggaaggagcaatctacaacggcgcacgcgcacctgccttccttcttccccttcccttcccttgaaatttgggcgagttttttaaaacggagattggtgcgcgttttggcgaggggatttttttttcctcttttttttcggtccgcgacgctgcgtccgcgggcttaaataagcttcggcgaaacgaagggcttaccaagtgcaggggggacggagtaaatggtggccttgactacgcttttgggcgaattttggtttgattgcggttgcttttctattcgtgtttgtgagacttgcgagtagagtagaatagtagtagatgcagatgtatagtagtagtactagttgagatagatttggcacgggaccatgcttggatttggttgcggtggtgcggcggctgagcacacatgcacaccgttgagagcgagacatacatgttcgtttttatcggctaatctttgaaaagtgtattttgggtttggcctatctacacgagtcatcttaaagggattccttatcttaattaatccagggagatgctctactgttattgaacaaatgctgccactccactagctagcatcccacaaattgttgcttggccattcggcctacttttcaggttcttcctctctgaagcctataaacccaagccgtggacttcccagacctctcgattctcagccttgcttacggcccttttttccttgtcatgatctggtgtaggtgatttggtttatggttcaaccaaaagcgaagaattgtctcgttaaaccatacgctccagtgtgtcgctgaggtctagacacgtcggtatttatacaccatataatttacagttaattgcacagtgggccacttatgtttaccaaggttgcaacttggactagggagaagaaaatattttcactttgatttagataagtttgcaaaatgattcactttgtaccacttccctctccagctctctcatcactttcttctctacaatctaggaaacttggtgagctcgtgaaggcagcagcacgcggctcaaattcttaatgcatcagatcagcatgagcatgattcaactactaccaatacaggatctgctagctaggtgctcgcttcttgcgttgattatgggaactgggagcctgggagatccttgagcttcacgtcaggtagagggcacggcccggaggagatgctccttggcgatgagcagtaggcgctcgtcgtagcctccgcaaattggggacattccccggtgcagttcaccaaagcatcaactatgcttgctccaatgcttcacgatacgcagtgcatggcagaatgtgtaggtcgagcagagcgcgtacggcaccagcagaaatcgagctcgagcagcaatatatggacggcaacgtactagtggaggcatgcgttcttgaacattttgtgtgtgtatatccttctcatctccttcctccgttgagcctgctctcatctctgcttcctcgtcgaccacaagtagctggccgtgattagggaggagaggagaggaagaacactatttgatattgatgtgtgggccactggttaaaaatgcaaagttcagtaataaaacccggtcaaaagtgaaaagatctgctgatagctggtccaatttacaacttgggtaataaaacctgccctaaagtgcaattcactctataatttatcctcaagtgattacgttgctgactgtgatctctcaggtaaaaaaaaaaaggcccgaccaaaatccattcggagggcgtgaaatcgatagcaaattagcaagtactcgtactatacgtacttaataacgccttgcacgaaccgcatgcaccacacgtataaaccagctcgtcactttctcgggtaatatataatcgcgttccagaagacgtttgcgctcatcctgagccgtactatccattcatccactctcagctttggcacggatgcagtgcaccaaaagttatggaaaagagcaactttcaccgcacttaattagcacagtagaagcttcccgtttacactgatgcttagtcattagtcactcgagaaaggacccggtaaaacagaaagatctcaagacgtacgagcgcgactttgccggtgtcgatcggttttaatttggtcgctgatcgatcacgccgagatggcctctcgccgcgccatgacggagtgggacggagatggactgttcgttcgtctagagaaagagcacagggcgtagctactggtcggttgattgatcgcgcgatcgatggagaccgactcgagagaccgggccggcgcgcgagcgaggaggcaagcgaagcgcgcgcggatgcagccatcgatcggcgaccgcgcgcgcgcgcgtacgcgtcacgtcgcgctcgtggagaagctggcgctgctggcgatggcgctgtccgggtttcttgtgctcgcgccgcgcgggttcgtggaatcacggtgggattgcggcgtcacgagggaaaatatagtgaaaaacgcgcggttgattttgtcgcgggggggaactgtgcaagtgggtagaaagatcagaacggcgacaattctatcgtcttctggagggagaagtgtaaggatacgtccgtttctaacctgttcatggaagtggtcattgtcgagatggattgggattagtccatcctgcttaataataatgtaaaagaagctaacctacttgccattcagcaagcaaccaagtatcacacgcctcggatatattgctagtggtttcattagggtctatatgtttgattttattttttctgatctaaagcatttggctgcgtttgtccaactcacgtcgcaaaggaagctgacgagatagtggaagcgtcatcatcattgcacttaaactactcgtgtctggtttacttgtacactcacgatgaaaattaaggaaagataccgtcaggttcatcgttttcatctcatcgatatatatatatatatatgagatttcggcaatgctgtcgtacgtgtcgtgccgacgccacgcgtcgcagtcgcatctaattcacacagggctgattaacgattgaccaggtagcttcttgctgatcaaataccagaagcgacaggaagggcaacattatcttcttctgcttaatactcttagcttaaacgtcacgactcagcccgatcatctgtagcactatttctgctagtaattaacttttgctttctagtactattaaccatcatgatccgcgcccctttcgcggggtcaagcctgaaagctccacgtacgcgccgccaccgtgtgctagcttttttctctcccactcttccatatgcacctatatatccatttcccccttcacaagggcgccgtgaaaccgatgaatatacgaggacttgtcgtgccatcctgccaaatcgacgtccgccgcgggctcgcgccgcgcgcgggacggacgggacatcgcctcgcgcccgttcgccgcgttgcgcttgcgctttgctcgtgaaacggccgtgcggcagggtgggggcgcgcacgtgcaaagcggcccgtgggcggtgggctctctcgcatcggcaaaaaacgggtggcggctacgtcccttgtcccaggtggcccaactgaacggggagctagttttggacgagaaattgttcgagaggcttgggctcgcgataagatgggccgagacaccagtgctgcaagccggccacagccaggggccaatagcccactactgcggggaccgctaatgcgcgggtccacacccctctcccctatacgtctctctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctcctactttgggagggttttccacgttaaaatctcgtgtcttctgtgattaatctattattctttatcttttgtttgcctatcatttcctaacaccttcttctcttccctactatagtacaccacaaaattattttgaaaaaacaaaagttagaaaaatttatgtaaagaaatattatatataaatatttgaatttaaatttaaatttgaatcaggtatgtaaacttttgacttataaactttggatctataaactttaggtgtataaactttagatgtatagaaatactatatattagaaaacatttgaattcaaattcaaaattaaatcagatataattcaaatttaaatttgaaacgggtatataaactttaggtttataaactttagatgtatagaaatactatatataaaaaatatttgaattcaaattcaaatttgaatcggatatataaacttttgacttataaatttttgctctctacactttagatgtgtaaacttgaggtgtataaactttatatgcataaatttactaaaatagaaaagtaatgtggtgaaaaaaaaagaaaccaggtgaagaaagatggaactgatcgcaaccagttggtcctgtcgatcgatcgcgaatcagcctttccgcactactactagcaatttgcagtttgatggcgctcggcaggcacacgcacaacaggaggactgaacaagtggtggctctctctacttctctagatgaaacgaaaagtttccagctcagtttgtagtgcccatcgtgtcgattggagttcctgccactgtgaagctttttattcgatcgcaactaggacgagtgtcaagctctgattgattgcagcaactaggagtataggacgagtgtcgatatttgattcgattgcaactaggaagtgccagtaacgtgccagcctctgaaccacacgaagctcagttgaatcagtcccaactccagtttcccatgacttggctctagatggttaccgaaaggtcgccagacaaaacttgattattacacactgatgctgtaagtacgtaccttgagagcaaaaaaaagttgcaactactcctgattcctgaaggatacgtaagtggtgacaacttgtgctcaaaccatgggtcaaatggatccaaaactgcttcgttaatagcacttggttgaagaaacatgcttatatactccatggtccccttcaataatggtaaaatgaggtccccacatcctcggatatgtatcaccatcgtcgataaagaattgaggctcaagatcatatgcctatgataatggcacattccatcaatcccgaaagcaaggagggcccctgttcattagtatgctacaaactgactgactagccaaataaatacaaattatcttttcagtcttaaaaatgtgcaatgggcaatgggacattgtagttgatctaagaacattttgataagagttatggatgtatgtactagtcattggttattggttagttcttacacaagtgatatggtataccctctaatattcaggaattcaagatttcaagtcccagtgccgacgtatactttcaacatcatcttctaaggaagaaaaaaagtatgacgagtactaatttaagtcaataatagcttccttagtcaatagagtagttgttaagtccgatgaagttatattgctggataatcaggtgacagtactagcagatcatgcaataatataatccaaagtgaaaaccattcgtatgtaccacctcatctcggttcttttaataacaacttccacatttagaacgtatataagggcataagaactgatcagcagcaaacagaacccaccatatcacaaccacgacttccctttcgagtaagcatactacctgcttatcatttatatgtcaggctcatttgaaaacatttcatttccttgatatagtttgttttaaattttgatgcatttcagttaatcttggaaagtatgcttttcttctatgttatgaaacacacaccgtcttgtggagtttgtgtgactacttgttttctgaaagaatatgctcagactggcatctagcagcatacatgtgttttctgactattttatgttcaaccatatgatacaaatgggaaaaggttcaaggctcaaatgataaaagctttaattactccatcctttgtattgtgagcatctctttaaatacgtagtgcattggatgcatagaatatactctacagataactctcaggaactagttattcttactgtctactctctccgtcctataatataagggattttaagattttgcttgcaacgtttgaccactcgtcttattcaaatttttttaaaattattatttattttatctgtgacttactttattatctacagtactttaagtgtgactttttgttttttatatttgcaaaaaaaatttaaataagacgagtggtcaaacgttgcaaataaaaactcaaaatcccttatattatgggacggagggagtaattatttgaatttgtgccgctcacagatttgaaccctcaaaagataattcaagccgtcagcaaatggggcaaacggtaaaatttggaagagttcctttcaaggttggcttctcacattcacagtcccgcccaaaggtgagcctttttgttcttttcaatgtcacgataaactcattcaaacagaaatacaattacagagacatcataatcaaaattcctggaatagttactgcttttaattagttcattggtcgatgataagagagatttaaagaaatataagcacgtaaggtagataatttactaatttaatgtaaatgattgatcatgcttcacagcaggaccgatggcaaggaaaatcgagcgagcaaagaagcatcgaatcatacaacaaaattccagaatttccaaattgtcacaagctagaggaaccagaggacaatcaacaaacagcactgcttctatctggatcccagaacctgtcttcccccgatatttttcagctgctatctgtggatgtatgtataccaacacaacttaattactctactatgcatttaacttttcaagaatcatttaacttaaagtacaggccatagtcatcctaactatttgtttgggatcattcatgctgatttagaccgattcagaaactgaataaatttttgacatatatttcatccattagatataatatacactccataataccagtgtactttaattaacagaacattatgcactaaagtactaatgatgtgcattatactgtacacatttcagtttgtatcatacctttaaaaatacatattgctgaaacatgtgcgtttcatttatttcaaaagtaactagctgggtggcttgcgcaattgcgcggctagcacccaaacaaaatcatatatttttcagtatgattttacttaagatttattaaatagctatacttgtatttctaattatatagtttttaaaagtcacaccagctgctaccctttacttctgtcatatccttcttttgtttcctcggtctaccactatttctattcattctccttgaaacctctaaaaattggatcttatagttttttgagtttattatctcgttgggtttcgtttttataatttctagaagtcccgtcaaacgctgccattatactcatctacgacccgtccattgtcttttctctttattgtcattgggattttacaaatcgaacataataatcgttcgggttcatttttttactttctataagtcccgccaaaccgtcagtggctttgccattgtactcctttatggttcgcccgctgcctcccttctttattgtcattgagattttaaaatgtatcatgattatcattgttttatttttactttttagaagttccgaaactttaaaaattggaccttgtagtttttagagtttattgtcttgttgggtttcattttttataatttttagaagtcccgtcaaacgatgccactatacacctctacagcccatcccccgcctattctttattttcattgggattctaaaatcgaatataactatcgttggaatttattttttattttctaaaagtcccgccaaccgtcggcggctctgcaactatactcctatacaccccgcgcacgctgcttctcctttttattctcattgagattttaaaaatcgaatgtgtttatcaatgttttttttttactttctagaagtcccggcaaccgtcttgcccgtccctccttttaatcatcattaggattctatttgatgttttactaacagtttttatatatcgtatcaactgccaccactattcctaattaaaatctttttttctttttctaatttatttttttaattaataccgtatagtgtttttttaatatttttattttttatcttttgaatttcagttgaactctcttttattttttattctgaattttaattaatctcatattggtttcttatatggattcttctttcactattgcttatttttaattccgaatttcagttgattttaagttgtattcctactttaacttttcttttctttttgctaatttcaatttttttatttttattccgaatattaactaatctcatattgggttcttatatgtactcttctctcaatattctttatttttaattccgaatttcagctatttttaaattgtattcttacttggactctccttttattttataatttcggattttattttatttttattttgaatttgtattaatctcgtattgggttgttatatggaaacttctttcaatatagcttatttttaattccgaatttcagctatttttagattgtatttctacttaaactctccttttctttttttctttttctccgattaatgtgggaatttctagccccccacagcgaacgtggtgtctccttttaaagctgttttaataataaaatagatatatcaaaatagcactattaatgcactatcacactaataataaaaagaaggaccgaacagagtctgactggaatagaattaattcattagatgtgatgtacatccttcatccatacgatctgtccatgggaaaagttgcacaaagtgagctatccatgtgggtttctgtagagtacaactgcatgcttcgggaatggtgcattcgatcagggcaaggatgcccaagggaaacatgaggagaacagcgtcacaatg

SEQ ID NO: 1277 - DNA, 6847 bp, Oryza sativa
tacagaattgatctaactggaaattctttccctactgcatgattttaatttcaagactctgctctccagtgaaaaggttcctcacacaacatatcagaaaatcaagactaggcacaaaacctgcgtaagaaaatggaatactctacaacattaaaccaagtttttcatgtgtagatgactgtggggggcgtggcagaattcttgaaaagtaaattagcaaacatggtacagaggggatgtggaaggaagagagaggacataagactccaaacagctcagatgcatgcagctctctcagttgcaagactagctacagcagttgcacgaatggttggtaattgccaatctgagtctaccaatgcaaacaacactatcatgactgccatagggaaagatgaacatagaaaaatgcatgttgcaattgcatctgccgcagcactggtggcagcctcatgctctgaggctgcaaagttaactggagctagcagagaacagatttcgacagtcattcacatgggcatggaaactaggtcgctaggggatttgctcatgctgactaccagcgcggcgacctgtaagaccaagaatagaaccagctcatatttctctatatattgtatactaagttacttgcatgaaacttggttcttttgctgcaggcttaaaaggagctaatgcctttaagatgcggaacagggcaataagcaattatgcctttgagaatctcatgagtaaccagaaagatgtccgacttcctattcgaacacctgatggtataatgcccaattaactcatcaatgacatgccacattcaattagattacttcattttccagggatacaagatgaatgcgaaaaaaaaaacactttcatttgtgtattcatgcagggaagatccatatcaggatggtttctgtgcactgcaagcatgacaagataatattgaacttaggaaaggagcatagtttgagaaccagtaaagaatgtgagcctcattttactatcctctttcttaagtgcaggaccattcaccataggcagtgcaaatctgaggtcttacctttgcttttaatatgtagctgtgctaaattgatttatccaattgtttaatcacccactttcttccagacataatttttgatgaacatggtgggacaacagacttcagctacccaacagatgaacatagctaccatgcaataaacctcgcaacatctggtggaaacatacagttattatttgaagaacatgaacaatacagcgcttggaagtcattcatcagatacctgataatcaacaagagatcaaggctatcctactgatacatgatgtacgaaaattcgacaatcagtagggactcatgctctacattccttacaaacccacacatttcttacgtgaacaataccaatgatcaacatcatgttatgggaagcaccatttgtgtggtggtggaacacatgactccatccacaaatatgattgtgtgtatccttagttggtgcagatcccggaagttatacttcctttgtccaaataaataaataataataatgtaatagaacttagtaatagttattccaccaaaatgcagtttattactaagatgtttggttgaatgatgagatccatcccctgaattatcatctcaacgtatttatgtatattttaagatcacagctagctggcaaaattcaactcagtaaacctgaactgagatgatcagacgggttccaaggccctacccctgccattctcacatattccattagcattaacatcacagcagtctttttacacatttgacaggacaattttggtgtgtttccaacttcagaactaaaaaaggcatgaattatttttgaaaggaagagtttctgtatttatttgaaacataagtatatttttgaaataagtatgtctgatttctatactttttagtggaagcaatagataaaacaattgcattcgctgtaaaccaccaacccatgagcaaaatcgtaagaaaaacaagcaattctacaagcagaataacatcacaagaccgacattaagaaggcaatagcacaaaaaaaaatcctacttacattttaatcaacgttgtaagctgaacttgcctaaacaaatataatgccgtgctccttaatggtgtcgatgacgatgccaagcttcccctcgatcctctcgttcttcttgggctcgtaggacatggcgaagacgtcggcgtccatggacctctcggcgatgaggcggccgatggtcctgcaggcgttgtcgtcgacgagggagggcagcgtggtcctgaggtccttggcgttggtgctggcgacggagatgaccttgctggtgcccctgtgcacgaccttggcgtggacgaagcgcttggagaagaagacgttgagcaggaacggccgcatgtacatgtccgtgcgctgcttccacgacttgcggttgggcctctcctccgcctccttccgcgaccgccgcgtccacgccgcgcgcaccaccagggacgcgcggttgctgggcacgggcggcggcgagagcgcgaggtgggcgatggaggcggaccacgagagcggcggcgacggccggagagagggcggaggtgcgcggcgcggggggagagtggcggcggtggggtacgcggcggcggcggccatgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagcttgttgggttggtgtgaaagctcaaacagacagtaacatagagcctatggagtaccgccctccgtcgcactgctcgcatctcgtcaatttgctcctacaccacatagtccccaagctagagcagctctgcgcttgcgtcgattggaggcggccatctctacggtttatggtcgacgatgagcaggcctaggtccatccttcgttcattataggttaatagcattaggagggacatagcttgctcacgagctcattagtggtgatgagtgtggaagcgtaagcgtggatctggaagaagtgagtttcagtacgtttgaggacatggagaggagctcatcaagtggctaatgtatcaattagttccaatttgcaataaattgtaagtccatccggttcaaagtgaaaatatgagatgagatgagatctagttcattatacaactttggtaaagaaatcatgtccaaattacaattaactctttttttaattgcagaaaaagcatcataactatggcgaagcgatggcagttgagatattcaaatttgtcaagagtgtcagagtgacaacatgcagttttacaaattttcattaaaaaaatatagatcaaaggtacatgttatgaaatgcttttaccaaatttatcattatcctgccgcggattataatagcgtacattgtaaatgcagagtcatatgtgtagcgttatcccttatattaactgacgtaatgggtgcttttatcgtggagtattttacatccttataacaagtttaatagtatagcgaactattagctctaaatcatttatagtcaatctaatagcaggtacaatagcaagctataagccagctataaacatttttaaagagataaagaaagagagaaaagagcagcggactacagatctgtagccagctgcagcacagactccaagacgtaatatgtgtatgacagatgggaccaggtattaatagtatagtaagcaactattgtatgaattggctattacattgactatagatgatttggagctagtactgggctatactattaaacttgctctactatcattcatacaatagttacctataagcatataatacaccaatatatggtctcacccctcatacacataatgtattgaagtctgtgctgcagctgactataaatctgtagctcgctttccttctctctataagcatataatacaccaatatatggtctcacccctcatacacacacaatgtattgaagtctgtgctgcagttgactataaatctgtagctcgctttccttctctttctcttctctcctccagctagacacacaacatattgaagtctgtgctgcagctggctcttctcttctctcctccagctagagacacacaacgtattgaagtccgtgctgcagctggctataaatttgtagcccgctttccttctctctcttttcttctctcctcccgcttttcttctctccactctcttttcttctctcatccccgctttccttctctctcttttcttctctcctcccgctgttcttctctcctccatctagctataaatctttcttctctcctcccactattcttctatcctccactctccactctcttttcttctctcctccccgctttccttctctctcttttcttctctcctcccgctgttcttctctcctccatctggctataaatctttcttctctcctcccactattcttctctcctccagctggctataaatctaaatctttcttctctcctcccactattcttctctcctccagctggctataaatctgctgttcttctctcctccaattggctataaatctatagctctgtagcccgctcttcttcgcttttcttctctcttttcttctctcttctagaaatctgtagctcgctttacttcttctctctcttttctccacatgtgcttacaggtgacttgtagcctgttattgtactcgttcttactccacatgtgcgtgcttacagctaacttgtagcccgttattgtactcgctcttactgatacactccagttcaccccacccagttgcccacaatacaaaagaacaccgatgcacaaaatccataacacgactcaccaaaacattttatacagcgcgtagcatgcatgtacagatgtacctatatgtggtcttacctctcttggataccatggagtcaagacttcaggattacacaaacaaaataatttttcctccagtgaaattagaatatcgaatttcacgagggatttaaccgcgaatgtcatttctaaactcctgattttgatgaccaagtggggacaaccaccacgaaggtaaacatctgaaaaaaattcagtgccaaacaggcaactggtagccaaaaaggctggattgaacgggccaatgagcaacacacgagaaataatgatttgggtggtgccgagggccttcctcttttcccttctctgttggcatctgctaaacaaaatttccaagttacaaagtcttccctcaacataaatgagggaatacaattctacatctaaagagcctacgctaccaatatacatacatgtatagaaagtacccaatgcctccattagtgctaaccaaaccctccaagcttgtaaggtcattgtgaccacatcaagcaaatagcttcgctcccaccaatcgccatcaagcttgcatcaattctgtgtggcgagcgactcaatctgtgtatccttgggctcctaccgttgacaatctaatgtcctctttaaaagaaagggcatgacatccagagcaatatgttcatttgttctcatccgatgtctgtgaaatctgtaagaggatccaactcctcaatgccagaaaggacatcagagtcatactggtacggaacaaactctgtttcagcctcttgaggaagattatcaaagtaggtgaattcagaatcactgatgccaaggtcagatagggactgggtaatgtggaactctgctgagttatgcagaagttgccccggaatcctatgaaaattatttgtaaccggcacttcctgtggttcagtggtcctttgaattttggatttgggaggccttccagattctgatgatgctttgtgctttcctatggacttaggaccagatttatgccgaccggcatcgtatgtgtggaaagcagatgaggcccagtgagaaccttccccttcaaaacaagtttctgataccatcctgtgtaaatgaatgcaatgacacgttaggaagatcagaagcaaaaataaataaataaaaaatgcaaagcagaactgtatcatcatgaagaggatttttccggtgctaataaccactagctccaataaatacacaaaatatctgtgtcaacaattacctgaatctgttctcagcatgtctataagaaagtgtggacagtagtgagtgctccactggctccacagcatgttttaatggttccggttctagtatggacacgttaacaacagatggaaagtccgcctcataatcatctcgatctgtcaagaaatccaattccaattccaaaaagttacggcgggactcatgattgcttgttggaactaccattcttggacattgaacctgagcatctgcgagggctgtccttactagattaaagtttggtctgaagtttgtcatggaccagttctcgctgagtctgccaggtttctggagtgtgttagagtaactcataacacagtgggactcacaggcagacttcgatctccaaacagatgaaagaacagccatgaaatgtttctggagaagcaattcattgttaggaagctcgctgattacattgagcaacatctgagtttgatcctggaaaataagtcataaaaaatcaagttgtgcacacaataagttgaatataaatagtagatttgtttaaagcccacatatccaaaaaaaa

SEQ ID NO: 1278 - DNA, 2764 bp, Oryza sativa
ctgatgtttcctcaaccataacctctgactcagatgataaacgtcctttcttcaaagatttgaacttcgctgccttcttcttgttcttttttgacttttttcgttgagtgctgtcaaagattgacaaaagttattcttttaggatacagtaaatagatgaaagcatatggacacatctaaaaccaattggaaagaaaatgcaggcataccatgtaaccctacagatgagcaccaaagtgaagtgcaaaacagcacaaaagctccctctgttttcatgactgtcaacattgactactactgtttctactttgacctttttttttttgcgaggaactattaatggtcaaaattattaaaatgattaatagtttaggattaaagtttcttgttgaagtttaggattaaagaattaatggtgaattgaactttcttgtttatgcttacgatacagtacactttaataacatgacatcttttcatttgtaaaattattgaaaaaagatgagtgatcacagtgtgaaaatgaatagtgcccgctgttagataataaaaaagcagagggagtatatgcatctacccactaaggccccattctaatgtgcttctagggggagctactccctcgtttatcatgagcacgcttcccgaactgctaaacggtgtgtttttgcaaaaactttctatatcaaagtttcttaaaaaacaaataaatctatttttaagtttatggtagttaatactcaattaatcataccctaatcatctgcatcattttgcgtggagctaataagctcaggttatccccactatcgaacagggcctaagagccaaaaacaatgaacaccaaagtgagagcacaatttctcagtctatacctattatcattcttttcctccaactcttttgctgcttcacgggcttgtctttcttgttcctcaaacaactgtgggtatcacatcaggtgacataattagccactagccccaagaggaaaacacaagaatagaagtatgaactgacctgtttttgagctagagcctcaacatgttgccgatatgctgtagtagcaaaatcaacatcccatgctgcagttaagatgatgtgtcaacacaacaaagcataatacaaggaagggtgagtatagcagagacaactacctaaaactaagttgcataaatcaaatatgagatgaaacttttttcgtaagtgctatgggctgttgggtcaacataaacataaaaacacttacactcataagaaagtggttcctggtcttcatcaatttctgcttctaaatcttctttgagtttttcaatgcgttcaagttcccattcttcctcttcaacattgacctgatagtttatagcagctttatcaattattggatcccagagttccaaaaaccgcatggcatatctatcaattggccggagctgattttcaaaagacgaacttgcttgacctgctgcagcagctgcagcagccatctgcttaacatcagcaagcatgtcaatatctccatctcctccagccaaagttatagccttttcttcatctaattgatttatagataaagcaacatgcttgtccttgaccaaatcagaacactgatatttatgctcttcattggtgtgttcatcaggtttagtgtcatcctcgtttacaagatcatcctcctcaagtcttccagcagcctcctcgctgaactcttgattgtccacggcctcttcctgctccagcctcttgagagccatatagtcagcttcatcttctgcctgtctaatagctgcttcaacatcaacatttgacagcgccagattagttccgtttgagggtccagcagacagagagcaatccttctgctgattctctgcatgaagtgatgagtgcccagaaaagaattccataggatcaagcttcttgaagaactctgtattgtagctaccgcgttgtatcactagatcatcaagagctcgcttctgattggctttcttgagtatattctcctctatagtgctctcactgatcagtctatagatgtgaacttcacgagtttgacctatcctgtggcatctgtcttgggcctgttggtccattgcaggattccagtcactatcatagaaaatgacagtgtctgcacctactaggttgattcccacaccaccactacgagtggataagataaaaagaaaaaactttgggttagtattaaacctctgcatcagtgtctgcctctcttctggctgggttgatccatctaaccgcaaatacgtatacccatatagattaatgaactcctccagtatatcaagcatcttagtcatctgagtaaatatcaaggccctgtgtccttctgacttcaaacgcctcaacaaaatagcaagttcctgcaactttccacagtcaaactggatcaaacgcctgtcaggaaagtacacttgacggcgaacaatcgcaggccttataggagagaaaacaggagaaaactcattcatgcatttctctctgtatgctggttcaataagaacaggagatttccctttgttgcaccagaataatggtgcaggcgctcgtgcagcaggaattgcaaaagtaaatgactcaataaaatcaagcattgtcttgaagcgatccaccgatgatagaacaagatttgctaggcttgatgaaaattccatgtggcataaagggttcttcttcttctcgagaatatcagacacaggatgctttatggtcaaaacctcccgaatatttgtgccataaa

SEQ ID NO: 1279 - DNA, 701 bp, Oryza sativa
  unsure (1)..(701): unsure at all n locations
nnnnnnnnnnnnnnnnnnnnnnnnnnnnnnnnnnnnnnnnntcgcgcaccgcgctttccaggtggctcttgttgccgcacaggtacagatgcccaccgcgggccaggacgccgcgcacttcgctggcacgctgctgcagcacatgctgcacatagaccttgtcggcaccatcgcgcgagaacgcggtgtgcaggccggccagcacgccacgcgcgtgccagtcctgcaactggtcgcgatacaggtaatcgtgctggcggtgcttctcgccgaacaccaggtgcacttcacgttcgcaggcgttggcctgcagttcctgcatcaggcccatcaagggcgcgatgccggtgccggtgccgaccagcagcagcggtacctggccggtgtcgggcaggtggaagccagggttggagcggcagtacacatgggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1280 - DNA, 611 bp, Oryza sativa
  unsure (1)..(611): unsure at all n locations
nnnnnnnnnnnnnnnnnnnnnnnnnnnnnnnnnnnaatttcatgatgtttatttttgctcgtgctagctttgttgcgtcaaattactaaaaggtttacctcaagtaaatttctccttggttctaattggtggcccaaacgtctctacttgtccaggatttcgatcccttctcactaacgtttgacagtgaagacaaggacaaacttaggggccgtgggacaaccgactgccttggccatgtggcgctggttgctcagctcatgaggagacttggtgaggtcaagccggtgctgaaacattcggtcattgcggtgttcattgccaatgaggaaaactcacttatcactggcattggtgtcgatggccttgtgaaggatgggttgctggataagctcaagaatggacccttgtgagtattgtgctgtttgatgcatggagggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1281 - DNA, 1334 bp, Oryza sativa
  unsure (1)..(1334): unsure at all n locations
nnnnnnnnnnnnnnnnnnnnnnnnnnnnnnnnnnnnnnnnnnnnnnnnnnnnnnnnnnnnnntagttgggtttgatgattgaaggtccgatctaatttgtatctcttaactactatatcagatatcttgacccataactattaaaaccaatgcaagatgactcccttagtggttttgagggtgtttttttgttgacgtgactcgttgacctactctagcaggccgagttactatgcggaccccacatgccaaatcccttctctccttctccaccccctcttctctacccttatcttctggattcggcgcgactctaggagtgggcaacgcggcgcccgaggcgatgggaggttgaggagaaggcaatgggtggcaacagtgtgacgatggcagaggagctcaagggagctgcggtccccatgtctctcgacgggaggcaaggcggtgggaggtaaaggggagggcagaggctggcggcaacagcgcaacgacgatgcagtagctcaagggggttgggaggcagtggccatcaccgacgtccctgtgtaagcaccggtggagagaagcatcgtgaaggcggacacaatcttcgttgcgcggtgtcgcgcgcatgaggggatgaacgtcgtgccgtgggagatgtgaccggtagggggcgaccgggtgacagaagagggatgagggagagaagagggaaggagaaagagattggggatgaagaagcgggcggcattagagcccaccgcttcgagccttgatgagaaggagatcaaggatgggtgggtcttcctcgccgactagcgggtcaagggtgaagaggccaccgtcttcatccatggtaaggactatggtgttcaacgatgacaagaggggggaagaagcaggcagcatcagagcccgttgtcgcgagcctccatgaggaggagactgaggtcaccgccgcgacctatcgtggacaacctcgctccgggtcttacccaccatcgagtccaatctcgggtgggcgcttaggcataccctattcactagacccgaatccataaatgcataactgatggcagcttcaataactgtcattggcataccacatacctatacgtccagtcagggttcaggatcgagggaaagacacatgtgcatgacatgacaaaacgggaggccagcgtcgacctcctcgaggctagtagtgacgtgatgtccttctcttcggccacaccgtcgccattctccttggctctgtcgtccaagccgctgactgccgtcctcgattccattgtgcccgaagctaggagagagagtgaggagaagagtgctcgcctctagccccccgatcc

SEQ ID NO: 1282 - DNA, 1740 bp, Oryza sativa
gggtgggcgcttaggcataccctattcactagacccgaatccataaatgcataactgatggcagcttcaataactgtcattggcataccacatacctatacgtccagtcagggttcaggatcgagggaaagacacatgtgcatgacatgacaaaacgggaggccagcgtcgacctcctcgaggctagtagtgacgtgatgtccttctcttcggccacaccgtcgccattctccttggctctgtcgtccaagccgctgactgccgtcctcgattccattgtgcccgaagctaggagagagagtgaggagaagagtgctcgcctctagccccccgatcccgtgcacgcagctgtggagaagaaggcgagaggagctgtctaggaaagaaagggacgaagagggaagaggaagggggcagagagagggagagataagggggaggggggtagggtggaagggaggggatgtgacatgtgggacccatgtgttgactttgccggaaccacgtcaacgaaaaccaccctcaaaaccaccgagagacatttcaccccggttttaatacttggagggtcaagatccggcattacggttgagatatacgaattagattagacctatatttgagggggttaaagtggagctattccaatttgatggtcttggcaaatttaattgggtagaagggtaattgagagcccattagaaagcccatcaaaactacccatattgttccctccaggccatttacaacacagcccccaaaagatggcacaaccgcacaactgatagagagtgatagtgataggtttctgcgatcctgtgtaaggagtactccttgaaaaaccgacgtacctctctcactgcaacagggccccacggagacgaccccaacaacttgggtcgatagcggcggaccgatttcgcatccttcctccggctcagcgaactcgtcccgcaatcaaaagcggggcaaaacgataaaacaaacctcctcctcgtcaaagccaagcctgcgtgacaccccgcagctgcgaaaataatcccaaaagcgcccgaatccactaaagcccacgcgaaatccccagactgcctccacgcgcgccgcccgcacctcgcaacccccaggggcgtttccgtccattcgcagccgcgcgagttttagctcccgaggcgtcgaggcggaggggaaggagtcccccaacccccgcaacccccgtgccctagactcccccgatcttgccgccgccccgcctccggcgccgctcgccggtgacgacctgctccgccggcgcccgaggccctcgcccgagatcccctccgacggctggccctgacggggccattcgccgccgcgaggccgcaccgccggtcgccgccggtggggcgcttggggtgggtgggcccctctctgatttgaaccccggggccacgcttgggtgcctctctggttcagagggtttgtgccgaggtgaggaaactatcgagtcgattcgactctatgtcgctgtagtttagggctcctacttgtgctttgggtctgggctgcacttttgtggggtttagcatttctgcaggggtttgcgtcgatggcatgggcgcctgcctttcagcttgcggtattcaggttttgaagttttggtgcataagattggtgatattttattcttttattgggagtaaggtaatgcggcataagtatcagttaggatggtgataatgtggctaggctgagcgtttatgt

SEQ ID NO: 1283 - DNA, 2007 bp, Oryza sativa
  unsure (1)..(2007): unsure at all n locations
tttcattagtacataagacattatttataacagcaaattgaattgaactttaatgaagataatttgagaaccaagcagtgttccttcccctaaatttgttctttcaactgcaagtaaatatataaccagcacattgagcgacatactcaatgaccgtagattatgtggatagcaaatcagtattcatgggttttatcttaatgttggctgcgattttcataggaggaagaagttcgcctgaaaaaagttgccctaaatatttctaaggacgtgaagaagttctggaccaaaatagagaagctggcaagttcattgtggctcagtgtatatttagaacaccacattttccaatatactaaaccttatgctatttatatttgggtttgatgcaggttttttataagaaccaactggagcttgaggaaaggaaaaaaaaggccctagacaagcaacttgatttcctcttaggacagactgaaaggtactaccatctattatcagttggttttgttttggaactatcttactttttagtaagttcatcgctgcatgctcactctctgttgttttgtgcaaactttttctagatattcaacaatgctggcagaaaatcttgttgatgtgcgccttcaaaatcaagaaaatgactctttacagactaatcaaagatcccagcaggaactagcacaagagaacataaatgcatcaagtccgactgatgttggtgtgtagctttatgaaatgttctgtatatctctgaaattttaaatgtcctttttctttagcttttaacagtatgcttttacagacaatgtggaaatcgatgatgattacaacagttccttgggtgaagagccagtaagctactattgtgatttttttgattcttttttttatttttcgtgggtagcattacaacttgttagatttctacagatactggtactggcaccaaccattattactttttttgtaagttgtgtaccagggcaaggaatacatattttcctgtccaaaaaagataataatgacacctctccttttcctttttggtttgtttttcatttctcaggacattgaattactcttgtgtgtgtttgtgctgtagaaagatgatgaacacacaatcgatgaggatgaagctcaaattacggaggctgagcgcaacgaggaattggctgctttgcaggcagaagctgatctaccactggatgatattctcaagttgtacactaaaaataaaggtgatctccgaaaaacagttctcttttgccatgtttcacatattttaggaatcaattctgtgttccactttgctctcaattgataatttgatcagttcaagctttctcagttagcagggaaagcagtccagatggcagagacgtttttagtgactcagattcaaaggatttgattaaaggttatatattcagagtttcagacacctttatggtatttggaatctgaaatacttgacacattgtggcctttcatttgatttgtgttgtgtatggtttcttccagatcctttgagccaggctaatggatgcaacgatgaatctgatcatacttcaagtgatgaaggcatttcttctgaggaagcagatgattaccagtcttacnnnnnnnnnnnnnnnnnnnnnactgtatgcttgatttctttgtgtcatttggcttatgcttatgtagtatatagtaaagacaggggactcaggatttcgagcttttgaatgttctctgaacgtgccatcaaactttcttgacttttcaggtgaaatgcaatggcaatatctcatctgttgatgcaaaggtacatttttgttatcattatttttggaggggaacatttttattatcattgtatttgttttggattttgtcttctccgttccaataccatttggtctatttcactcatatctcttagaaagactagctgttaggggtgggcattctgtctagaccgaaaattcggtctgggtagttcagtttttctgaagatcg

SEQ ID NO: 1284 - DNA, 475 bp, Oryza sativa
attctgtattcatataatctacatgtaagcactgtatttgttttaccctgattcacatccatggtttgtttgatctcttgattgacattgtgtacgctgttctcctcatgtttcccttgggcatccttgccctgatcgaatgcaccattcccgaagcatgcagttgtactctacagaaacccacatggatagctcactttgtgcaacttttcccatggacagatcgtatggatgaaggatgtacatcacatctaatgaattaattctattccagtcagactctgttcggtccttctttttattattagtgtgatagtgcattaatagtgctattttgatatatctattttattattaaaacagctttaaaaggagacaccacgttcgctgtggggggctagaaattcccacattaatcggagaaaaagaaaaaaagaaaaggagagtttaagtagaaatacaatctaaaaatagc

SEQ ID NO: 1285 - DNA, 8418 bp, Oryza sativa
  unsure (1)..(8418): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgctcaccgacttgccctgcttccgcctgatctgctgctccttgatcgagttccacagcttcgtgatggcgtccctctgctgcgtcgtgaaccggttcatgttgtcgtaggcgtgcttcgcaaagatgtcaatggcggtctgtgtcctgataacataaaaaaggagaattagaacacaaaattgttgaatatgtgttgataacataaaaaaaaggagaatttagaataggaaattgtagtgtatgtgccgctaacagcataaccacatgatgttctatctcaagagaactcaccacggaatcctatagcgccgagcagctatttctagacatttcaggagggcttctcgttgtgacttcagaaatctctttgattcatcctcatctgctttcctatttagagcggcgaccgtcttctctcgagccttttcagacttctttgacttgtgctcaagtagaccatccaaaccaaaaggatcagaggattcctcacttgagttggaggctgcagcatgagtgctatcatctggcaacgagttggatgccgcagcttgcgggttatcatctgtgttattactttcaacagctgctagagctgctgcttcatcattgtcatcatccactgttgtgattggcagggctgagatggcatctttgatcttccctacagcctttgagaactacaaaacagtatcaagtacgttagtcaagcactcaaatcacaagctgtgtcatagacatgagcccagaaacaataataatgcatttttcacatttgatagagaaaataagcagcgcaggcaccaccacaatacactcaccacaaaactgtcatccgtaaaaagatcatttgccaccactgcatgcagcacccatatatcaaactgatttttctgttgttggttgaaacactgcaaatccaccacaagttataagtacaagatacaatggtataatggaactgcataaaacagagaacactaagacttaataaaaatcttcacctctgttacaccctgggctgcattaaacaaagcctggtaatcagcacgtacagaaggctcattacaagctcctggtgaagacattgcagcctctaatatagcaaagaagtgactgattgtccctggcttgacactcccagcctcaataagctgtagagctagttttgatgccttgctgaattttgaaggattccgtatgtgtgaagttatcttgtgcatagcatcaatgacttgcgtttctgaggcatcaacagtagttctaaacctaagtcgcttctcaggagctacaagaaaaaaataatgaatattagaagtttagaacatgagcatgaagcaagtaaaatatctctgctgttgttataggaatatagcgagactgtaaaagtcgctcgcaattaaaaaaaatcatgtggaaaataattggatgataaaaaaccttcagatataaggagtcattacaactttcaatcacccataaatcttgtcagcaggactagatattcagtgctagcacactaacgaaactaacgaaactagagttagtagtaaaacatgatggcattttgcagatggaagagttgtcatataagccaaacttataagagatgtcaccagattctgttaacgttccaacttccaatcaacacataacatagcgaaacattaatctttgcaagacacaatctcgcaaacaaagcacaaaaaatcccagtgaattacctggtggtgataatatcaacaatactcactatattcccaattgagttactccaagggaccaaggcagcagtaaaccctggcactaagatttttttaaaaaagggcaagcaaagcttatctgaaccagatcaaatgtgtataatcttcataactgaactaatttaacatcttctgttttaagttatgtcacaccttacatactcggagcttattttgagttcatattggtgaacaatgttaagccaaacatatgtaagagaagaggttgttatcctaaaaggaaacattaacacttgatttgacagggagtctcagggctaagagcttcaactatttataccttagttctgcaaaagacacaagtaatttgcacagctaacatattctggctgatgcagtcattgatctcaagccacacagaccaaacattaacaattggaacatccctgcatctgtatgctatggttaatctccttgtgagatgtggcaaatgagaactgggaaaccctaataccgatctagaaaatattcctatgaacaaagttcgcatcaggatatcaccacacaaaattcataaattaagccatgaatttctagccagatgaaaaacctttcaatttctcagctcctaggcgatgaaaaatcagcaactaatcgttgacaaaatgtacaacaaagaacacaagctagtcgtactcgtacgaacaggagtgcatccgaattcccaaagccgaccacgcagagcaggggacgcagcggcagtagcagtaagcatctatctaatttcgcacggagtacaagagcgcgagaggagagctcaccacgtccttcggctgcggcatccgtggcggcggcggcagcgggtgaggaagcggcagcatctgaggaagagagcttgtcccgcttgagagcgctcttcagcgcgggcagtctcggaggcggaggcggcgatggtgaaggcgcgcgctctcctccggcggccggcgcggcggcggcggcgggaggtggtaggccctcgaagaggtcgtcggaagccatggccggtgtcttggtctcctcctgcttctgtctgctcgagatgtcctaaattaatgggcctcaaactaatgggcctagttggtctgctatccaaattgagatggcccatagcccataggggagaactatttatgaaaatactcttggagttggactgaaattacgcgcctgccatgcagcaaaacctccaacgccccacactgcgtgcacttctcgatcattcgatcgcttccccaaatcgctctcctctcctctcctctccaccgccgccgatctcctcctcctccggcgccgtcgccgcgtcgcctcccggagctccggtgctgccaccagcctacgcagcgccgcctcctcctcctcctccggcatccgccaatcgccgccgcctggttcgtcggggagccccgcgccctaacgttttctagaggcgccgcggatccagcgcgaatcgatcgagaggtaaagggtaaggactcgactccagatcatctctcgatttgtcgttttcttcccctccatttttagtccattatttttttttgttttgtttttttatggctgggtggcgtctttgttctgatcagcgcggcgttgtctctcttgcagggaagttgatttgagtcggcggccgaagaaggaagccatgaactcgagaaggcaagtactgcacactaacttttcgatgtgttttcgattttgatgctatgggtgaatggagttaccgggttagggttgatgagcacggatgatttggtaggactgactgactagctggttgagctatttgtatatttgcattagggttctatatctactataactgtgtgctgaaattctctcaggaaaaaaaactataatgtgaaattatcgtgtgattacagcaattctgatgtatgctaggaaggtcaatactccttcgtgggattttatctgttagttgtgagattgcatcctttgatgtaagacatttgccaggggaaagctcccatgattccgtagttagcaacttattgatatgaatcaccggaaacaattacttatttttgctggccagctctagctttgcatcctttataacatgtttgaacattgatgtgcttccaccaaagattgatgaaatgttgtgcaaggcaatttggttcaacctgaaagaatgcctcatgcttttcaattgccattagtcactatccaaaagtttgatttcggaaggcatgtgctatgctgctgtatatttactttgctcatatgtgattatgtgtatactaccattaaatgagctttaggtctgtgactttttactcttaaaagcaactagttatatgccatttcatcctgctgccagttgatacttatagtagcgagaatcttgtggcctaagaagtcgacttcctgcattgtgtcagtttaataaaacaaagaagaaaactcaaataataactttttgtgtaaatgaatagaaggagaacaaaacacctggtagattgaccaactcatgatcattggatcacatttctatttttatcactcctgctctgtcccaagctctctatcttagttttgtaaacagtggaagtgtataaggaatcaaagaaaagggaaggccctaacaaggatctgtacagtgggatagcttgttctaaacttctactacttgatattgacattttgacatttggttgcagatggagtttatgtccagctgcaagcctttgtctgctctaaaagcttgttactcactatgcacagtttccagtttaggaatggcctgtgatcatctacctgctaacactaagaacttactaactcacacatgctgtttatccaagtcaaaagtacacagtattagctttgtcagtcaaatatatttgataacaagtattaaccttttcatgatattcataactataaattcgagttgaacattattaagatgaatagaacttgttagtattgtggaaggtatctatagaaatcagtagtatgtacctgtttatttatggcttgagattgttttggctcatagtttttcttcagttaatttgttgaatgcatattctctttctgtttttaattctttgatacatgtgtcaaaagctattgtttttgtgaacttgggagattttagtaatgtcgtcccttcatacttgacatatataaatgcattcatgaattatgattgctcagtgtatatccatgtagactaccacggtaaatgtttctatgtaacagattgaatatttatttatatggtttgcttagtttgcatgtgtctttgcattttatttccatcatatgctttgcgcacgctgattatttcatggaaattttagcaactaccgcagcaccagaacttttctttttgatggcattgaggagggcagaatccgtgcaacatcctatttttcacatgagatagatgagaatgagaatgatcaagctattgatggattgcaggatcgagtcagcattctcaagcgggtaagttgctgcgttattattggacgtctgatttgccctaagttttgccagtaaacttgtgaagaattactgttttgattttttgacataatcactcgtattagtatatttgtattaagccgtgctgcccagatggatcattaaagcacactactacatttgtaatagcgaaaacgaaagattttgttgattgtgacttcattcgtggccacctattagataactgtgaaccatgtgcttcttggaccattttcatttgaagtgttggaaagtgctacagcgcagcttttgatcatgagatttatgcttaaatatggccaagaaggaatctgagtaatctaatgggccttgtgataacttttggaagcagctccaatgccaatgattttattaatctttttggtattcatctgatccatgtttctaacatgcgactgatttacctctaaaggttttagtgctagaaattagctaatgaatggactatagaagattttgtttcaactgcaagtagccagcaaaacagaagattttaataaatctttggatagaggacacgatgtaattcttatgtaactgtgggcctcttcacacctaatcaattttctttgtagtcttaccaagacatttcaaaggtctgagccttgaattaacgaatgaaatgagtaataatatcttcagtagtttatggtgttttgctcctgcttatggatcaacagactgctggactgctggtcccgttccagtgtttggttgtgtctagtttttatagctatgcgaatcttctaccctgtcatttctttggagagatctacagacaatcatatatggatggttactgaggttattttacgtacttgcagttgtctggtgatatccatgaagaggtggaaactcataaccgtatgctagaccgaatggtattttatatttatccttttaacttttgcttccttgaaaaatatccttctagagttctattatgttgacatcttgcctgatccagggcaatgatatggattcgtcaaggggttttctgtctggaacagtggacaagttcaagatggtaaacactcacacagtacaatcttccttccatcataccatccgtatattctgctgagaccgcaattgatgtctacgatataggtttttgagaccaaatcaagtcggaggatgggaaccctcgtagcatcattcgttgcgctttttctgctggtatactacttgaccaggtagaagaggaccatgcatcacttgcctactgttgtgaagcgatgtgaactgggttgggtactcaagaacacgctgaaaatgtctgtgtcaatttaccgtggtgtcgtatatacctccaatatctcgctgtcataaagcaaaatatgttgaccagaatgtttctaactctgcactgtgtgaggattacaacatgttcgtcgtttgctctggtgctgtaattacctttacagaaaatgtttcctgctgtgttctgtaacatctgtttctgtatgcggtcatgctatctgtattatattataacttcacaagagattgtactttggagtcttaattgccatatataagacgctattagtatgtggttaatttgctgctactaccttgtaggcttgtttagcagagcttgtttgggcagttctggagtcgacacctgtcatggaacaaatccaaatcgaaggaataatgtggctgcagcgtaagccatttgtgttgtatattataaagttaacgactgctagtcagcgactggttaatcacactgatcacaactaacgcaattatcaatggagcaattattgagtgaagatgccttaatcgtgcgggagctagcaccaaacacctgtaattatcatagataattacgtcaaccgatcttaatcacatgcatgcatgtaccccaatacaatactcctactcatggctcgtatttctataccgtcttgctcgaatagctatactaaccaatcaagacggtttttctaatcatgcaacttaatttgcccatgtcgttaactgataatcgaagtctgatgattgttgtgtagagacctctctctctacttcaaaatataaaacataatcaccctaaatccaaaaacaaaaaaataattgttatcatcaacaataaatcatcgtaataaatacatgctcccaataaaattaaagattttaagagtaagtgattttaaaaattaatttagtacagatgagattttagttatttttttaataatggaatgaaacatctcagcctttgctcagaagattttagttaattacatgcatatatgtacgttttgtattatgaaacatctaaaaatagttgtgcattatactttggaatagagtgagtatatttcttctattccgggttttgttatagatttttatgtcgaccttgctcctagatactcaaaataatgagggttgtaataggtgcctatatacgtagatacttaactttttatacattaatgtgattcattcagtttgattctaagaagacatatatttcctactacctgatttgggagtgacttaattatttcccgtcaccagatgatctgggaatgggaggccatgataatattccaattaatgcttttgctactaacagagaatctatgcgagattcctttaattcatctatgagcagatttaaaaaaaaggaacttggctctgttcttgtgatcaaacacctacctgtacaacagctgtactcttgtgcagtttaattagtacgcactaattaatcaatctgctgctttgtttggggtgtgttagagatgtcatgcacaccaccccatcaatgtttgacaaagcttaggttatccatctctgggagatgtgccactagtttaattagtgggcaaatgctttgttaaaaaaaagcttaggggttcatatactttaattggttgcacttaacttttgttttgtccctttcttttttagactggagtggaggcatgagcatgacaggatcttttatttggg

SEQ ID NO: 1286 - DNA, 2862 bp, Oryza sativa
agcccataatctaagtcggccatccttttctgaactctgatgctagtacactctttaatttgttggctcattaatcagtggctgcccctcgtgtgtgtgcatcattgaaatgatccaaagtcaatctggagagaattaagaaaaagcttaaatttttattggcgtttcaaagctattcggatagaaattaaacaaaaagtagttgaagggtgaacattcatacacacatggggagaattttcagttacaacagccgtcatcctgaaaatttaattattctgcctccttaatttgcaattgaattaatcaacttctgttcttcaaaagaaaatgtctgctagcttacaaattagatatatataatcaatggcacctagtaaggttcaagcttccaacagactaggagattattcatatttttgttcatttttttacactgctttaccaaagcaaggggaaaagaagcagcaactagctgattgactggagagccaacattatttttctctctgaagtatctcatgaactgacgcccattgcattgctttcatatatttataagaaccagcaaaccagatacattaactttgttcctcacaaaaaaataagacataacaacatataactttgcaatatataggtcaaaaccgtacgggttttacctaataatttaacagatcacaagcagagttggataagaaagatacaacacatgcatgtgttctttgttagtggttagctgacaaccaattgcaatttgcaagcaaaacgaaacaattaataatgatcttggtacggactacggacagaaacatgagtgtacttaaaattgatcaacctgcttcatgccaataagtacgatatatatctactaagattttcaaggctgcatgcatattacatcatatagcataatacaattatatttgtactgcacattacagtactgagtaataatctgttcctttttttttcagaaacaaacattccttcatatatattgacaacattgtaaaaggaactggatagtccttttttttcttatttgttaaaaatataattgtgttccacttaagatggagacacatatatatactagttcatgtgaaaaatactgttcttgatggacagaaaagtaagagggggagtgctttctcattggctgcaagtagctgaaataaaaattcaaggctagggctggttttgtttagttgggatgtcggagttttgagaaaaggacatgcatgcacccggctacctgccatctgcacacagtcccacacacacaaaaaccctaatcttttcactggagacagtagtacatttccatcgggcctaatcctaattatcatccacaacaaaactacatccacccactctcatcaccatcctaatttaggaccaacatcacaccaataagttaaaagtagtggaacagtaggacgccgtatatgtctcttcttaaaaagtaggtatcgtgtgtaaaatggtcatttcagatgaggttgtcactgctgtagatcgacatgttagattcttactagtcgcgttcgataaatattaacaaaatgcgggtaccagttctcatccacgactaaagagagcgattatttttttacaccagtcatcagcacaccaaacagagcaccactagctcaatagggggaccagtctaagcttgtgatcttaaatagaaaataaacaaataaatgaagccttcaccgaaacaagttaatatgctaacctgcaacgtacatgataaactatatttccaacatttgaattcacatggcaaacggggacccaaagtcaaaataaaaccgcaaataaccccggggaggagcatgcaggggaggatgggggtaagaagaggggtgtgctccttgggaagaaaggccacctaattaattaagtttttgcttagtttatagtggcacccaaagtctctctctctctctctctctctctctctctctcctctccatcaagtcttcatgcttacatgtccacctttctccctcccctctcttcctttcttataccccacttgccctcctcttctcagtttctaattaagcagaagctactcttcttcttcctcctcttcttcttgagctgtccaagctagctacacctactaaacctccacttcacatacaagcagctaggttcaaacctagcttgcctagctaagcttgagaggaagagggtttcacacagagtgagcttctacctctgaatcactctacctaagacaagttagaagagagatacatcaaggtatgcagatatatgtgtgtgaattcagatctcctcaaatttatgcatgcagcaatctccttttcttgatttaagttgatctcttgttgatttcttgtgttctactgcaattgcatacactaatatactattagaggtagattgattatgttgtattattagcaggcagctgacatgtgtctctgcagcagcagagaagcaattagttgagagattaagcatgcagtgcattaattgtgcttctcctggagcagggtcaagctggcgaacaggtcgtggtggtcgggccccatgggcttgccggagcagccgtccggctcgtcgggccccaaggcggagctcccggtggccaaggagccggaggcgagcccgacggggggcgcggcggcggaccacgccgacgagaacaacgaatccggcggcggcgagccgcgggagggcgccgtggtggcggcgcccaaccggcgcccccgcgggcccccgccgggctccaagaacaagccgaagccgcccatcttcgtgacgcgcgacagccccaacgcgctgcgcagccacgtcatggaggtggccggcggcgcccac

SEQ ID NO: 1287 - DNA, 15015 bp, Oryza sativa
ttccctcgatactgctacctaccatctcctcctcctcctctatagtattgtggtggtgtttggttggagggactaaagtggagctaaactttagtccctctcacaaaaatataagtctctactatagggacttataattttgtaagagggactaaatttagtccctagttcccaaacaccccctgtgttcggccaaactaaatttgggttacctcgtaaaacggttatcatagtaaccatatagttaccatgaggattactatgattttaaaaattaaaaaagattatcatgcgtgataatcgtgcggtttcttaaacctgttgttcggtagcagactgccagttgcagcgatttggagcgtctgattggccaaagcattgttcatcagttatgttaatcggtactagtaaatcaggggaagatcccccatctgatcatctgatgctccgtgatcactgctgtctcccccacttgctctcactaccgaccactgctgatgctcctcttcttgctcggtttctttctcccgcggacactgaaacccaacaacagccaatgcctatcaacaccctaaccacttgctgcctcccatggcgtaagccctcctgcatagctggcgtctttaccttcctcttcctcttcttggtgcctctctcggtctctcatctcctctcctctcctctccaggtgacaaattctcccatccatccatcgattgctatcttctcttccgtatttctttgttcattggtctcttttgcagatcaattggatggcatctttccctggaacccaatatcgatagcttcactgttgcagacaacaaactggttctgctcaactttgaggtagtaccacaaagcttcagaatttgttggatttgctccacctctgtcctgttttgggatccaaagtgctacagggattcactaattcgtcctgtattcactttgtgttgattgattgattgattcaggacggccgcccagttcgatgaatcgatccgtggatccaattctgctctgctgaagctttgatctttctggtaattcacgaaggcaaaggagaaaaaaagatgaagctgatgctggttttcttgtcctaattcctttgcctgctttgcttgcacatacagattacagatgatgccattccgggatgttgctctccacttggacgccaggatgcttccagggcaataaaatcttgttaagatctctaatcacatggtattatctcgaatttatgccaaagctgcggcctttttattttcttttttacttaaccttgccaagttgcgctacggattcgccgcctatttctgacaaaagctcctccattttcctcccattggcgcagcagcagcagctagtccactggatgatgcctccaagattcagatgccaagattacctcctgccgctgctgctcgccctttcgccggccgccgccgccgcccgcgaggtggagtaccaccattgccactgcgacgacgtcggcggcggcggcgccggggggttgtggagcatggacagcatcttcaggtggcaaaaggtgagcgacctgctgatcgcggcggcctacttctccatcccgctggagatcctctacttcgtcgccgggctccggcatctcctcccgttccggtgggtgctcgtccagttcggcgccttcatcgtgctgtgcggcctcacccacctcctcaccgccttcacctacgagccgcacccgttcatggtggtgctcctcctcaccacggccaagttcttgacggcgctcgtctccttcctcaccgccatcacgctgctcaccctcatcccgcagctgctccgggtcaaggtgagggagagcttgctgtggctcaaggccagggagctcgaccgcgaggtcgtcctcatgaagcggcaggaggaggcgagctggcatgtccggatgctcacccacgagatccgcaagtcgctcgaccgccacaccgtgctctacaccaccctcatcgagctctccagggtgctcggcctcaccaactgcgccgtctggatgcccgccgccggcgagatgtgcttgacgcacgagctccggcgagacggcggcggcgaggatggcgtcgtcggcgtcgacgacgcggacgtcgtcgaggtgcgggggagcgacggcgtcaagctgctcgggccggactcggtgctcgccgcggcgagcggcggcaaggaggagggcaccggcgcggtggcggcgatccggatgccgatgctgaaggtgtccgacttcaagggcggcacgccggaggtgatccagacgagctacgccgtgctggtgctggtgccccccgccggcaagagctgggggcggcacgagatggagatcgtcgaggtggtcgccggccaggtccccgtcgcgctgtcgcacgcgacgctgctggaggagtcccgggcgatgcgggaccggctggcggagcagaaccgcgagctgctgcaggcgcggcgcgacgcgctcatggcgaacgaggcgaggcaggcgttccagggcgtgatgagccaggggatgcgccgcccgatccactccatcctcggcctcgtgtccatggtgcaggaggaggccctggcgccggagcagaggctcgtcgtcgacaccatggcgcgcaccgccaccgtcgtctccacgctcgtcaacgacgtcatggagatgtcggccgacagccgcgagcgcttcccgctcgagacgcggccgttccacctgcacgccatgatcagggacgccgcctgcgtcgcccggtgcctctgcgacttcagggggttcggcttcgccgtgcacgtcgagaacgcgctgccggacctcgtcgtcggcgacgagcggaggattttccatgtcctgctccacatggtcggcaacctgattggccgcaccgagcccgggcatgtcacgctccgggtgcgcgccgccgacgacgacgtgctggacgacaggctcggccagaggtgggatccatggtggccgtcctactccactggctactcctcggtgaagtttgtcattggtgtcaagcggcagcagaacggcgatgccggctcgccgctgtcgcggaggccgagtgggaagggcattgatctcagacttagcttcagcatgtgcagaaagcttgtgcaggtagtgttattgcctggatcactgcattgcatctgaatcatctgaacatgaaattagcagtccaatctcaagagagcatattaccactgatgctgatgtcctgttgatcctactgacagatgatgcaagggaacatctgggcgattcttgatccccaagggctaccggagagcatgactctggtgctcaggtttcagctgcaatcgccactgacatcatcaagccttggaggatcattcgagcagaagcactcgtcgccgtcgtgccagattgcaggcctgaaggttctgcttatcgacgacgatgacgacatcaaccttgtggttgctcggaagctattggagaagctcggctgcgtggtctcctcgccgccttcaggatcaggatttctcagctctgttggctcctcagcagcagccttccagcttgtcatggtgaacctcgaaatgaagagagtaaaagcccttgatgtcgcgacgaggatcagccagtacaggagcggccgatggccaatcgtcatggccatggcttccgaccagaaggcctgggagaagtgcgctcaatccgggatcaatggcatcctcaagaagccggtgattctgcaggagttgaaagacgagctggcgcgaattcttcagagcacatgatgctgatgtttgctggaggtctgtttgtctaagagctctgaagtctgaatcggtaaaagctgtgaatcctgtgatcagtgtacaacctcgtcatccagcattgaagaatgaagaactcagaagaattctgtgatcagtgtacaatctcgtcatccagcattgcagaatgaagaactcaaaagatcttcgcggcgaaaacggggaacatctctaacgaaagaaagggtgccctgatggatggcaagaacacatggaatcttggcagcaatggcgtccccgagaaatcttcttcgcacaaattttgtaatatgagtttgagtgggaatacaagtcgtgtaattttctaatgatcgagatgtacactcgggtgaagtcaagggaattcgtacttgactctctctgtcaaagcaaatcatgagattggaatcaatgagatgatatctcaaaacactttcagttgcactgcagcttgcacgtgacgccgcgtacggggaggaattgatgaaattgagaatcgaaatgggtttgacttgctaaaatcgagtagagagagatgggacattgatcttgaggcgaggagaggtagaacgtgggattccattatcttaaaaaaaaaaagtagaacgtgggatgtgtgggaggtgtatcacggggaggaggatcggattgagatttgcagggaaggatcagtccgtaccggatcggcagcagatcgcgcattcgcaggagcaggcgccacgtcgtaggagggctgatcccttcccggcgagcaactccatgagcgccggctgcgccttcggcggcgccggtggcccctatagatccggttggttcgcctgaaaccgcagccatgagctcgacgagcaaagtacggatagcgtccaggaggagtagagggagggcggtttgccgaagcggtcggggtaggagacaccgaactcgagggcgagcgcggaccgccgcggcagaaggggcggcgctgcacgccggcgacggcgagcgccgaccgccacaggagcgggtggcgatctcgtgaggcccaagaacagaattggatattacgtgtacgtgcggcccaattttgttgggccgggacgaaattacgtgcttccatgctagttgggccgtcagccgagacctttcttgtggcccaataacggaattgtgagttacatgcagccgattttacctaccgactggaaatttcgacatgcgtcaggccgatttatgttgatggaaattacgacatactcctacaccgttgactttttagcatatatttgactgttcgtcttattcaaaaacttctgtgaaacatgtaaaattatatgcctacataaaaatatatttaacaatgaattaataattacttaaattttttgaataaaacgaatggtcaacaaacatttcaaaaaaatttaaataagacgaatgatcaacaaacatttcaaaacaaacatttcaaaacggagggagtgcttacgttcataggctttctatcaacttgtccaggagatcaaggagatagctagatttgctactactaacgtgcagattgtaaatccacatagtagcaacaggggcccacaatttgatgacattagctactataataagtgcaaagcaaaaaaaaactttgtaaggacaccgagcagataaactgtctagaatacaaactacacggcagatctgtgacaaggttgatccaattctaacagagatccctcatttcaagtctggacacttttagaacagaggtagctggaaacatgagcatcaagaggtgccatgacaaaaacgcgcagcttcaagcgatttacagcttggctggctgcctgttcttcttcttcacaccagacttggcaacctggaggctgcggtacactgagctaagccttgcaagagccggtttggtcagatctggcctgtagtagttgtcactaacctgcgcagaaaagaaacagctgttaagagcacaagctatcaaagatttcttcaggaaggtacatacaggaaagctgctgtagagagaacagtagcagcttgattctgctcagaagccaagcgtaacaagtatttgtcatcgaagaaccaattgataggttggccttcttatgtgttacggctcatcacagcagcatcacacattgtaacctcaaacatgggaaaaaaatttgattcgagtattgataaaaacaaaacattccttacagactagcttgtgattaattggcaatttactaattttcagatcaagttataccaattgctgtaacaggagtatttcacagaaaaacaggagcaatctctgagccttcttccatgttggggcttatcacagcagtgaatagaaaagaataatgaagccaatacgagatattaaggctcatcacaacagtgcatctaaagcatagagcatcacaaggcaaaataatgacatgaaactaagcatttatcttccaaatacctggttcttgacagccttagccatcttgcggaactccttgcgcatcacagacttgtggtagagcttagctggggcattctgcttcttggtcttggtcgtggagaggaccacagccgcgtcctttccacctgatggctggatcgtcacggtcttcttgttcgccaagccttacagaacacaacaacactatgtcaggacattgcaaaggctgaatcaaaggcataatttgcatctaaagcctgtgacgttgcgagaagcaactactgaccagagtgcttgtaggagtgaacattgtacaggttgttgggctccttggtgaactgcaccttggcattgctgtttccaaactgcttcacgaggaagcagttgttcttcttcacaatctcccagaacaaaggctccggaaccgtcgccatttcgctgtagctacatcaccaaacagatcgaccattacaccatagcaaatgaccatcagaccactaagtgaccattaacacgcaaaaacattacacaacgctggcagcaatggtgtcgatcacaaatggcatctgccctaaaatctctcatccaacatcatattgatcgaaatggctagccctatcagctatcagatctagagaacacggatgatgcgcagattggagcatagcgaggcgatctaacaagctaaacaacccgcgtgcaccgaattactcaaactaaaactaagtttacagttattgcagccaaacaactgaccgaaaagcataatagtatcactgagaatttcacgacaaaatcgaccggtcaccgagaatttaaccgcaagaggcagcgatcaaatctaccaagcaataggtcttacagtggaaacagcagattttaagatttcggcagagaatacaagcgcgaggggtgtcgaactcaccggagacgatgaagccgcggcggcgcgtcgctgtgctccggtggcgtggtggtggctgcggcctgcggaacggtgcgacggcggcgcggaggctcgcttttatacctgttcgtccttgctcacaaaccctaggttagctccgcttttaatgggctttattgggccgagcaaataatccgccatagcccatgggctactagacgggccgaaaaagcccaaaacacaagaccaactgaccagccgcctcatcaccgaattaaattcgaaaatatactgttccattcattttatttttagaaatattcaggattcaaagctttttgcaaaaatataccgttgatctcgcacaaccattacgcgaaagtgaagtggcgtgacgtcgcgggcggtatcgcgcgggggaagcgtgagaccgtgcggtcgcgcgaaatgaaagagcgagaccgtgcaatctcgctgaaccaatcagcgataccgtatttcaaaatggtgaattagtgattaattattatgattaatgactaattattattagttaaatagataattacgtcattagtcactaagcaaatggagtttgctcgtccttcccgcgacagcgcgcggtcggtgcgagagaccacacggcacacggtctcgtgcattcgctgtgcgataccatcctcgacgttacctttacgtcattttcgctcatcggttgtacgagatcgacggtatatttctataaaaaaattacatcctgaatattctttaaaaaaattaaatgaacaatatattttcaaatttaattccctcgatcgtctcctccaactccggcgccgcctcaacaagacgaagcgttccgtctgaatctgattgccgccggcgacgaacgctccgtcaaattccatagataaaaagctctttcttccactagatatattatcaaacagggacgacgctagagtcacttatcagggtcagtagaccccgacgatttttttgcaaacatcttgtaccagcactaatttatcagctacgaccccagtcaaaccccggtggtccggtgatattgttctgttcaagctcaattagcaactaaacaatactaacaagtagtaaatagaaaattagcaagcacttattatacgacagcccgatatacgtatgagatttgagcccagaaggctttgtattcctgctaaacaagtccacaaattgccttgttgtgctgctctgtattcctgctgcagtgcagtctggctcgaagcgcttcgcccaatcgtcgccgattggcaagggtaacccactaaccccatcacaatttcttaattattatcatcacaaattggttgtaggctggtttctcaagtccaaaattttaggaagttagggttctgaaatatgaagtttctcccaatttctgttacataaacataaatttattctttctagaaaagtggaaggtaagaaattagtgattttgatcatctacagcagcgtgggtattttgttttacataataatcattctattttttaataaattaataggcaagcaaagtataatggagtgtgattcttgagaagaaaaatacccacttactagttcatgtggtactaattctcctttatcagtggagataaccttctcggtaataaaagttgtgtagacaatactgcacgcaatcgtatcggtaataaatatatggattactccttgcgttttaaaatatagctacagttccaaatgatgatgacgtggttgttcgttttcacaagatgaaggatcgtaattgtacacatgagaagtttgtaacatgtaaaacataaccactttacttaaaaaaaactttattttatcatattatatggtcgatagttttattctaggattatcttaagattattataagctatagtcagttagtggtgaccccggtgactatttttcctggcttcgtccctattatcaaatgaagtaggtacaacaacttctccaaaacaattaggatggcatcacgattctcgagtaccagaacaaaattcagtacaactatctttttcatccacacaacatatggcgagaatatgttcccaaatacttgtgattttagctactaaaatcacacacttgtcagcatatacatatcagggatagtatgttctgttgaactaactagtcgtgtcaaggtctatgtatactaccacttgttgatgagctgatccatgtctgaattggttccagagactggtatattctgaaaccaactttctgtaccttaatgtattcagggaaaaacaaaagtgaagtagtagctggacatgattatttcttcgtaacaacaagtgaacaaacaggggatcaaattcagtgtgctcaaaacatctgctgctataaccgatagttgtatgcctttggatttcgtacttacctgagaaccagagtacaaattccttctagatcttatttggtgccaatgtacaatgggaacgtattactagtgtctgtctccgtagctaattaaccaatcatcagtgcatatagattgttgtcacatatatatgtcttcactgtaaaatatactccctccgtttcgaaatgtttgacgtcgttgactttttaactttttagcacatatttgaccgttcgtcttattcaaaaaatataagtaattattaatttttttctatcatttgattcattgttaaatatatttttatgtagacatataattttacatatttcacaaaaaaaaattgaataagacgaacggtcaaacatgtgataaaaagtcaatgatgtcaaacatttcaaaacggagggagtatattttatctcttacaaagtgtaaatttaaactaaatgaaaagcaaatagtacatacattttgttattggatgactgcaacatagaaaaaaatccatggcaatatatgttcaatgacagctctgaggaaatttgcattcttcaccattgaaattttaccataataaaagcaacaagaagtatattgtttcagatatattctgtgggggtaaaatgtgaagtacatagaaagctacctaagctagagatctaaattgaaccaaatactccttcaaatcaactcaattatgatgaaaaagaatacgtaattgacacacatttaagtattgattcgatcatgagcctgcagagcctgaaccaccaagtctcagctccaaatccaattcctcctcctccccatgatcatggccaccattgccatccccatccttggagcagcagccgtagcgatctcgtcgatctctaccaccaccttcttcccgacggccggcgccgcgcccaaacagccttagctcttgcggcgccggctcggcggtacgggacctcaggctcgcgccgccgccggccgtcgtggacgccgccgcatcctcgcttcctccgctcgccggcggacgaaacaacctcacgagcgtatcgtagctgacgcttcgccttgccgccgccgccgtcgtcgacgacgaggaggacggcgtcgctcttccaaccctgtccttccggtggacgttcatgtgcccgccgagcgcctgcgccgtcgggaagcccctcctgcagaaggtgcagttgtacggctgcctcgtgccggcctcgtcgtcgtcgtcgtcgtcgccgctgcgggcctcgcggagctcctcctccgccttgtctccgtcgccgctcggcgaccttccaccgatcacctcgtccttgctggttttttgactcatctgcttctgctaagctaggtagagagagagagagagagagagagagagagagctagggtttactggtttactggtttgttgatgagattcagtgagcttagctgcttattgggatcgaatctaagctagccgattgtgaaaatgaaatgtacagtcaagcgagatagagaaatgcaagtgcacaataatcaatgaagtttttatgcagctcccatgaccattgtgttagagattacctctcgctgatttggatgttagccttgttttatgtttcttttttgctcattctgccggccgcaacagttgtttttgtctccgtgttatttgattttgatttgatttgattaattagctgattgattaattaactaattaatctgagttgttcagctatggccggccttcatttgcaacgacctgactggttcttggcctctagtttatcgagggtggtggcttagctacctgcagtgtgcttttgtaagcttgtgcttggaagcgtttgttgttgagtctttataggagtaatatattgtgttacgctatatgacatgttcaaccttttcttatacatagtactatcctatattattgactatatatatcattattccacatcatcattttcttttttattgataacaagtcatgtcatcatgtagtttacccaaaaagaaaaaaagcagaagaagagaagatagattcagtttttaaccactagtgttgcatgaagcggtatgaggccatgaattctcacttccttgcgtgccgctacggcccatcaaggcctatcccagaagctcgtggcacgcgaatagactggcccatacatgtggtttttggcccatccaaaataatgacaagagtaagggcatgttcactttgataccattttcaaccataccattttctagtaaagttgctaaaaaatgactacgtttaatttattgccaaatttgctaaatacaaaagaaatcctgccaaatttttggcaatgccaaaatttggtaaggtttattttggctacaatctaaacatgccttaaattttactttaagacaccttttattactgatgtttcgttttgaatcaccctttaaccaatgctttcactttagaccaggtaattttacctctgtgacactttgggccacccctcaaatcttttatcgttctacattcagtttgtcatatgtcaaagaagcaatctaatggttgatggagtttattgacaagtatgagccgccatacacttgtacttaaggtcattctatgcatgagaagagagttgaggtggttcaaagtgcaacaaatgtaagatttacccgattaaaagtgaaaacattggttaaaaggtggttcaaaacaaaacatcggtaataacaaatggcccccaaaatttttttaatctaatagtaaatccagaacgtgatgaacaaaaccagatggacaagtaacgaaggcaaaatcacattccaaccgtatcgtgtcagcgattagctcgatcacaattcacaaacaacatcaacacatgagcagaattttaacgaatactttcgcttttgcatatttacagcaaaacgttgattaattcctccagagctcgccgctccggtcgccgccggtgccggcggacgacgagctggcccggtcggagatggacgagagcggcgtctcgtcgccggcggcggccaccaccatgtccctgtacgtcttcctgaccgcccacagcgccctgcagcactcgcccatgctcggcctctcctgcctcacgggggcgaggcaccggaacgccagctccatcaccatctccgcggcgcgcgccgtcgccggcgtccgcggcaggtgcgggtccagcacgtccgccgccgcgccctcggcgagcttgcgcatcgcccaccgcgccgtcagccgctcccgcatctcccgcctcgcctcgatgggtcgccgcccggaggcgatctccagcagcagcacgccgaaggagtagacgtcgctccggtcggtgagctggcacgtcttgaggtactccgggtcgaggtaccccgccgtgcccttcacctgcgtcgtcacgtgcgtcacgccgtcggcggcgccggcctcgccgacgcccagccgcgcgaacccgaagtcgcccaccttggcgcgcagcgacggggtgagcagcacgttcgacgacttgatgtcgcggtggatgatggggtgatcggcgtacatgtgcaggtacgtcaccgcgtgcgcgacgtcgatggcgatctccagccgcgcgcccatgtccaagaacctcccgttgcaccctgcgcccaagaacctccattagtaaccaatccgatcgagctcgagctcgagctgcaatggcggatcacacgcactgtcgaggtgctcgcggagcgtgccgttggggacgaactcgacgacgatgaccctctcctggccgcactcgaggtagccgtagaagcggacgaggctctggtgctcgatgcgcgccatggccttcacctcgctccggaactccacgtccacgtgcgggttctggtcccggagcttggcgcgcttgacggcgacgagcgtgccgtcggggaggacgcccctgtagacggcgccgaagccgccctggccgaccttgagcgccggcgagaagttgttggtggcgcgcaggatctcctccatggagaacaccgagctctggaactgcgtcgcgatgcctcttcccctgctgctgttgtacagcccgcgcatcgacgccttcccctgatcactgccaggccccggcactggaatcatcaaacagattcatctatcaagaattaattcccaactgcttaattgctgctctgaattttgaaaaaaatgtttgaagtcttctgtgattcagattttataaatatgattctgtaagctttgcactagcaattctgctccagaaagtaaagaattcagagtagttgcggcaattggactgtgataattgactgtttccaattcagagtagttgcagccggcaactggactgtgataattgactgatttcttaacagttcaggaacagttgcatcaattgggcaaataattcggattatatcctgtttgcttgagcaattcaaatcgaggtaattaaggacaaggatgaaatagatggagaagaaatgatcgagagaaacaatttacatggcggcttcttgatcaagtcattgggctctcttctgctcctcctcttagcgttgctgccggaggcggaggtggccgccgccgacgacgaggaggaggaggaggtggagagcgagctgaaccacaacccgatcgtcctgaagagcgacttgagcgacgccgccctactgccgccgcccccgacggagagcggccgcgaccacgtgggggcggggctccacggcgcccatcgctccctctccagctccggcgtgcgcctcccggacgacgaggacgacatgctgcggcggcgctcgcgtccctccatggccgcgcagccgcccgcctccgctcagagctcccaacgcgccggccaccagggggcgcgtacgcgcggcgtggacatatagctaagctcggccaagtcaaggggcgcgaccatgtccaacgccggcgagcgcgagccggtgggacccgaccagttaaacatcagtgtcactgtctgtggggccggtgatgtcctggggcccacttgccagtgagacgcggcgtttgaggtggacctggcaagcgatgactagttcttcttcttcagacttggcttgttgctgcagacaagagtgtgatacaaatgtaaggtactgatcttgatcggccaactacactaattgaatcattaacatctccctcttcagcgtatataagctttagtcggggcatcacgtatgttcgcagcaactttcaaatcgcattttttttttataatccataacctatgttcaaagttcaaatccatgggcacacacggcacgcaacaagtccgtaaagtttttatagcccttttgcagctaatttagtcacgcgtatcctgagagctcactctatttgtcaacgaaagcaacatgcgtcacagcgtcagctaaaccatgtctccagctggcacttaagcatgcagcaggtaactgtgtcaccgg

SEQ ID NO: 1288 - DNA, 9810 bp, Oryza sativa
  unsure (1)..(9810): unsure at all n locations
aagtcaacggtgtcaaataaaacgaaacggagggagtaccattcaaacttcaaagagaagcagattaaggaggaaactaaaaggggagaaagaggacgagttcagagaaatgttctgaaggcggaaacaattgacccggacaagattgaacacactggttcagacatcttagaccgggcaaatcatttttgtatacgtctgatgatgaatgactcgctggcgatttagacaggacagacgctgaaccagaattggacaaaacaaacacacacatagcgccaaatttcaataaaacctttccaaaatttgatactgtcaatatttaggaaggtaaacgtgtagtataagttatgttccgtacctttgccacgttctttttttttgtgaaattctaggattaccagtgcaagtaatttttagcaatgttttgattgttattactaccattttgatacagcaaaattttggtagggttaatcttgacaataaaataaacatcccatactatataacatctactactatatctataatttcagctttctagctccgaacgcagtgaacctatgttcattctcagggtgcaaaaagtagtcatttcatagtaggagcgaattttagattgggttatttataaggctaagttttaatttaaataactgtatatatccaattgaatgtacacgtcagataaataatactcctacctttctctctcgaaaaaaaaatctgtagccatttcgttcagaatcacggcggaccgccggtcgaacgctcgaaccgcattgccagcgtcggcgggagggacggtggcgtggaaagagtgcgaacggcccatgaaaaaccggcccaaacatacgggcctcacgtgggccgcgactcccttgcggccctcgggtttagcgcaacaaaaccgacgacgaatagtaaacgggccacaacggtctccgtggtcgtcgccggcgatagggaattgtgaaggctctgcagcctcactgccactgcggcttctcgccaaagatctccatttttttttattttttgcctaagaaaactaagagaagtactccctccattttcagtttataagatattttgactactactttaaatttgattaaatttatagaaaaaataataacaactctaatctaagataaatttattatgaaaatatatttaattattggttagatgaaactaatttaataatataaatattattatacttgtctataaacttagttaaactttaaactttaaatttaacgttttataagctgatacggatggagtaacaaacataaatcagttgagagtgagagggacgtggaaaagtagagccatccgcgctaaaagagggggggggggggggggggtgttaagggaagctatgtaccaacgccaaaaacggcaaatcgaggccgggattgaagtgcggcaatccaaccccaaaccccttccattgccctggcctacaccgagccccttcttctcttcgtgcgccacaccacccaaacctctccgggccaccacctccttcgcttctcgcacactctcgcccgcgacgctgactgtcgtatggttgttgccgtgcaagacgaccagacctgcgcgctcgtcgcctcggttggcaagggcgatgaggatgacgacgactactacgctgttgccggggaggaggaccaggacgaggaccacgcggcccgtggttcgaaccgcgcgcggggcgtgggaggtgttcgcggcggagtcgcggcggctgtgggcgatcggcgcgcccatcggcttcaacgtcatctgcctctacggcaccaactccaccacgcagatcttcgtcggccacatcggcaaccgcgagctctccgccgttgccatcggcctctccgtcgtctccaacttctccttcggcttcctcgtgagtcctccctccaaatcctccatgcgcatccatcgatgggattgagagattgtaatttgggcaatggcaatggcagctcggcatggggagcgcgctggagacgctgtgcgggcaggcgttcggggcggggcaggtggccatgctgggcatctacatgcagcgctcgtggatcatnctcgccgcctccgccgcgctgttctcgccgctctacgtcttcgcggggcccatcctgcggctgctggggcaagaggagagcatcgccgccgccgcgggggagttcacggtgcggatcattccccagatgttcgcgctcgccatcaactttcccacgcaggagttcctccaggcgcagagcaaggtgacggtgctggcctggatcggcttcgcggcgctcctcgcccacgtcggcctcctcgccctcttcgtctccgcgctcggctggggcatcgccggcgccgccgccgcgtacgacgtctcctcctggctcaccgcgctggcgcaggtggcctacgtcgtcggctggtgccgcgacggctggacgggcctgtcccgcaaggcgttcaacgagctctgggccttcgtcaagctctccctcgcctccgccgtcatgctctgcctcgagatatggtacatgatggtgctcgtcgtcctcaccggtcacctcgacgacgccgagatcgccgtcgactccatatctatatggtactccctccttccctagatatttaacactgttaactttttaaaaaatgtttgaccgttcgttttatttaaaaacttttgtgatatgtgtaaaacaatatgtatacataaaagtatatttaacaataaatcaaatgatagaaaaagaattaacaattacttaaattttttgaataagacgaacaatattttaaaaaaagtcaacggcgtcaaacattttggaatgaaggtagtataaaacactaccatcaatgattatgttgcgatcgatatgaatgataaatatacatatgtttgatgcagtatgaatataaatggatgggaggggatgctgttcatagggctgaacgcggcgatcagcgtgcgggtgtcgaacgagctcgggtcggggaggccgagggcgacgatgcacgcggtggtggtggtgctggtgcagtcgctggcgttcgggctgctggcgatggtgctcatcctcgccacgcgcaaccacttcgccgtcatcttcaccggagacaggcacctgcagaaggcggtggccaacatcgcctacatgctcgccgtcaccatggtgctcaacagcatccagcccgtcatctcaggcaaccattcacatctcagcacttcatcatatactacctccatttcgaaatgtttaacgcagttaactttttaagtacatgtttgaccgtttgttttattcaaaaaattttgttaaatatgtaaaattatatgcctacataaaaatatatttaacaatgaatcaaatgataggaaaagaattaataactatttaaaatttgttaataagacgaacgattaaacatgtgctaaaaagtcaatggtgtcaaacattttgaaacggaggaagtatataattgactaactaaattccgatgaactgatccttggaagaattcattgtctacttctttttaggtgtggcggtcggcggcggatggcagggagtggtggcgtacattaatctggcgtgttactacggcttcggcctccctctcggcttcatatttggctacctcttcagatggggtgtgaaggtaaaattcagttcagttcaaaatcgtctcactactactacataaatgaatcatgcagtcgagcatatatatttaattttcgttttcgaaaattctacggaacttgcagggcatttgggctggcatgttgtgtgggacggcaatgcagacggccatcctcatgtacatggtctgcaaaactgactgggaagcagaggtgttaatcacagcagcatttttattcacgttatattcttactcgtagtagataataaactcatcataattgccatgtttatgctggttttacttcctgcagtcagtgcaagcgttggagagggttagattatggggagggcagccggagcacgagaagcttccgacgtcagagccggaggagacgatcatctagatagacatgcctccaatttttcatttcatttttttttgctaccgctgttgctgtttaattagctaggaggttagttcataggtgagagtatccatggaagagaaggggattgaggagtgagattttttttaggcttttgtgaatcggctagcttgcagtcacactgcgcatatgtgtaggattagtgataggccgcaactaagatggttaactaattaatcattaggctcgatcagtatggtttcttgtacactgttaattagtcggttactagtcatacacttgtgacaaattctgtaccgattgctcattctttgcactggacggttcgacctgaaagtagcagttcgatgatgtgcagattgattttctaacgtctgaccaataagaacgccatcggtgctgggaatgcatgccatgggcgttgatgccatcggtgctagcatcatactccaggctcgctcatgcagcacggccgtggattccccacgaaattaaatgaaatggagatggataaatgaaccaagctgaaatgttgaaacaataagggcccgtttagttccccaaattattttccccaaaacatcacatcgaatctttgtacacatacataaagtattaaatatagataaaaagaaaaactaattgcacagttatagaggaaatcgcgagacaaatcttttaagcctaattaatccgtgattagccataagtgctacagtaacccacatgtgctaatgatggcttaattagtctcaaaagattcgtcttgcagtttccaggcgagttctgaaattagttttttcatttgtgtctgaaaccccttccatttgtgtccaaaaaccccttccgacatccagtcaaacgtttgatgtgacacccaaaaatttccttttccccaactaaacacaccctaagaatgaataaaatggaatgaagaaaaataatttattaataatgtcagacatgaagaaaaaaaagaaaaataaattgaataaaatggaatgaagaaaaataatttattaataatgtcagacatgaagaaaaaaaagaaaaataaattgttaataatgtcagacatgaagaaaaaatataatgtcagaagtgggatttgaacccacgccctcgttagaggaccagaacttgagtctggcgccttagaccactcggccatcctgaccgtcctgtcgttctaactttntttaaaggggccccctttttttaaaataatccatttaaaatgtgggagtattcacgatctgaccgtccattacccgtcactcgcatcaacggccatgatcgaacatcaaccctagncctcccctttacaaatgattcccttcctcgttccctcttccaaaccctaatccccctccaaaaccctacacctaccccctcacctgcggcggctgcggcggcggcggagagcaacatcgtcgagtcgacgccatgaggccaccgcgaggtaagcatcccaaaccctaggattactccccgtgttggtcttgcgctctctcggctcgttttgaatcttacgtgatatatgctttggtttcagggaggggattcgggaggggagggagagacgatggcggcgcccgcagtgccggcggtgggaggggattcgggaggggcggggacagcggagggagaggagnccgtgggaggggaggtggcaggacgccaagggcccgtggcgacgcccgcggtggcgggaggggtggcataaagggcgggagcaaggtggtcgtggtgccgcacaagcacaacggcgtcttcatcgccaaggccaaggaggacgcgctctgcaccaagaacatggtccccggcgagtccgtctacggagagaagcgtatctcagtccaggtccattgctgttaccttctcctcctctcatttttttgttcctcttttgtgcatcattcgagatataagctatagtgttacatgtagaaattctcttttgtgcaccattctctactgagctactataagctatcttgtatatgtaggaatctgtaagataatgttctgtagaagtctgtatgttttgttgcattgtagtgtaccctgcaagttatgcttattgctgatgtttctgcgtgaacagaatgaggatggaactaaggttgaatacagggtgtggaaccccttccgttctaagctggctgctgctgtgcttggtggtgtcgacaacatctggattgtaagtttttttttgttgttgaatcactgtgcgcagtagcttaggccgaagtgctaatgcatcagtatggttgtcagatctttagtttagaagagcatcacgtgttaatcgttgtttcatgatttaggctcctggtactcgtgtgttatatctcggtgctgcctcaggaacaacagtgtctcatgtgtccgatattgttggaccggtgagatgtcatttgctatcctcatttcttattcaggcaacatatgcaatttgcctttgctaattgtgtcattttgcagactggtttggtctacgctgttgagttctcgcacaggagtggtagggatcttgttaacatggccaaaaagaggactaatgtgatccccatcattgaggatgctaggcacccagcaaggtaccggatgttggttggcatggttgatgttatcttctctgatgttgcccagccagatcaggtatacctttctcacactatgatttcagtaccatgagattgccagatttattatatgattacctgtatttaattaaccgtttgcattacttgcattctttggcttcttctgggctgcaaatgatgagcttactcggattccccttcaggacatcaaattggatgatgcaaattcgagttcctgatgcgctaacgcccattatcacctgttctttatgtgctgctttctttaaccatctttgttgtcagcatgcattgctgcatgcaaccttctttataattccatctcaatatttgcagttttcatatctcttagctgttcgaattccattttgtgtttaatttccatctcaatgtgattcaaacatgttgagtagtaatcccgtattcttctgtagtataatagagtatattgtgacaggaagctgcattctttctatcgaaccacttcattctttctatcgaaccacttcttttatttgacatattttttgtacccatccttttgaaattggttttgaagtgttcaccttcaccatggttatggatttcttttggagcatttggtggcctcaatgtcttctattaatttgtacacttgtgttgctttgtctggctgtgttacgcatctgcagatttgcatgttagtgccatcactatttaccttgtccggcattatttaatgttttgataggggctttagcaaatgaggaacttactcggattccccttcaggacattaaattggatgatgcaaattcgagtttccaatgccgccgcgccttcattgtttctttcctttgcgtttatgggtattctgaataaaatattttgactgtgctagcaatttgccttatgcctgttttattctctcgttaggtgtaaaaccttcagtatcgaagttgatgcgtgccttattggtggccaatagtcatgtttttgtccatattcatttccttggcatgatcttgtttattttcttgactacatcagctgtggtaggaatttataggtttcctggtatagcgttctctcctattgttattatgttttatgcctctttgatagtgctagttaggaccagattgttatgtttttgctttgtaaggagtaatgaatactgtggagataaaagtttacggttcatatttctgtactgaataaacatacttgcagtagtttctataaggttgctgctcgagttaagagataatttgtatcccataaaattacctttatggaatcttccttggcatgtccctgtgttaaaaatcgtgaaggttctcacagaattcagttttgaaaccgtttgcaattttaatcttctactaccctgcaggctaggatcttagccctcaacgcatcctacttcctgaagaatggtgggcattttgtcatttcaatcaaggtacttttggtctttttttctcgctcctgaaacctgaagttaatcacgtttattgagattgcggagacagaagatgatagcagcattggactgacaaactgtttgaacaggcgaactgtatcgactccaccatgccagctgaggctgtgttcgctagcgaggttgagaagctgaaggcggatcagttcaagccgtcggagcaggtgaccctggagcccttcgagcgtgaccatgcctgcgtcgttggtggctacaggatgcccaagaagcaaaagggcacatcttaatttaaggatacggccatctgcggtcaaagctcaaatgtactagtagaactttttataagcgttagcgtttttgcttaagctattttaattagttcatgctgctgctggttttacagcaatccatgtgtaccgcgaacagagaagttgaaattggttgaatcgacgctaccgattaactatcctctcggccaacttaatttcatatggcacaatgtcatcacgaatcatcatggatgtgctactagcaaaagctttgtatgtgctggtaggtttcacgcaatggcaactcctaccacggtatttgatttaattttccgttgggcaaccataaatggattaaagtagcagcaaaacctgctgctgtaagtggtttaagggagagtgataaaaagaggaatcatccaggaataatccaggagtatattttgagtaatatataggaaaatggtgcacgtggaactctgttgggcgaaaaagaaagagagaggctagggggcccattgtaccaaagggaaaaccgctcgcggacgcagtggagaggagagagaaagaggcggtttcagaagcgcagagagagagagagagagtagaaaaatctccgcacgcaacgccaatccttccttccccttcttctcgcgagagagagagagagagagagagagagagagagagtagttcagttcccattctcgcctgctttcctcactcgcgatcgcgactccccccctcctcgtcgccggtaaggccgatcttcctctcccctctgccgatctgcgattccgggtttctcctcgcgtttctcggcaaccgctggcgactagctttttgggagttgggacgatcagttcttaatccctatgtgattgttgttgtggttgcgatttcttaattcaccgtgctgttattcgggtagcgatttcttcatcagtcaagtttgattagttgctctctactagtaggctagtagcaagtacttagacttggcaagactcgtattattacatctactgtggtgtaatataggcttgcttcagttggtgtatatacttcagtcgggcttcgatcaccccaacagttttatccctgtgtctctaggtataagtggctctgtcgttagtatggctagtgaaattctggttaacagttgctagcttctttgtcgaattgtaaacactttccattatatgagttgcttgtttacctacatcgatggcttgtttgctgcctagtctcttctgtatattatacacctcacagtttggaaatataagtagcgattaattctgtattgttttagttgcttgaattcacatactgtatgcccatctcggaactattcgagtacacctgccatgttgggctggtttggttttatgccct

SEQ ID NO: 1289 - DNA, 2979 bp, Oryza sativa
atgtctggtcatttctcggtttcaccgagtgaggttgagagtctccttaggggcactgacggcaaagagcacctaaatgagctttctggccaagatgcagtttctgccgaaggtgatgacgaaaaattccaggacacctgtgagcataaactgaaggatgaccttcactggattccatcctttgacaaagggaaaaacctttccctggttgacatggagtttgataaagcattccaagggatgggtttggttggtgaggaaccacttgggttctcatcatctcgttacaatccaattgatgctaacaatgagaagaaaactgaggagccaactgtgcaaaatgtgaaccgtgtcattgattcatccaaggttgttgcatctagtgaacaaaacaaacctgatgattctgaatttccacacgaagcttcatggaagaagcaactcttatcactgtacaagaatgtgaggaaaagcaacaaattctggcccatcgttgttgctactgctttggtgggagtcacatgtttttgaaggcgctggcagaagggcaagttgcagcatcagccggtcaaattgtatcccagcagcaatgaggtaattgtgaatgaacatctttgtttttaagaaaaaaaatgccttcctttttttcttttacaaaacgtgagggattttcctatggtcaacaagtaggtcggtaggaatgtaaggacggacttgaccagtagcagacatctttagttagaatcaaaccatatgcatcctcttgcaggacaggggcaggcctagatatttgatcgggaagtatgctgtggttttccccccgaccaatatgaaggtttctattatcacaaggatgtcttatagcacatactgtaatatccctttacaccttaagggcttgtttgggtaggccgaaatcatggtcaacacatgtggatcctgtatttgaggcccatccaaacaaatgctgttctgataagtatcttaggttgtaatgctaagtgagaaacacatggtgagggacaccttttttcaagtaactagaggattcccctcgcattgcagcgtaagccagaaagtcttcatagtatattacatttgaagggagcaagtaactgaaggcatgaatgatggttgagattaaactcaaagagagatccagtggcctatgttttttaggtgatgtggctcaatgcattttgagcatttggtgctaattatataggaatacaggatataagataagattgtttattttggcctccatggtttgctgaaatccagcatgtttgatgcttgttgcggcaattctgattttactggttatgaagtggttgctatcagctgagttctaattaacgcaggcttctgttggcttttcagaaaattaaccaagctgtaggaccgttgaatcgcatcaaggacatccttgttgccaacaatcacccagctccagctatccatggacatgctcgattgagctgattatgctcaccaagtcccgccaacatgctcatttatgagacatctcctgaatatgtacccacttgagtcatcatcatcagtgaagaatgaatgcactggggcatcatctactcaatactgaaaatcgtctgggtgtttatgcgttgaagttatgtaattgattcaaacccccccttggatttgtatttatgtgtttagtgtgattcatcttcttcctcttttgagagtactgctcctggtttgtcaattgcagtgccctttcaggttgctgcagaaaacttgtatatatatatatatatatgatcatttaggttgatgatgtttttggtctgtctgtgttgtgtgatcctgcttatattgtcaacacttacgtttgatttcccaagaacagtttagcagaagctgtaactcgatgagtcaggctttcagataccaaagctttgattacatcacatattgtagtattgtctgaagccactactgggtctctttttaaaactgtgctatattccattttgtattactagcatatcatgaataaatacataattaccccacttttacattgaagaagacaaaacaactccatttgaggaatgtgttgggtacccattggctgacagtatggaaattattccttgtctgttagtattagcatagaataatcttgccccaatcgtggtggctggctggccgaaataagaattgctgcaatggatttaagaagattgtttcaatcatgttcctatcctaaccacatggacgcgtttttgcagtgttaaactgaccaagcttgcaggcttctttagaggataataatagtacaaaatgatggcaattatatatataatacttaggaggagagtgagacaccttgattaacaccacacttaacactttagaagtagccaaaaaccagagtttggagatagccccagcacatgtgggtgttggtgtcatccccagatgattctgatggggacaaccaaccaaaccccaaaccttgcaagaaaaaaggattatgatgctaacaactgacagcaaccaaggtgtcaccctaaagcattagctggatttttctcatcttccaattatcactgcatggttgttacacctgcaacacagcatctcatcttcttctttttgtgtgtgtgtgtgtgtttctagaacaacaaattacagtggtcactcacagtgactgcaatcagcacctactttttcttggacatactattacttatcatccttttttcctatccttttttttcagtagacaagaagtatgcatcaacgatgttatgttctttaccagtgcgatgaaccaagtctacgttgaaacaaatggacttctatgctgaaatacaatgcaggtggcaatcaacttattcacagtaataagggaaatacataaattaaagagaaaaaaatgttactatcaagttgattagacagatacacagttcttaaataaaccaactagtatttcattaaaca

SEQ ID NO: 1290 - DNA, 7497 bp, Oryza sativa
ttaaagactagagttacgcacgcgtgagaaaaccttcacggaactctgcaaacacaaatatacgaatttcacattcgtaggacttgaatggaatttttacggaattgcagattttgaattttgaagtttggcgttgaaaagattattacagtagaatacaataataatttctccgtatgcgtcgcgtacgaatggttatacggtggagtttggtcaataaagaaagcaacggaatggaagctgtgcgtgatgatttcacgagcaaaagttgaagaaaaaaaaaagagagagaaaaatgtttttgtttgtttttccaatgggaaaaaaaggtaggtgggccccacccatctccagctgcacgagggggcgtgcagtcgccggctacctcaaaaggccctacccgcctcgccgtagtgcgaatgacaggtgggcccgggaaccgcccgagcgcacggatagcgcgtacgatgtggggtgcgtgcgattattattatcggctgcctccacacgcacacgtggggtgggatagtgccaccgggccctctccctgaccaaaatgccctcgcgaactccttccattttacgatactgccacctgaggtcaacaaccaaatccattttcctcccattatattctcgtttcacagcggtgacacacggagaaaaaaaccaatattaatttcggtaaaatacgaaatgactaatatgcccatgccctaatccccttccgtgtcttgtgcttctctcttccccggcagcgcgtccatcgaagtagtagcatactactctctactcctctcctctcctctcctccgctttggtttgctccgatctgcagcgagagcgggaggtcgtcgccggcgaggaggcgcggcggaggaatcctctccttcccgatcccgtccggtgcttcctcttcttggtctgcgagtaaagctcggccgccgccggcgacgaactggtttggggagagccacgtacggcgccgcctcgaatcgaatcgaattggaggtatcattccttctcgtagaggcacctcctccaccgcgtgtggcttgatgagcgggcgtggcgtggattgggaatccatcggtgtttgtttggtcgattgattgattgatttattttttttccttccattaaaccatcgtttattcgggatttgttcatgcgtagtggtagtggagttgtaatagcagtttgtttttttttcgaagaagaaaaaagaaaagaaaagagggaatccccgtgcctcacgttacgtggcttggaattttctttttttgatgatccattcattactggatgatttttttctcgattaaaacgtttattaatcttgcaggttgatttgactcgttggttggagcgctccatcgattaagcagacggagtcatgcttcttctttgggtataaaagtttggatctcggaggctcgattcaatctctggagtgggaacaatcgtttgctcgtggtcgtgggatagctcctctgcgagatgcagagtgggagcgagatgagacccgtgcacaacagtgtcgacacggtgaacgcggctgctgttgccattgttacagccgagagccgcacgcaacctcaggcagagccggttcgtgcctcactccctgcttccatgattttttttttcatgtatgatatcttcgttgcgtgattcagctgggtcatttaggtagcttacttcgatgatattgttgtgacggcgttcttggttgcttggtggtgggagcattactcggttgttttttagttaaggttgctgtatttagtaggcaaaattgaagaactgataggcaaggtacgttttgtagtcttagatgtggttttacgctagagtgttgatgtattggacagtaaacttgcatttttagggagaaactgcgtaagtggatctatgagtgcaaattttctttgcttattcatcacttgttgacttgcaactaatttcttgtccaccgtctttaacttttacaatatatcagaaatttttagcacttcaaatcgaaaatataacataaatgctgccaggattagttcctgctgtatatttttctagctattgcaatctatgattcatttatccccggtatatattaccatgtttgaccttgaatgaaacctatgtatcaccttaaaacattgaaaatatgcatggataaattaccattataaatactgtgagaacaaaggaggggaattgttgaaactgtcagtttgaactcttcagaggaatagatgggaccaaaagattcttcctgtgctggccatatgcaagtatgcaaccagccattattttattttaacttgctgaggccttggtcattcttgttttttttattacatggcctgctgtttgggctttcatctttgtatattattaatttccctctgagattacctctcatagggaaatgcagcactatggtgctcattcatgatagccactctccaggctatttagttcgggttatctcgtggctatgatcatttatgaaaccttcttaatgcttttattttgaactggaaagtcattacctggctaatgggggatctatgacgtaattttgatgatttgtggaatttcatttctagtttttcgttacggttacatggagcctaatagctcgatgatgctatatttctattgccaacctgtttacatgttcacgttattggtcatcctaactctgcaatacaatcgctatagaatgcatgtctgacaaaagctaggtgcaggctactgtactcgactgtgcttatgctgtttatgtgccaaatatttatgctacaatagtaatcttcttaagtcacatttcaggaggattaagactttccttttgaattaaatagtgttgttcttttgcagcgaagaaaatgggctgattggttgagtgtgtacttctgctttggatcacagaaaaatggccgacgcatcagccatgctgttcttgtcccagaacctttacctccgaggacagatgcacctatgccagaaattccaatccatccgccacccccggtattcccctttgtcgcacctccatcctctcctgcttcttttctccaatcaggaggtgcatctattgtacaatcacctgttggtgctccatctttttcgcctctctcgccaaattctccatcccccactgggccaccgtccatctttgctatcggaccatatgcacatgagacacagctagtctctcctcctgtcttctcagccttcacaactgaaccttcaacagctcctttcactcccccaccagagtctgtgcatctgacaaccccttcctcaccagaggtgccatatgcaaagctacttacctcaatcaacaacagcaaaaatgctgaaacaggtgagcttcagtcataccagatttaccctgagagcccaataggacgtctgatatctccaagctcagcttgttcagggacttgctctccatttcctgaccctgaggtgcagacttcctcacgttccacattcccctcattcccagttcgtgagcctccaaagatactggatggcgagggaattgcaacacagaagttgatacctcgccatatgcgcaatggcggttctctcttggatggacatatttctgctgctgtaccagtcgtagacttctctgcccgacttcaaaataatgatcatgctatggatcatcgggtttcatttgagttaacagtagaagatgtagctcgctgtcttgagaagaaaaccaacattaatggggagtctgctgcagcttcttttcgccttgtgcccaccggtaacggagatcacattcatcccagagaatcgaatgatacaagagcagggctatgtgttgatgaaacataccatgatctgcctgagaaagcacggcgctccttgtcccttcgtaaggctaaagaattcaagttcaacaatgttgatgctcctagtgtggagccgagcgttggatcagactggtgggcaaacgagaaagttgctgggatcacatcagagccaaggaaaagctggtccttcttcccagtggcacagccaggggtcagctaacagttgcactgaccataatcttacaagatgaagaaataagcttctgtcatttttgctcctgctgtttctcagttccccagataccatcatcataactgcaggagatgcaaacttatgcaaaatattccagttttagcggtaagttggagttagttagtaactcagtgtccagctaatatcatcataagatactaaaggtgatgcagattctggaacctgttgttataaaaccataatacttccatggtgtagcgtctgttgtatcctccttaactgactggctgttctgatactgatgctgtttatgtacataataaactagcgaaaagagtagaactcttcctagcagcagtgtattgtcagagtggagcaagcaaatgactctgatcccctcttcaattagttgtgctttggctttagcagaagaaacttgaaaatattgttctgtcgtgcttaccagttcggcaagaatttcaattctgtcttggcatatgtgatgtcacatctcttatcacaaattctgtaagcaacactattttgttgtgctctgtatattaaattgggccaagtgctgactgtttatatttgaatgtttgattacccatggtcattctgaaatgagaattattctacccttaacttaatcacgtcatttttttcataattaatggtgtatgaggattgttctgttgtagttgctgagcctggataggaacaaaagagctggaaaaaaaatcaatcagagctcttacgttgtgctggctagaactctggacgaaattcattgatggcccgccagagattacatcaagatcacgagacgttgatcgtgcacatagagaaacccgacgagcaataattatcactgatatgtcaagatttaatgaccccaatgcttgtcaagagacgcatcgctaacgaaaatattttcccatgcattctcgcaagagatgagcatatgcgtatctatcaatcttgtgttgcttctcataattatccacgaaataaaactatcagtacgattggaattatatagcttggatgaaataatgtcaatccaggagagcttgaactaaacagaacagagggtgttcctgatatttgtttttgtttgggtcaaaatcaatctacgtccaattgaaaccgatgaaaacgaaacacaaaacagcaaatatcatagtactgttcctattaaaaatggaaacaagaaaaatgcagcttgagtcaaaatccgcattaagcacggagataaacttaattaagcatgggtgattaatggaacagaaagatttgaggccatacctgagggagagagagagagagagagagagagagaccctgccccaatggtgaggattacgtttatctatcaccaaacccccttgtggcccctttctctcacctcacaaatcaataatttaggcctctcttcgccgccgccgtctcaccgccggtgagcttaagctgaccacgattgcccggcctctgtccctgtcaatgggccccgctgcgtggttaatattctccctgatcaatcattgcctgcccatatcaaacatgctcactaattaaattgtgagagggcgaagcagaagtgatcaacttccaaacttgtggtaaccaatcagtaacaggaactgtcgtcacaggttatactaccatagcaccatatcttttatttctctataacctatatgagatgcaatcgtatataatcattatcgacccatctggttatagataaatgctagttttgactttgagttgttctacttcgaacaatattttttttaataatttaactatttagcattaaaattatgccattagatttgtaaccagaaatagtttactagtactatcttacatttaaatatattcgctttgatatcacttagaagcaactgttgaaattcatctactatatttgtttttttaatacataacgttattaacttttgaaataatgtttgatcattcgcattatttaaaaatttactcctttcattttatattgtaagtcgttttggctttttcctagtcaaactcgtttaagtttgactaaatttttggaaaatctaaaataccgaattggttttatttaatctagcattgaatatattttgataatatgctattataattttctatatactcggtcaaactcaaataaagttgactaaaaaaaagttaaaacgacttacaatatgaaacgaacggaataatatagatatgttaagatataagttatacttaaagtttatttaaagataaaacaagtcatatcaaaataaatcatatttatatatattataaatggacataggaagtacaatacttgtgttgagatccgtcaattatttattaacagagaaagtataatgcctttatattagagtataaataaaatgcccctaagtgtgaatttagtgatataatattcacgtagacaatttagctgagtttgttatattggtgaacaagctgatgaagaggcatgaggtaataattcatctgaatatgttactagtagtagttagtgatattttaagactcagcagagggtgagaaacgttccacccatgcatctctttgcctgtcaattagtgacaataatagtatacaaaaatcagctgatatgaaagcaacattcttacatgtggcggtgaatcatcgttaccaagtaaaaaaaactctgtggtaataacatgatcgtattgtcaagtttccaggagaaattctcaaatataaacccagaaatcaaacattttattccttgtgcagctaggatccaatagagacatgtctgtagtaatcatgttcatgtaaacaaatgaggtgagcagaccgcagcgagtgagctcacatgcgccaaccatttttctgcacatgaaaatacaagaatgtttttttcttttttctttgggtgtacacatcatcctcatcaatgagtagagagaagagtagagggtagtagagagccaaaaaaaatcgatcatggagaggccatgtggagctcgccaagtgtgagcatttaccttcttggaaagaatcccaagctagaaatccacagaattatctgctctcaaacattggctcatctgctcaacaatcctatcctcctcctcctcctcactggcagtgattcccccaaccccatttctctctgaattgggcttgtttctttgctgaattattattttgctcattccactctggttgcttgttcagagactccatgtacaattagttgaccattcttctagttagcttctcttgtgttcttggagttggagctggtctgtccatgtgagccatgttgcagattgggctagctttgggagcaagagagtggtagatcttcttcttgccagatttattgtagatacaatacaatcccatttcttgttcagatttcttggtgaaaattcctag

SEQ ID NO: 1291 - DNA, 16792 bp, Oryza sativa
  unsure (1)..(16792): unsure at all n locations
cgcgacgcccatcggcaacccgcagaacctggtcatcgccgtccagagcggcatctccttcggccagttcgtgttcggcatcctcccggccaccctcgtcggcgccgtcgtcaacgccgccatcctgctctgcctctactggcgccacctctccgacgagaagtgcgtcgaggtcgtcgccccggtccccaccgacgtcgtcgaagaggaggacgtcacctcccaccgcttctcgccggcgaccatgtcacacccccgttccttcttccaccaccaccaccaccagcagcctggcagctcgctgtcgtcgcctgactgcgaggtgttcgagccagtgaagcccgtccctgtcaccagcaatggcgactccaacaacaagccggacgccgccgacgccgncgtngtcgttnggatccaccagaggcgccgcggcgttcgcggcggcgtgaggatgaaagaggaacatgcgttccggtgggtgaaggaaaagagggaggccatggagcaatggaagagcacggtgtggaagacgggtgtgtacgtcatcacattgagcatgctggtggcgctgctgttgggtctcaacatgtcatggagcgccatcaccgccgcactcgccctcatggtcctcgacttcaaggatgcccgcccctgcctcgagaaggtaattctgaattcctgatgctgaattgatgtcaaaaacgaaatttcactgaattctgatgctgaattgatgtgaaaaacgaaatttctctgaattctgatgctgaattgatgtgaaaaacgaaatttcggtacattttcagttgtttatggactgctactagtatgttcattcttgctcttattttggaaaccaatgtgttgtcgctctcactcgctctgaattctggagctgaattgacgcaggttgtatgaaaaaagaaattttggcaccttttttttccttgggtgaatttgtttacaggcaatccaatcacttcgattggtattctctgcgaaacagaagtcattactttggtatttgataatccaatcatactgaactacactaaatttgttttcagtatacaatccaatcatgtagcactatgttcttattacttctgtttttttcacatagcagtagattgccattcattttgaaacaagagtctttacttgataatccaaacatatcgaactacactgattactttgtcaagttccttgtcaccttgatgatagtactttggtcttgattttcgataacatttggttctgtcacatccctgtgttgttgctaaattgaagtaattgtgtgcaccaatggctctgctgttgtatttagtgttggttttggatacctaactgatgttaacttgagttgttaactgtagttttgctgaatgaaatttcaggtttcctatccacttctactcttcttctgtgggatgttcatcactgtggatggattcaacaagacgggcattcctagcgcattctgggaattcatggagccctatgcacggatcgatacaccgaccgggatagtaatcctcgccctggttattcttctcctctcaaatgtggcgtcaaatgttccaactggttagttctgccctctgttcatggtcaataatttcacatggcacatgtagaaattttcatccttgttgttactaatccatccagattttaaacaataactaagtcaaggaagcagcgtagacttaacgatacatgtgcttcgcactttccatgctatgcttgtcaagagtagaaaggaaagctgcttctttttttaatggaagctcacaatgccatatgtgccatggttgtctagcaatgaagcaacatatgagaggaaaagtttatctgtcatcctgcactttgcgcaattctcgcttccaaaaaaaaccagaaaatctccactaggttcactcacctactcatgatagttaatagaacaagatatcaaagaacaataggttcattttggagtctgaatttggggctggttctaaacaaagtgtgaatgtcatagctgataaccatgaagttcttatcagttaaagattgctctgtcctagtttcttccagtgaccagaaaaaaatcgtacaaaaatcagttgggcattctttcttttgatttcctgattcatgtatatacctgacaaatctcattgcagttctcctgcttggtgctcgggtggcagcgtcagcagcggccatctcccctgcagcagagaccaatgcctggctcatcctggcctgggtcagcacggtggccggcaacctctccctccttggctccgccgcgaacttgatcgtttgcgagcaagctcgcaagtcggagcagtacggatacaccctttctttcttcagccacctccagttcggcttcccggcgacgctcatcgtcaccgggattggcctactgctcatcagaagcaactgaaaaatggtacagaacatatatatgaagaagacatggatatcaggacatgtacaaaaagaatgtgaattttcaggtcaggtcgattgtatttctgcaaagattcaattgtgggataaaagaaaaatgtctatctttgcctcggaattaagcacggatatcatggtgcttggaggctttttgagctgtacatttgttagttcatattggggggagaagatgtatatgttgcagtagcaaggatcataaaagggaaatgtatatttttgttcagcattctacttgtaatccatatatattttttgaagtcgaataatttgtataggcaggagaagagaaaatcaatgaaatgcatgcccctatcgatgcagctaatgtgtcttattgcgatttactccctccatccaaaattctcatacacatttcatctttttttttttccaaataagatgctcgtatttgcatttcattcaaggatctgaaagattgatacgttcctctcctctgcgatccgacccggaccgttggaccgttagtgttccatcgaacagccagtaaagccaaaaatgcttatagtttgggatggagggagtattttctatcaatcgcagcggtctaatttcctattggggtaaacaataatatggaacaaatgcaaatattagagaaaaacctaatactcccaacgtcacagaatataacaactctcatcctaggacaatgtatctggacatgacattctatcctaagacaatgtatttggacatgagatatgtctagatacattgttctaggatgggtctcgtcctatcttaggttgctacattttgaggcagaggtagtatcaaataaatagaatgtctgagatttcgaacccatgaacccaaactgactagtacaccactgtcgagggaagatcctcaatagcggggagtcgtgagaccccccatttgtgagttcggccgggggcggaggctcgtctctcggaaatcactcgctcgtccctaagattaccggcaagcttgcacgcaatcggattatacaggttcgggccgctatggagcgtaacaccctactcctgtgtttgcgattatggatgagttttacaaaggtttcttcactctaaaaagcgcgctcactttctctcttctggagttcaggttttctgggcatcgtccccttatctcagtgggcagggtcctccttttatagctcaaggggataccacatgcaccgcctctacctaccctctatcggagggggatcccactccactttgggcttcaaaccgtgccttctcccggaagctaagcaataaccggttctcgagtggaacccggcgccgccccccgcctgacacgggggacagccctgtcatttcctcataaatgaacgatgacttgcgatagcccttcctcgagtgacgctcggatgtgacgggtcatacccacccccacttcgccgggtacaagggcgacgtgaggacatggttgccctatccatcggatatgacggtcacagaccggtcatatccgttggacagaggttagctaggcgcgccgcacgtctgcccttaccgcattaaatgcggtgagggacagttggggccgtccacatttatggctggtcagcctgtgctccctttttgctctctccctccgacgcgtggcagccgggtgagggcctcggggcgaagccctgggagagccccagggggtgacgtcatgcccccagccccccccggccccttccacgactcgtgtgacgcgtgagtggggccagcctgcagagtcacgtggcccgagggaaagtaattcccctctacttcatataccccctgtccacgggtgatacccccagactggatatagagggtattggggtacgttggaaccaggatctacctagtacgacatcaagcaaacaaaagataagaattatactgggtcaggccccttgataggtaatagccctaatccagttgatgtgagattatatgatagaaaacacaggttacaaagagaacaagggaacttgtcggatccggcgagattgtagtccagttgattcgactagctctcgatgacttggctccttataagctccggcttcgtaggctgtggaggttgtgttagctctgagattcgatgcctaaaccctccccggggggccccttttatatcgcagatgtggaggtctcctcatagaactcggaggtatcagaccttatacgatacgccaacgacccagtcctgcccgagtaggattcttcccatctgtagattccgtgaaaggtttccttagaatatacaggaaatatccgcatgcgcgtgggtatgccatatcgatatgtaacgtatatcgaagggtaaagggtatgcctaacccgtaaccctgacacccccaggcccatatctccgacaaccacctcgtaaagttaggcggaagactcctagacgtttcttgtaatacgggacaaacgatggggttttaagaaaagtgttgcttgctacattgtagttgaagaagagaacgggcgagggatttcggttgcttttaggaggaggaggataaccctttggatcgagacgaaggtgtcagtggccggccaacatcctcatcgacggcttcgcccgccacctcctgaggctccccagtggcgaggacaagctcgtccttaccctagctccccgctttgttgccgggcacaattacaattgctcgcctaggctccgccacgcctcgctgcggtcgacctcaccgctcttttccccagccatagccacaagcatctcaaacccgtgtcgtgaggttgaaactatactgagattgaaaggctgacttgttgggcccacgcttccatccacgttagcaagccatggtggcatgtcacgttgacataagtggcaaatagttaataaatcatcttttctcatgtgtaataaaaaagtaaaaataaatctaaaaaaaggggtatttaaatagttcgccaaacctaatcagtgacaaataattaaatacttaaattcctcctttagttggaccaatttatcggtaaataaataagtaataaaaaaagaaatcttatcttagcttccaaaatcattgcgcctcgactcgagtttctctcccccgccgccttccgctcgtcgcgcatctggcgagcagagcaggggagggggcgccgccgccgccgccgtccttgtgcatcctcatcccggtgagcatccgcatcctctctctctcattctcattcatctctctctccctcccagtctcacccacacttttgtctcgaatttgcttgctcgcgttaaccctagcttctcttctagatctggaagaagcttttttctcttaatttcatcagagctttaatctccttttaatataagtaacagtttgttttttgcccccaaaggttttgggggtggttctgtcccaggttggatccgcgccccctggctgtcaccgtaatctttcagggttttcgcgaggatgtcgtggtgcacgattgagtctgatcccggtgagttttagtttatatctctttgtctatatcattagttgcatgttgttcatgggaggtttactggatgctagccaatgtattgtgtttattcattagtaggaaggatggttgttgcctttggttttccatcgattgagcactgtggggaatatatattacctagttttttttttttactttgttactagtatctgtaagccgagggttactttctagtagtaattttgatgtgtaaagtctttactccattagttcatctgactaatatccacttggggtccttcggtatgtgtataatcatggatgaagtaccaaaatactgtgatctcaccttacacatttcattgcgaatgattgagtgaaaataaagctttgatcatgctatcctgagtacatcacagattatcgcagtgcttatttttacgtttcaagtgttcttaccattgcctttccaaaatatacctgttgtttcacctgagtatatgacctgtaggtgttttcaccgaattgatccaggagatgcaagtaaaaggtgttcaggttagcttccagggcctgtttttttcctaccatgaaaaattgttagaaacgaaatctatatcaagtgttcttgatatgtccttaggcttttaattattacttgtaaaacagtgtaaattggatggttggctctattggttgattctactgtttctagaatacatgtttaactgatcttctgaagatatatgctttgcttgtgttgtgaagctaaccttaacctgattgaactcactttaagtaactaccacactatatatctctatgatcagcagagtgtatgctaaacaacgcttatgggaaaacatattgctgcatataccatggagctgtgtgcttgaatgtaataaacaatacccttgtgaaggatatggagtaggacaatacctgtttggtagtaataatttctgaagggaatatggtggccaactagtaagggttaacgaatatacatcacagatcagtgcgatatgtctattaatattgttagctcagctacaaaaggaaaagacctttattttggcgttgtatatacttgcaaatctaatatacttccacttttggtgccctgtccttttatagttagtggtaggaaattctagaaaattgcaacagatggccatggacctggcattgtcagaaaaaaaggccgtcatttagcttcagtttatgactttattaaataactcttagctgccttttacattgctattgtatctttaaacaggtggaagaactttactctcttgatgtggactctattagtgaactgcggtgagtctcttcaattttttgttgtcatgcgtctctgttctctggatggccttaacacattgttgtccacttctcataggccagtttatgggctaatttttctcttcaagtggatggctggggaaaaggatgaacggcctgtcgtcaaagatccaaacccaaaccttttctttgctagccaggttagttccattttgctccgttagctacctctgttcagaattggatttaacatttgatctaactaaatcaatcactgccaggtcatccctaatgcatgtgctactcaagctattctgtcaatcctcatgaatcgcccagaaattgacataggtccagaactatccaacttgaaggaattcacaggagcttttgcacctgacatgaagggccttgctattaacaacagtgattctattcgcacagcccataacagttttgccaggcctgagccatttgtctcagatgagcaaagagctgcgggtaaggatgatgaagtgtaccatttcataagctatttaccttttgaaggagtcctctatgagcttgatggattgaaggaaggacccataagccttgggcagtgttctggtgggcctgatgatcttgattggctaaggatggtgcagccagttatacaaaaaagaattgaacgctattcccagagcgagattaggtttaaccttatggccatcattaagaataggaaggatgtatatactgctgagctgaaggagctggagaagagaagggaccagcttttgcaggagatgaatgagtcctcagcagcagagtccttaaacagcgaacttgcagaggtgacatcagccattgagactgtcagcgagaagattatcatggaagaagagaagttcaagaagtggaggacggagaacatcaggaggaagcacaactacattccctttctattcaactttctcaagatgctggcggaaaagaagcagctaaagccattggttgagaaggccaaacaacagaaggcttccagcacaagcacgagtgcaagatgaagccaagtgccaccaatggctgtaccgaattcgttggttctcattttgaggaaagcatacgttcatgggttactggggttagttgttgcattttccctttttgagaatgcgttatgctatcagatacggcaccttgttggcagcttagagatatcactaagttaatgaaccagagtacattctctttaatctttttctccgtgttgtattattatctgttatgactttctgcccctgtgtgatggatagaaactgtagaagggggggtcaattgggtcttaagggtggtggcattgtttatttcgcgtcgtggcaatcgaatagaaaaatacatgttggaggatggaagttttgtgtctagatgctgtcttggaaatgcccacttgctaatcttacttgaattagatagatgctgtgagtgtatccatgaccatgagagagctggagcctagtgctggtagagttgactttcctgagtgaaatcgcttgcttgggttggcttgtagatataagtataagaaaacggataagaaaattcaggcaatgaatctgatgcgcatgtgattgattctggtgggatttctataggacatctgattttctgttgaacagttaacgcaaacgacaggtttgaatgatacagtattcgaacttgttttttttttctcttgtcatcaagattcataattgttggagcatgaatgatctggtgtgcaacctcttaagctctatagctaggacgttgctgtcatctctgttgttgcaccagctaaaggacgaattgtgaccaaaacccgaattgtgaccaaaacctttgggactttcagagtgatctttctgtcgcacttgcacacactcttttgtcattcagagtggttattatccacccattttgaaacaggatttcaagaaattaggggacaaaaagaaattatacacattggatttgaagaaatttagagctggtgtcgtactcctattttattttggtctattatcccatacttatgcagatcagctggatggattgcatcgtcagatattcttacaaaacaaacttgctcaaaccaagaccagattagattagattttgttgtgaatacaaagtcaagcaacaacaaaaaaaaaagagattgagaaagagtggcgagttgcgacgtgaccaatggaaactcgaaaaacagaaaagcgaaggataataaaaactcataaaaaggggaggagggagaaagaagcgagaggcgcatttgttgtcgttgttgttggttccatgccgtaggcccatcgcgatctactagtgtttttttgcctatntcccccntnnangcntnnannnnnannnnnacccccaccactcccccccccctccgcttccgccctccgccgccgccgccatggaagccccgggctcccctaacgcctcctcgccggagtccgcccccaagcgcgccccccgctcctcgcccccgcccccgcagcagcaggcctcctccgaaggtaacccgctcgcgcctcccatccccccatctcactctcgatatcgatctctctcaacgtggtgcgcgcgtacgtgcgccctcgcgcgcggtttggtctggatccgcgagatccaggcctccgtgttccgctctgagatcgagatctgcaaccacgggcggcaaatatggtggtcacatggataacactaggccgctgctgatttgggcgtgttctgcgtttgtgtgcgcttgtgcaatggagaggggagatgcaacgatcagttgtttcagtggtagttgatttcatgttcatcttgtccgctggggtgatttggcaccggttgatgttgacgatgagttcatccgatgcgtttctgtgtatgcatcacaagtttattaacatgtccaagcgcggttagtaacagctgcatgtgtgatcatatacaatgagcttacacataagagttgcaatttgatgagtaccatcatttaattgtagagttgagttgaccacatgagacgtataccgatatgcatcgctatctgtactcttactagcgatgacttgctggatgatgccgtggttgggtctgtcactctgttgatgttcagggttttctacttttcgcagtggaaccgacacgtagatataataagtattctaggaattcaaccctacatcttgattgtctatcccacagtagtctgaacacacccagccatttacttaacattgtgataactgatattggatgttgtttcactttgttggttgttggcctgtaaatatattttttcggggaaattgcaattggggaacaagaggatgcttacaggaaatgcgaagtcatgcacactctatttagcaagcacatctcacctttctggcatatgccaatcattaatcttgtccattatggtttcctcgggtctttggttgacacacttattgcctttaaagtgttatcattatatgttggttgttctaatggttcattagttacatcaaaatataagaaatataaagttctcctgatccaccttgagtggaaaggtatttaactcagtcctgtcaattgctgctttcactctgttcgtagcatattcctaccattatgcttgttgctaattcatgttttttaacttgttatatgttcaaggagaatatgatagaccatgccaaaatataattcggtcataatgtgaatgaccctcttgttattgttcccaacaagcatacatgacacaactgtatataccaaacttctaaactacactgactggaaaccaaaattcagtcagtagtggttctacagaacatgtatagttaagtgccccagttggaccattagctgtttttactatgcatcatggaccacttttgttgcttgagttaaaaaaaacaattttgtgcctaaacaaataatggcatgcacagtttttggccctctcctttattgctagtaattctgaatttccaagtgatcattctccacagatgacaaggagaagccaacccatctgaggtttctggtatcaaacacggcagcaggatgcattattggcaagggtggatcaaccattaatgaatttcagtcccagtctggggctcgtattcagctatcgcgtagccatgagttcttccctggtacaaatgacagaattatcatggtttctggtctgtttgatgaagtaataaaggccatggagctgattctcgagaagcttttagctgaggtaaactattttattccgcaaatagttgtatcatagggccatgttactttatttgatgattggtattctatggttactttcccagggggaagaaagcaatgaagctgaagctagacctaaagttagacttgtagttcctaacagttcttgtggtggaatcattggtaaaggagggtcaacaatcaagtatgtaccattgataaatttgtttctggtttctgaaatcttatttttattcttattcccattgcgcttcttcattttcttagttggttataatgtatgtataccatgaagcgtgtctgaaccgaatgaggaaatgcatggttattttcctaatgcactcatctttgacttaactgcacccaagttattgcatgctctcttgtcaattgtacgcaagcagtatttgttgtttcatttgtattgttttgtgttggtttatgtttctttgaatgtgagttgacatgcttgttttctcatcaggtcattcattgaagactcacatgctggaatcaagatttcaccacaggataacaattttgttggtttgcatgatagactcgttactgtcacaggacccttggaccatcagatgcgtgcaatatatttgatattaagcaagttatcggaggacgttcactacccacctaatctgagttccccatttccatatgcaggtaaacaaatttcaatatttgatttggtgtcaaacggctacttttcttattatggggtgccttaattctcggactgcatttcttttctggaattcatatactgcattgtataggtcacaaatgaacatgcttggtcactcgtaccatttggcagccatgagctttctgcatgaatttttattcagctactgcacgattgttctctttccgtttcagtgatcatgttgaatgcgttcacatgctatgtccattcagttactgcatgatcattttatctgaattcctcttcttttgttttcaggccttggtttccctagttaccctggtgttcctgttgggtatatgatcccacaggtgccgtataataatgctgtgaactatggacctaatgggtatggaggaaggtaccaaaacaacaaggttagtgattgctgctgctttactcttgtcttgtatatcactaaagcaaaccttttgaattcaatatcagcatttttatgcacatgttggtatgagctaacatgtgttcaattttgttatgcactagattaaggttatgttcaaggtgatttgcattagatgttctataatagaaatactattttctggttgtggttttgtacttttgtcatacatcactataggcatctagaatttctgcttcaaaccaaccttaacaatagtaagactcattggatgagatgtctgaattactaattgtggtttatttgagtgacatattccatccatttgttcatccatagtatgctttagtacatgttagtgcaaagcataagacagcttttaacgaattgaagtattattacctatgtcatgcatgatgtttttcaccgtaagtaacatcagtgctgtaaattctaattcagaactgtaagtaacgtcattgtactgctttctactgaattccacaaacattaccattcactatttttcctttttttccctttgagtgaaatttgatatatgcgttcagagcttcaaattaatccaacaattgtctgctgttgaaaattttgcagcccagtacacctatgagatcacctgctaacaatgatgcccaagattctctcactattggtattgctgatgaacatattggtgctgtcgtaggacgtgccggaaggaacattacagagatcattcaggtggtttcttgcgctatgaattccacagttattacttttttcggtgcatttttcaattgcttaataccttgtacctatgactgtaccttctctttttttgggtacaaaaggcataatgtttttttttgtagtatcttaggcgaccatattagccatcttcttgagttgtatcaccctatgtcccacatgtcagttgtttttctgcctcagaaatgtcataacctttcttcatgcttcaaagattttgtaattgtcccaactgatggttgtcttccagtgtgatcatgttggcgtgtttttactgaaatagcttgcaatttgtcgagtgcaggctagtggtgccaggatcaagatatctgataggggtgacttcattgctggcacatctgagaggtatttccttggttacttttcaccatcagaacaagctcttaaagcatattgagcaccaccgaccttcatatgatatgcttgtacagcaggcctgaatccccaaattttactgactggtgcaggaaagtgacgataactggaacatcagaagctattcaggcagcagagtctatgataatgcagagggtgacagccagttccgagaggtgataaaatctcatgaagacgaggggcatcatctgatggaaaagaagcctgatgccaagttaggaggaggggttggagattgtcttttctagttttagcactatccgcaaaaaaagcttgagagaaaatttaagataatctattgttccttattgagtctgattgtgttagtaactggagtagtcagtcaatcagctgttctatttatttcttatttttgttgggaataggattatatttcacaacatgtttggctgttgtcataactcaacaacgctggtgtgctaccctagttttgataattgtgatccttaggttacccttgaccccttgtctttgcctgtttgtttgtctcctcaaaagtcgaaatgactcgttttgctgaaagacaaagttgcttcctagtgagaggctgcatcttctgtccaatttgttgcatttccatgatgttgcctccaaaatcttgcaagtccaaagccaggaaaaaaaagcgaggctgcctactcttgtggggcgtggaaagtcacaagcatctacctttgcctgcgtggatgcaaccaatgccaagtaaaaaaaagcaaaggctgggcttttctttttctttttaaatgttacagcgagttttagctcccatttggaattcctatgaatatatcctatttgaaagcatttgaaattctttcaaatttggtgggcgagcaaactagtacgagcagaaaaaaagtcgaaattttctcaagatatatgtcgtgaatgaaataataatactggagtatcatggaggattaaatctgtttgtaaacccccaaaaaaaccggaaccggttttnttttccccctctcccaaaaaaaaggtttgtggancctaagtaattaccaaccattaaaattaacatttctgtggcatccactgtattgtactatcttcagctcactacgtttggagaatttccggagtagaatcaaatcttagaaattgcataatactccctccgtttcaaaatgtttgacaccgttgattttttaaacacatgtttactagtttctcttattaaaaaaaattatgaaatatgtaaaactatatgtgtacataaaagtatatttaataatgaatcaaatgatatgaaaagaataaataatcacttaaattttttaataagacaaatggtcaaatacgtactaaaaaaatcaacggtgccaaacattttgaaacggagggagtacatctcaaaaatctctgaataaaatttatccctagtagtatatccttccatatataaaccgaaattattaaataaaaaggtatattcctaaaaagttttccgacagaccagagggcaggagtcttctacaagacggctacccaggagtatgatatttcctctattattattttctttctcatcacgcggctgcgtccgtatcgcgacttttatcctctcctccccaactaactcggcgttcgccatctcgtgtcgactttctcctcaaaaccctaattccatccaccgctcgatccaatctacccttctctcgattctcaattctcaattctccctgcaaaattcccaatcctccgtgcagaattagaattatgcgggattgatcccctcccacgggatctccaatatcatatccatccagaaattgaaattcccctcgccgccgatgagccaatcgccgccggactcctcctccgcggcggcggtgcccctggcgccggggtttcgcttccaccccaccgacgaggagctcgtctcttactacctccgccgccgcatcctcggccgccgcctccggatcgacgccatcgccgaggtcgacctctaccgcctcgagccgtgggacctcccctccctctcccgcatccggagccgcgacgcgcagtggtacttcttcgcccgcctcgaccgcaaggtcaccggcgccggggccggcggccgcggcggccccgggaacaggaccaaccgcgccacgccgcgcggctactggaagaccaccgggaaggaccgcgatgtccaccaccgcggcaagctcgtcgggatgaagaagacgctcgtcttccactccggtagggcgcccaagggccagaggaccaactgggtcatgcacgagtaccgcctcctcgacgccgacggcacccaggtacctgtgaaatcatttgatccatctcaaatttcgcaggatctaccgtaccacgagatcacgagattagcggtagcaccaaaaaaattctgttcttttagcttgtctcctgctaggcttgtgtgagcggtaggtgggaactggtcctattctactttcaacactcgttacttgctgctgcttagatatgttatctagtgcgaccctgtcccgggcctagaatggttacaacattctcatgtttgttcacttgatacctatatatggtaggtaaaaacctttccttacaacatcaatgacttgctttgagaaaaaccaatatgagcatgagcttatcttttgtcaataaaagaagaaaaaagtgcgagatgcactggtagaagtgatagagcacgtctggaaatgtatgaagcaagggggcttttaactgggctatttaagcattggaaatcttatcctcactctgaattgaggagtctgaattgcggaggaccaatggtttttaacctgtatagaatattgatgtagcatccttttctgatagctgatgttagtttcctgttgagtgcgcaggatctgcatgtggtgtgtagaatcttccagaaaaatggatctgggccacaaaatggtgcacagtacggtgcgccatacttggaggaagattgggaagagg

SEQ ID NO: 1292 - DNA, 8278 bp, Oryza sativa
ggacggagggagtagtgcccattttcttttgtattttccaagatgttagttattaaaaactgaaattgtactgtcaatactcaacacctataatgaaaactagaggatgccaggaatccatggaattacctttaactgaaaacattctatgtgactatatcaatgaatacaggataatgatagctgaaacaactaagtagactatgcatttgccatcatggttgaagagttcttttctttaattaaggttttgcatgtttctattccctgttactgttctgacaaaattttaaaatagaataattcttgctggattttatctcttcatatttttttcctcgataatatatttattgctcctcctatcaagtgctctgtgatgtgtaacacaccttcatgtacttcaattaccactacagacccaagaataccagccagagataactcctgtgaaagctcaaggttcaaatgaggagaccaatggcggtggttacagttgtgatgttttttctctggatgagattttgcaggaacctgaaaatgtctgcaaaaatgaagagcagaatgccattgatgacaagttcactatcgcagagttatctggatacccaaggcaagatgatggctatgtaggcgagaatggtcctgtgaattggattgacccttcaaatggtgataatacaaactggcctttgagagcatatagtactcagaaccatgtcaatggaacacttagcgctgatggtttctttgacacggtgaatggtaccaactcatattcaggtccttcagataaccagaacctgtatttgcaagatgatggcttgacttcttctcatcaagtgggcgataacatgccattttatgacgcatcatctaatcacaaatgggtagatggaaaggatgattatttgaatttgaatgacctcctctacccgccagcagaaaatcaacccctgtttgatgctggggatgacctgatggcttacttcgatgccacggaggatgatttcaaatttgatattatgggcacagaagattctaattctcaacttccagacatgtcgaactttgtccaaaaggtatgcttcggtgcacgcatgtcacataactatgctacagttctcttacatctagttagaaggacacttcctgatcactatccttctttgacttctttctggttatcaactgttgtattattttctctgcaggatgataacaacaataagtttacattagatgggatctctaataccgctttgtatggtgcttcttcatctggatcccatggcaatatgtatccagacactgcagtaccaggtatggctttatcactatatgcttattagtaactattttcatctactaaagtttgcccattgctttgggggtacatacaagcatcttttatgaaatgtgaccatacttgcatctaagtctctcttctttaaaaatctcatggaactactttggtccagatatgccgatggatgacactgttgacaaaagtttcggaaagcgccttgccagcatgctgggttcaattccagctccacccgcaatggcttcagagttcccgccgagcacaggaaaatctgttgtcccacttagtgctgtcaacccgagtagctctatccgtgtcactgcaggcattatccaactcggtggtatcacttttactggtagcaccgagcacctgcagaagaatggagatttcaatttgctcctctctttcactgtcgagggcgacgtctcaaccaaatccattggttttgaaccggatacgcagatgagcaccacgccaatggtgttgcgcagcggcatgtatcttttcttcgtatcggcgatgattctcatgttgagctacaaagttgggctgtgtatctacagcaggtaagttatagtagtttttgttgccccaggctgtttattaaattgaaggagtcatacagagtccactcgacgtagagggaactgcctgcgatttggacagtttggttctttacattgttatagttggtataccgttctgacagttgaaagatacatagcaataaactctggaattggagaaactagagttacacgaatttggtgctgaaacttttgttggtggcatgtactgtataatttactctatttatttatttcacccaattctgggaggctgtaagcgttccccgatcgatgtaagctgatctgaaacctgaatacgcgctcttcatttttcatacccaaagggccgagaggcacagtttgcagttactgttgatcaattttcggatggaaggaattttgcgttggtgtgattatgtgcttgtttgtggtgttgtcagaaataaaccatgaccttgtgcgtgcttcatagttcaacgtgttgcgctttggagattggcaattgcatatgggaacagacgcactgcatgacgtacatatatgtaagaaacgcatagcatgatgtacacattggctatattacgtgccaatgttcgtttatcttcatcgaaaaaaaaatattatcacaaaaacgtgaaaaatctttcatacaacattaagaccaaggtggcaattcactgtaatcctatacaactaacagtatactctggaatggaaaatatatttctggcacatatgagtgcactgcgcttttgcttctgatttgttgtgttgtgcccaaacaagagaggctcacaagcacatggcaccgacggtagtacattgccctagacatgtgcggttgtgccttccttccatcaagagaaagacgtcaaattctctcccatctccagttctccatgaccgcctttcgcacatttcagtttcagcaccttcagaactaaagaataaattcgcgtgctttccctgccatcccgcagtgccatatcgtttcaaggaggatgctgctcggcaaaaaattagtacctgctgctgaggcactatgaatgaagttcatgtcataacacaaggcaggagaatcaatccgcggacgaaataatcgcaatggctgctggctggggcactatgaattttctggaaagacggtctggatgaacttgaggaaacgctccgagtagaactgggggtccacggcggagatggagatggagtcgtactgcatggacttgacggcatgctctatcttctttgacatgttgtactcctgcaatatgtctatgatacccaggtaaaggaccacgtcgtacacctcccgaaacgatttgctttcctcttctttagggttctgctctgcccttgcaggcatgttaacccctagctggatctgcagcctgtcaagtgtcaacacaaaaaaagagtaagacacctgattggtaaccctcctactttgggatgaagtgcaacatgaggaaacttttccttgtaatggaatgcttggggtgcaagcaactcagagccatggctgtaaagagggttttcccttttctacaggggaaggaaaaggaaagaagatattcacctggctgtaccagaaagtagtagatctacttccgcaaatccagcggctgttgatcgtaaacggctacctcttatgtgagggccaacaaccacactgttttcatcaccacctctttgaaccaacactagaccttccgggtagttgaaagcatcgtcctctgagcgtctgcaattgtcgattataaacatcagctcctcaactgtattaacaaaatatattatgtaccagctggaaaaagtgtccacttaccttcttctgaaagaacagttaatctatctgctgccatgcttcgatgataagatgcacgcgtccgaaggtgctggggagctctatagtgcacaccaagcaataagctgtaatccattatccgttgggtccttagaaattcactgtcagtttcaatctgcctgaagagaataataataattgtcaaccactgttgaaaggttgcgtgattgctctttgtgaaggaaaacatatgcaagaaaatggaaccacagcagcaacactgtacatgtgcgaaaattggtactttttttggtggacaccagatcagtgccaaaaccagataattttatggcaacacattgcagaacttggcatgtacttgacattgttttaaatggaaatgggtcattacatccatgaatcctctatcatacatgggctatctatttagtgacatccttcaactagttaaattttgtatttagaggatatacaagttgaacaacaatttagaacaaaaagatatgttgatttggcagcaagtataatgcagttacacaacaaaccatatcttagaatgataattgcatgagaaaatatgctcacttaagtaaagcctcacgccaggaaggttcaagataaaatgaatagttaagatccaaatccttcagagttgtgttctcatcaatttcgattttgtcagtagaacggcctaaggatgaacctttcaaatcaaatctccgatgaatcctcaattccgtgcaaaacatgttacccattacaacaaagcgaaactgcaatttgcaagtgttaaggattgtcactgcgcaagaaatgggattggagctaaagaagtgtagataaatccgttaccttttgaccactagaaggcttcaccctgtggaggccaaaaaacttagttatgagggtgttctcataagtacggacatgatggtaatatttttggaagcattcgtaaaagaacctgcaaggatcatatagagtcatgaaatgtttttaacttccgcttgctaagtaggtggtgttacttataatgtataatttatcgaagaatctaccattaaagaattttctagcacgcttatatgatctctgaaaatttaagcataaaacagaacctggacttcagatttccgaagagtcttgatcatgaatcgatcatcttgtgataggaaaaagacacttccactctttcctggagaagataactccctaagtgcagaatttccacatatagagatcatataatctgcagcatcaatcttgaacatctccctcaaatttctacaaaaaataaaataagaacaatggccattttaggtgtgtgacagaaagaagagaactataagctagaaataagaataaaaagaaaagaaaaaaggtacatagctacgttcagattaagtgatgataactacgttaggtgagtatgccaattctaaagatcatgtaaatctgcagaataagtgtatgggcatatcttagagatgtacattgggatgaaagctaaataagtgcaatgaacctgaaaaccatgggacaatagtccttccatttgaagtcttctgcaggatgtgaaggagtaagtcgtgatccttctttggggaaggtcatccagaaacttgctcgtggaccaaaatctgaagcacggacttcacgtttctgaatgggcgtaatctttcctaccgtgtacctaaacacaataatgcattgatcattataggatataattattactgatgtatcaccatcatattgtcctactaactaggaaaactctcattttaacttaatagatgatgcaatattttgcacgaaagttcttaagagcaataaaaagtgctgctagaaatactccctgcttaggccaggtgctgtatcttagaatccaaaaaaactactaccagctagcaaataaaaaaccttgcattctaacttttcaaaaggtaaatgttaccgtggacactattacgcagcacaagcattagacaactagagggacctgaaatagttctgttatagttttaggatatgttgtcaagagaactagagaagactatctataaatgaaaacgatcaacagaagagagtaggtcaggacagtattagtgggaccaaagaaattaacgaacagatgtcattcaaatcttgcaactacgatgccgaactcagagggattacctgattccaagctgtagactgagcataagatcatagcttctgtgacccttaattattgtctctcctggcttttttgtctccctaacaattttcttctggcgccgttttgccttcttggacgaatccgaaaaactcctgtcaagtactacctcgctgattagaacaccttgcatatattcccgttccagcataggcagatcagaatcattaatgctttcagatctttctaggccagagcttccagttgcgtcatggccaatgaatttttcaatggccacctcaaggctccaccgtctttccaaggatacatttttcgaatgaggttgctcacttgagttccttctagatgaaggacctgaagattcccgagttaagccaaccttcatgttccccatgtcaaccgaagaagagtgaaggatgcgtgagccgtgattctgccttctaatgtcaggcagcacacctcggtttcttagattattgatgtagagctcatcattaacaggaactctgcaaccttttggatagaatgtgcctttcccatccttcagtcccttggtccaagtaccaacataatacccacactcattccatgtatagattccatacccgtgcatcatgccatctaaccagtttccttcatatgaatccccatttttccaagtaagagttcccttcccagacatcttgccattcttcatattgccaacgtaagtgtttccatttgcccacgtatacttgccatggccttctatttctccctgaatccaagaaccgtcaaacatgtctccattagggtacgtctggcatccaagtccatgcttacgattcaatttccaccttcccttgtagacgatgttgtcagacccggtatatgtgccttcaccataaatgtagccaccagagtactcaccctcgtaggtggctccagatggccacattgtctttccttgcccatgcctcatccctctcctccactcaccatcgtaagtgcaaccatctgaccagacatacctccctgaaccctctggtgtgttccccaataatgtgccgaaataaatatccctgttggagagcctgatctctccaactctgaagccagggtttgttccagaagcatgagaatcttggccatttgctaaactggacagtacctccttttcgatattgcaactagcgtctcggaacagctctactctttgagaacgggagatcccttctaactcatttggaaggactgcaggggctgtcatgcataaacccactaggaggactaacccacagtcgcgaggaagatactcctaagcacggcctgtaaagaaaagttcacgagacacatcagtaatgtaacctgtggaaacgtatccaagtgaggataaactgcgttacaacttatcctattgcaatattcatagaaagaaacccttcacaaagaaattgattgtgcagctttaactagaaaatgagagacagtcaagatcaggtgtacaaaaaaattagatgaaatttatattccttgaaactacaaacctaactaatcggagatgaaaatcgttgtagtacacgtcctgtaatcgtatcatgactattattgtccagatcattctgttgatcgtcacatcgttttgtgaaggcaaaacagtaaggacaatggtaatcaacagcagcactaactagtagtagcagatggtaagaccccacccacggtcgtttcctcaattgtttgctgtaggaatgtaatcaatcgggcatgaaaactttagcaacaaatttgggggccccaaatgacgtgagcggcagttgggctcatacgcacagcaaatggaggagtcatccaatatccatcacagtggcattcggagcttgcagtgagttgataaccaggaaaaaagtagtaggcagcaggacaggaggtgtgtgatccaatcgtgcgtagtcagtaaaaactgaaggttagtcccctcgagacaaatccttgggagtggagagatattgtatctagtaaatcaaaacagaagagggtattgttcgaaattcagaagggaattacggctcggaatgaatctaatcctaacccagcctaaatctaaacatatacacgcagcaaacgatcgtccacacaaaaaatatatagtagaggaacaaaaacgaggaaaaaaaaacgcgtcaacgtgcaactgatttaggagtaggggaaaaacgatggaaacgtgtagagtagagtgagggggatccataagaagcgggggttggattcactcgctttgggtgatgggtatcatcatccgatcaaatcaaccaatggatgaatcatgagaaggcaaattcgatagagcacaacacagacagaagtcagtgagggattcaattcaa

SEQ ID NO: 1293 - DNA, 2132 bp, Oryza sativa
ccctctccgctgctgcttcgtctcgtgtggtggtgtatgcggcgctagatcttttactactactagtactagtagtggcctgcctgccccctgcccgcgacgccgctcgatcacttgacttattaacaacaacaaaaccaatcaacttatactaacaaacttgagtagtattagtactagtacggagtatattaccttttcttttttatctttcctttttgcgattcctatagtattcttcttttccgttgatgacgatggtcgatacgaactaatttctctctctctctctctgccttttttttttcaaaatgcccttcttttctcttaataacaagtttaatattatacctaactagactttaaatcatctatattcaatttaatagccggttcatacaatataaacatatactacataatttataactggttcaacctgtcatacatacatgtatcttagagtccgtattgcaactagctacaaatctatggcacgttgtttttctctctcctattttatcttctcgaaatatatttatatctagcttataatctgctattgtacttgctacggaaaacaaagtgcgcgattatagtgagattaattaagtattagctaaaaacttaaaaaatggattaatataattttttaaagtaactttcatatataaaacttttataaaaaaatataccgtttagcggtttgaaaaacgtgccgcgaaaaatgaaggaagtgagttgagaaagaggggaaaagaacatagcttgatggttttcactgtctctagtcccgatctaccgtctccgtctaaaatataagaatcgagtactatatgtaatatatattttaaatatgttcagatagtaaatatattttactagaaaatatccgtagtatacttgtggcggttaatcaacgtatctgtctgcacaagttaattacatccttccttttaattctctccattttaattgacaggcactgccatcgcttcagttgaggtcaacgtactcggcacaaatcacaggtcaaacctttaattaattaccctctcttacgtgcaccaatcatgtcctccgcatcattatcgatctattagcacgcaacacaccacagtactcgtagtagtagtgcttcatcattaggttaatttatttactcctgcatcgttagattagatctcgggtgaagtacgttattaagtagtactaattacttatctgcggatcgattagattacagctatctagtgctggtccagtgatccagtctcgattgcgagcaacatgaacgctttaattccacaatccacacttacatccatcttgcatgtaaatatacaaccgcaacttgcacaacagaagcaataaccttaagatctactgtacgtactatacctctgttttcaaatatacttcaaacgtgtgtttacatttacaactttacaactgattattcttttatatggtagagagtgtgcgcgtgttttatacgagcatctgcgtttataatttgttttaaaaaattaacaacatcatatactactttactttttttaagtatatgatgttattgacattttaataaatatttgatcattcatattatttaattttttatacataaataaattttaagtcacactaaaagaatatttgatgatgaattaaatcatgataattaaatgataattatatattttttaataagataaatgctcaaatatatcttgaaaaaatcaacagcgttatatattaaaaaattaaaaaaaacagatagagtatttatttagggggtaacatagaggggatatttacattcgtttgagcaagtgacagtaaagaaacaaaaagaaggaacaaaccaacaaggtcattttcgataggctacgcaggccggccggccggccgaaacaaatgggtcacaattaagcacgaatttaattggggaaacgccatcatgtcattcactggatcgaatctgcaagatttaattaagccgtactccgttccgttccaatccatacaacgatttttttggttgctcggttcggtcggttgttcatgtgtcccaatatctcctctccttttcttcttttttttcccttcttcttttaacgatgcagtag

SEQ ID NO: 1294 - DNA, 4249 bp, Oryza sativa
aggcaggaggatcatcatatcctgctgattaaattaagtttgggacagagaattgctagttagctcggtgtcccttcaaacatcatacattcaaatggaagatgatatatataggagtaatataatatatctatgcatatccagttgcgtcgtacagtgttatgaattgtcctcatatatatcgatcagtcatattcatataactttgtcccttgtttgttttcaatcttctttctcatgtggttgcagtatgaaccaaaattgaaaacgatattattccaaaaaaaaaaatggaaacgatatacataatggcttgtggctgtatacatatatccacgatatagtagctagtactgtggatatgatttagtagaaccgtatagtacacgtgaatcaattaagtacatatatgttgagaaaaaaatgatgatgtggtggtaaagtcaggggtgcatactatgtatgacgtactccaacggaccatcactaacctttaaacaatgatatccatagatattacatatgtatggtttgtgctatcaatagaaatttagtaagctcagatttattattggttgttatttccttagagtatatgttagaatacgtatttgtgaatgtgtgagtgtgccgtgcgtataaatcatctaaccggaaaaaaaaagaaaaaaatcaagtacaggtgttatagcagctgatgacagcaatcaactcatcgtgacattgacatgaatgtgtttatttgctcatctctgattaaccggtcggtcggtcggttatctgccacgtgtttcgcacactgtgcatacgtatgcatgcatattaacatcaatcacagagacaaactacatatcaaattaaacgttcggatgcaaattaagatatttccactaactggctagcttgtgttagctatagctagctagcttatttatcaataaaaacatacagtaccatgtatatattatggtttcattaaacaaaagtaaaccatatttcatatttagggatcaaacttcagtggttgagatatattcgacgaacgtaaacaaatacacaaaaactttcaatcgaatgtatctcgccaaacaagatcaaagaagaatatgtgatgcaagcaaaacatgaacattatgcgcaattcgtatatggacatggcataattaaaaagttacgggtaatggagatgacctgttaaatgtgtatcttttgttgctttgcatcgaccggtcggttcattgatttcaaggtagatcagatgctgatgctctgtgttaataattgtttatgagctataagctagctagtggaagcccatggattgatgaaatacaagctgggaagcaagatgcaaagcagagcacacatttctatttttttttaagtgccaaatttgcaacatgctaaagcagcggttttcgtgatcaagctaatttaaaacgagctagcaaaaatattctgcaatctttggaagttgaaatgtaggatggatggattgattgattctacagaaagtgagaacaactttggccacatatatatgttttcttccactgaaaattcttgcaagctaaggaaagaattaacaatcaaaataacttcatctttttttagcttttgacatgaattaagatcaccaaaaagattccttgttttgttgtagagagtataacataaagaaaatgaatctttgtacagaaagagcgaaagattgatatccacattatattggtcgtatactttgggaaaagaaagaaattaaaggacggtaatgaccgactttttcctcctgaagaaaacagttgagatcatctgactataatatcgttttggatgcatggtatacgtgcatgcaaaacacaaaagtttgtacttacgtagagagctaatttcaaccatggaccattttttttataattaaagaaagtacgctatcagttggaaatgtactttatgagaaagttggatggaagattggaagagagatagacgcgtggttggtggtccgtgccttttgatcgtatgaacgtatgatcatagcatcattttggtcttgatttttgcagcacatgtacacacatgtaacagtattagtacgtgtgtgtagcccacttaattattagtaatcgagactttgtttaatgtgtggatcgagtcgagtgagcacatatattccggcacgcactacagtgtactatagtatagtgtttctggtgtgcattttgtttgatctccttttcaattcgccagctagcttaactggatcacctttgtttttgtctttccttttttttttaacggggtacatggcacgcgtctacgtcttgtatgctgcaaaatgatactctctccgtttcaaaatatttaacactgttaactttttagtacgtatttgaccattcgttttattcaaaaatttaagtaattatttatacttttcatatcatttgattcattgttaaatatactttcatgtacacatatagttttacatattttataattttttttaataagacaaacggtcaaacatatgttaaaaagtcaacggtgtcaaatatttaacggagggagtacaatcatacagctgatagctagatgcaatgcgtgctaagcatataggcatctgatccctgatcagaacctgaaaagtgcacgagacgagagccaaactgtacgcatgaatgcacgatcgtgctgtcaccatgcatggatgccaagctatagctagccaagcatatatcatgtgttagagtgagagtgagactactcttttttctgttcatgagtatatgctgttcatgagcactactcttttcttttcaccccaaaaggtgctttatgtttctcctaatttaaattaactttaaccaaatttttagaaagatatcaatacctataacactaaaattagcataaaaaatctaccattgaacatgttttgtaggtacttcatccattcaaaaatataaatatttccatattcattttgaaaaacgtactgaaatgtttatatttttttaatagctaaagtatttgttctatgtaaaagtgctgatttatttctctgtgaacttgattaacctataacaccatcaaaccttacaatatgaaacagagtaactatatttttctttctcaaggaactaccttgtgtactctctgcagtcaactttactgtgccattgtcactgacatgtggactcgacgacatatcaggtccatatgtcattgacaaaggcatagtacattaaccgcagagcagaggatcctgatccgtgtactactactgttctgttcttccctatccctagaggcagctggctgagaggactcaatcaattaactggtgatcgatttgatttgatctgatttaatgtgcatcgtcgttgcccctgttctgttttcttaatcaagcagcagtaattttccaactcattcgattccaatagattagatatagataggtagcctgttgctgtatgaactatcggcgtcacccaccatggagatcgaattaaggtcatggatgcatgaatgcggccctacgtccgtctaaaacatgacacaaaccaaaagacaaaaaaatattgtgtgggtttggtttatcggacggcgccgctcttactctggagtacttaccttagcttgcgcctgcagattctataattatctattgaccgtttcgtctaacactgatctcatcctcctaatccttgcactcacctacttatacttgatttaattatttaagtctaatcaaaatatctctctgatattgagctctttttttttctccctttgagctgtctatatatgtgatctaatcgaatcagccggactgatcctcaactacacgcttcatcatccaacgctccagtgctccaccatctgcattccaatttccaaaccacttccctaactttttccaccctcacccacaaacaaatctaacccaaatagtttatgtactaacaggatgactaattagctcagctttgcccgcggcacacacttttggcatataaagtccgtgtcaaagtttcagatgaaaagtttctggatggaagtttccaaacgaaggttttttcagatgaaagttttcattaaaaaatgtgttgaaatccctatgtttgggcctaataatacagcgaccagcggcccaacctacgaccaccagactgcctacgtgccattttggcccacccaacccaaatattgtagtagctctatcaaactatatgactat

SEQ ID NO: 1295 - DNA, 3805 bp, Oryza sativa
gtaaagaccaagccccgtgatgtgacactgcaccttggagtttcagcaaaaatctctgcaagtaaatcattgcatgaattcagctgctaacacaattgacgaaatgtatatgacagcttaagaacggagcaaaaggtaaggaacaatggaatgccttgcagatgagcttacctggtgaaatcagaattcatccaaagcccaccatccactaaagattcaatcaagcagcttcagggcttatttcgcatatacggtcagccttacttgagctgtgacttcagggtgaagcttaatctctgcaatgtattccccaatttcacgaatttctggcactgtcacgagacgcttgtcgacatccctacatgaaatagtttccggtaagcaaagcaacagcagcaaatagagcatcgcaatccttccttaaaaggtagtgattgtcagtgcacttagaagggcatacctattaagttgtgactttatgatgtcaacaagatcttgtgctgtgacgctgtagaatagaagaaaaacttgttattaagtgcaagtaaaataagacgatacataaagaactatctactcgataaaaacttgcctcccaaatatctgttttcctttcccacctttacgtggcactttgaatgccccaatagtttcaaaaacacgggcaagttgctgtgcctcttcttttacctactcaagcacaaatgctcaacagggtaagattatgctaacactggatgaaagttcttatactcttatggaaaatgatattggtaggaacaaatcatgctttagactttttacaaaataagctaaaccacaactacgtaccctggagaacaaggattagtagggtataactaccacagtagtttttagacagacaggaacaaataggaataagtttcaactatatcaattcttactgagtccacaaatagaataataggtttacttacccgcttcttttcagcatctatcctctcctgttctacttgcatttccctgtagacagcagcagaggaaattaagtagcttactagccatccttttacaagaactaattgaacatgttgaacaccccagaagaactgaactagaaatgcagaataggcatctataaaagtttgcagatttatatgtcaatcctgggctccacaaggaggcaagagatacaatggctaacacaacagaataaatagctgcaaatttacacctgcagcatactgtgaaaaccaactacgatgaaacataagcatacgtcaattaatttactaggagcacctatctgttggttgaaacatagcctatacaattcgtgagatgtggtaaatgactgtaagacagaagattacttgagtacttctggggtgagcagcgttgccttgccctttggcagaaggaagttgcggtagaacccggccctcactttaagcgtgtcccctttcttccccacctctgctatgtcatctgtcagtatgacctgggagaaaaagaaactcaagtgaagtaaatcaaatacggaatcgtgcattacatgctaaagtatagaaatgcataatagacaaggaagatgatgacataggcttggaacattttacagtttacaggtgcaaattttgaactgggtgtatctagatgccttttagttgcaactttccctacaaacaaacagcatggccaaaccaacaattccggcgttccggggcatatacagaatcatattagagatgacttttgcatctgagttgcaatgctaagaggcacctaattaaaaacatgacgatagtttcttccatttccatgtactgcatcagagcatgcgtccatggcaatgtatcttttcctatactcagatgtgtgaatgcacacagtaatcttaagcttacagctgctgcatttcgaatttttcgatcgatggaatgcagtcgcatgcgctttgtaatctactgtactgattagtggacagggtggtgacagacagtacattgggtatggctagttctaaaagaggcaaaacaaaagcatcaccagcaacagcttgttcaatcagtcagtactagtactgcttagctcgaacgaatcgcaattaaatacatacatacatacatgctgcaactgtggagagaaaatacaagtggaagccaaacctggcgatacttcttgaccttgccctgggcgacgacgaccagcgacggggagcggcgcggcgggaggcgggaggagggggcggaggaggaggcggcggagctccaggcgagcgtggaggccatggcgttggggatggattgcgggggaagggaaggaactgcggctgctgctctcttatccacttccccaacggatttggtgccctctctcttgggctttgcgctgctttgggcctttcaaatcggcccagtatcaaaggtttcttcgtgggttgtcatgggcttgaagattaagggtcattttggtttggcgctccttcttgccttactaattctttgataacttaaaggtcaaaaataaattatttggtaactttgaatagttaacacgtaactatttgaataagagtcaaattttgctaaatcaataaggtgaagccaaatagacaataacaaaaatttagtaataccaaaatttactcaagatttggcattgccaatattttggcatggtttcataccaaacaagtcgtaataataatccaccaaattgtaacccccttccactcaacgtatagagaaaggtaggagatatatatgtacgtgatacctcgacgatattactaagatagatagatagtacatgtgatgccaagatgttataacatacattaagagaaacactcaggggtcttccggctagctccacaaggtgatagcctaaatgacctggattcgtaacctcaccccttctaattatttgatattaggtccttcactaatattcatgttataacataaatcgagaaatatattattataacactattttggtgctatcttgaaactcaacgatacatcactagctaccattacgtataaacgtgtattaatagtataagcaaatatcaacgagtatcatcaagtatcaatgtgcaagaacgagtattagcaaatactccgtatcttcatgaataatatcaaagagtataatcaagtatcattgtttaattatcaacgagtatcatcaaaatatcatcctcgtatatcatactccagtatcatcttgttgtactttttctgacaaagatctccagctggtgacctgtttctcgaaaggaacaaaaattaaaaaaaaacctagcaaatcgttcttaaaaagaatggcgattatatatcttattgaattagtatgtctactgctcaacgagatgagaaaaccgaagagaagaggggtatataatcgagtatatgtcatcgtcgtcgtcatgtcatgcagccgtccatgacttcgtccttcccgccatcggagaaaccaaacaagcggactccacgaagctagctaagctagctagcgcgccaaaactttaaaaatcctcacaccctcttccaccttcgcttcatctccaatccaattctccatcgatcgttacacccaaagatcgagataccaataccatggaggaaatcttggaatccgagtactcggcccgccgcgcggccggcgacgcggcgtccttcgtgctctcccgcttgccccacccggacaccacgggctccgccgctgcggccttcgtcgtcgacgtcgcccgcgccggcggcggacgaacgacgacgctctcgttcgtcgccctccgcagtgccgcgctctccct

SEQ ID NO: 1296 - DNA, 13216 bp, Oryza sativa
gccctgtttgcttggcgtctctccccatctgcagcgtccacggcttgccgctgctcgccctcgcgctcccagccgccggagtgaccacggtgctgctcgccgcctcgccgtcttccgatccaacggcggccatggaggcggcggccgcgcacggcgccaccgacgtcgtggcgacgcctgacgtcgcggcggcgctcgcggctcccctgacgatgctctcctcgctgaggagggtgacggtggtgcctgctctcgcgacgacggaggcgcggcaggcgttccggcggtggctgccgtgggtcgagctgacggagatgtccggctcgccggagaagatgatggcgtcagcttcggagcaagtgcaggtggcgcctgacgctgcaagcgccgcggtgatagcacagtaagtgcgcccttactgaagattctatgtatcagtcaatatttgacacttacgaaaaaatggcacatttcaccttctttacatgtcaaaattcttgcaggcaaaacagcggaaaggcccattcaatatcagtgacaagtgaaccaacttcttcggtaaaattctcgactcaacatcactagaaaaatcatgcatgaaaacatatgtactagaacaaacattggcaaggaacgatgtccttctcggggtttatgaatgagatacacacagaattgagacatgcatatagtgacaactgaaccaaatttatatctgaatagtatatttgcaagtttgaggtatataaacaatgtattcatcccctcgccgaaaccaatgaacactttctacttctgtaacaccgactacagaaaagtatgccatgacgaacacaaaattaataactaatcaattatttctagaatgtgatacaaatgattcggtatatttgtatgatgttatgctcttactattgaatgtctaacttgcctatggaaaatttctaccaggtgccactacttaagaagattcagaagactgtcttgggagatattatctcaaaatcaaccgcgaacaagatcttgagggagcacccagaaattatctcaaaactgtagcagctctgcatgcgtctctctgcttggtagctgcttgtcttggtgttggtggacctgacaaccatgctcaaagggttacaagcactgcaaaagttgtactgtgaaatatagcgaattgaatgagtggcaacagattacgaaattatagtctgaatcaaattgtatggaaacgggcataatgcatgataggagaaaaatgcagtatttatgctagcacttgatttctgtaccttcagcctccaggacttaagtgacaactctgtgtgtgaatttgtatttggagtacagaagaaatgcaggtctaaattcaaataacctctgtgggtacgtgactacatgtatttggtatcacagcattttagcaaatatctttgtctcgaacacgcaggagatctacattttagcaaatacgacttgcatatgattatatatatgatatgacattttgaccaagaaaaggttctaccccagatgatctgttattgggttcatttcacaaataccaacttttttatcggccgactcacacaaccactacataggaagaaatactataaaacaataactcttgaaatgttcgtgttgccgatcgttatatattaccattttatatcaatgttacaatagcaataccaaaatgagttaaaattggcagctcacaaatctcatcattcttaaaataaagttccagtagtaaagtggtgcaaaacaaaagcgctttgacaattacttaaagcacaagtacaccagaagttccactccaggatgttgcaagtagcacttactattcatcatcagagatctctgcacttcctgccacccacttccaaacacccccagatttctgtctttgagcagttgtcatggtttgctccacctgagatatttgttgccgcaacacttctagttcattctccaaagaatcagtagattccagtcttttatgagcagcagcaatttgggactgaattaacgagaataaggaaataggttagcgttcagaagcatgtaaaaggatcaaacaaaagaagatggcatgctcatgcttagaattcattgtagtgcattaagacagaacctccagtttctggcacctagaaccctctgctgctaactgatgttgaactgatttaagctccttcataagaaagaaaaatagtgaggatttattagagatgaattgagaattccattttacaaaatggaaaataaacatgtaacctttgtcaattcaccatgcgataactttaccatatctagtctatcctttagttttgagttttcatcacgaacttctgccagtctggactctagcttgcctttctctccattaagtgcatcaagttcagtagtaatttgtttggaagaacctgaaggctgaactctcttcacatctaaatcatccgttgcaacaatgtctctggttttctcatcagttattacagcataggcagctgtcacagaagcagctgcggcggcagcagctggtgattggagcagacgaggttgcactaaattccttggcttaagtttcataacaaatatctgcagcagtgtccacttgtgaagaaattgcaaatggaaaaatgtgcaccaaaaaggaagggaagatgaaaagagaaaaaagatgcaaattcatcctgagtgtgtcaagcattgaaggcacaagacatgtgacacctaaaagtaaaaaatctacagatggatcatttcaaagctgaattgaagtactatgcatagaactaagtcactcttttaaattcaatacctcattattgtattgtccattgtaaccaccaaaggcaaccagaaacttttcgccatcaactgtggttgagcaaagagtgagaccctgaaaagttttttttttaaaaaaaagaaatataatattaaagaaaagttgtcagcaaagcaaaatccattatgttcttaaaacagtagaaagagaagcatccacatttgctgtcagggacttgaaattactgctgaagtttgaggaaaaagaaaattatctataccataaattgtggtgggtacagattatgatgatgtagattgatcagaaatatataggagttgttaaagctgtataagaaatacgatttcattttcagcaatcgccacagaactgtgcaggaaattcggctagtttactattaacatgatttgttttacgtaagtatagaggaaggaacttcctattcaaatgtgtttgttctcacagttgtgcgatagaaatttatatgagcaaaatttatcacagaactaggtagcacaattgtttacctcacaagcaagcggatctcgggctggcacactggtgactacagaccaaacgaacttggaagcattcatcataattgtatcagtagaacctgcatcgttgtattttctagctacttcagcagcacaggtggtgcaaataaaatgaaaatatgagcatcatgtgttcaggaattaccacttgcgttatctccgccaccaactatgtaccaattttcatcaatcatggtaccagcatgaccactcctaggatttatgtgcgcgccttgagtgtcaggttgagaccactccatctgtaagcattaagcttcacttaatcaagaatgaatagaaaacaatgttcataggagtattagtcaaatcataacttgggttgatataaggggaggaaataaaattctccttcattcaaagcacaacatgatttgttttatgtacctattgccagcttatgatatacggtagttgctgttaagttttcgccataacagactgaagttggatcttagtcattgcatacaaccacccagaaattcaaccttagtttccattaactggatacagtttgaaacttgaaaggcctactagaacctagaactaccagtgcggggggtttggagatcttcaataggcaatcaatgaataaatatcaagacaactgagtaactttttgcctttgaaacttatggtatgtgactcaatgcacaaatccatctgtatggcaagatacatggagagtatataacacttacagtttgcaagtcaagaaggtagatatcactaaagcatgtagagtgagaggaaccgccaaagatcaaaagatactgatcagcataaacagcagctgaatgatcatacctaggagctggaccacctttcctatttcacacaaagataataatgaattatgcaataacaatacgtaaatggaaccttgcacaatcaataaataaattcttaccctgttttaacttcttcccacatcattgtctccaggtcaagtatatgaaggtcgttcagaagtcgcctcttgttatcctctccaccaaacattatcagtcgagaaccaaccagggatacagattgaccaccacgagatatctggttgagaaaagcagagaagttcagtattcagaaaattctgcagaaaatatatgccagcacattcagttctatcacttcaaaagaattactttttgtttcaaatacaaaaggaaatgattcttactggaacttttccatatgtatcaacagaagaccagctatttgtttccacattaataagccaaactgcatgcagatagtcagcactatcatttaagataaataccggtcttgaaattttaatagaacataattaaaaaactgcaaggatgatattacatgttagcaagtactatagactgtttggggcaccttgaaagtgaagctaattatgaagcatatatgattaaatagaaagttcagtacactgtgtacaagtgcataacataaggaaatgtaaaaatcatcacttaaaacaatatcaaagttaatccgaacagcctttaaacacatgaaactacatcgagtaattatcttagtcagcatttcatttgcatctcatttttttgccaggacatatgaaatgacatggagcaaggaatagtcggtaccattttacaggtagaggcaaagaaaaccaggaaagggttctgaactaacgtacagattgcttcagttcccctattggagattatctatcttaagcgataaataggtccatataaagatgtaatgtacatatagccgcttcaaatattgcatctatacaatatgtaaggtcataaaggatcatggtaattggtggtgtggcaaagcaataaagtcataagtggattatttagcaatatatatgtctaagaagatctatgataggaagattctgtgctctatgtttcagtgtgacgatatctatcaaataattgtagagcttttgaatgagtacctgaaaccttgtttgatgttgatgttctggtgttcccagctacaaccacaatatattttttccagttgacctaagtggtgacactatgttagcataggaaacataccaatgttggattgtatgataaaaatattgctaagttgccatacaagtgaaagagaaaagatagtaagtttaccagactgtggcctgctagtgcagggaatgaagggtctgtggtattattttcgatattcaactgacttgaatctctagcagcacttaatgctgaccacttgagtgtcctaaaatcaaagacctgtgaagttttcccttgttatgatatagaaggagaaatggcatgagaaacatgatttgttagagtgcattagtgcagactgaaaaacctggatatctgatagatagcggccattacgactcccaccaaccacatagagtttttcacgaaccacttccgcagcatgctgtcatgtattagcacttcaataaaatatgatagacaacatatggaataaccaaagaacatcacgctattcaagttatcttttcttttcggcgaactcgcaaaagccttgcgcatcgatatgttagcaggaaaagagagattttacaactgcgacctgctgagtgctgacgcagatcatgggggtttacaggggagagggagggcacgctagattaactagggtagaaaccatactcctgagaacaacaaggagaggagaaaaggagaaagagtagtgactaagcaccaagaagatctcctaggggactaggcaacgctgcaacccaaagattttcaagttatccttatcatatactatcttaaggtttaatgggtttcacagtctaacaaatggagcacactacaacaacggtttcagtatgccgccttgcataaactctttggctttaatcagataaccatgaaaacaggacagtagggaaattaccaaaatgtggccacacccgcgtatctgaaaccaaaattctctcaagactacttctgtcggccatttcagtcctaatgccaatccctcggcattgtcccactatacgcagagatggcatctccaaagccacaggattaggcacgcggtttgtcacattttcgcattcgtttgtctttaacgtgcgttccctgagaattgatacgacagcatctactactcgcattcgtttgttcttaacgtgcgttccctgagaattgatacgacaacatctactactccaactgatcaatacggacaaaattacgaaaactactgctacaccaataaaaattaaaaatcagacgacaaggccgtgagtaatcggaggtagaaatggaaatgggcgcaccttgtaacgcgcggatgggcgcggggatcccccggcggggctgaatgggagccactggtcgtacggcgccgccgcgaggtcgccggcgtcgccgttgatcccctcccccatttccgcctcgaatctgcaggggatcgatgtggattggaggacggggatgggccggggtttggggatctgcgcggtggaagcttcctccgcggattggatggattcctcccagaattttgactcggaaaattggatctgaggccgcggctcggatttccaagcgagcgcggatcactggagtggactcctcgttggtttctgcgtgtcacgttcgctatgaaatacgcctccctgttatgaaatcgtaaatggagcgcgaaggcgtatacactggaatgtgttctcacgtacagaaaacgtattctcgtgaatacgcgttggcttacgattgacgtaaatggtggcctgtacatcttttgaaggtgaatgcgctgatgagacgttggcattcaacatgtactttggtccaagtactataggtgcggaaggaaagtgtagattaattattgaattgtctattgttgtgcatattattggatttttttactgtaaactgtatttcttttattaacgtattccctacgtactcgtaaaggaagtcgttttggacagcgacacggtctccaaaacacaactttaacttcttctttctataaaaatatttattaaaaaataatatatgcatactcatatgaaagtatttttcaagacaaatctattcatataatttttacattttcaaactcaacaacttgagagttattcatgatttatatttctaaggtttgacttaaacattgtcctaaacgagtacggaggaagtacaaatttactcaaatgtgcgtgcgtacgtagttagtattacctccgttcagaaacaaatgtcggtttttactttgaattaccaatctctcaccaactgtatttttataaaataatctgattatagtatcaaaattgtatcattagtttgtaatcataaccactttactaatagttaaagtttactactgcttgatcagatcaaaactaacaaagatcaaagaagtacaaaagtgatacggagtgctatataaaatgcgcaaacaaacttatcgtgtgccttatgcgacaactcggagacgtaatgcgatcgatacaccttccctaggaatgagctgaggttgacaaggcatcctcactctctcttctctataatatttttaaaatcctgattaggtgtccagttagaatcattaacctaatactacgaaagagctgaaagtagtgtgaatcttagaattctgggccttttggaattgtgtttagctagccatatctcgaatcatagaaagcgactgaactatttagctaacaccgacaggcagacaactgaagaatggtgtccagatagctaccagaacaatagcatttttttttgtcataaccagatgagtttggttaagctaacggattaatttttggtacggttgatacgcatgcagtgatgtagatgatgcgtgtgctctgagaattcttgatacatcagcaaaagttctcccgctgttaaatggaatagtagtatttgttggtgtgtatatgttcaggttcttgtttctgaataaggtaaacaatgacatgtttttgtcatgaaatcagaaaagatagtactgctgattgaaccccacgcgtgtagcgtgcttattttccaacgaggaacaaattgagaaatgttggagataaaaggttagaacagttaggggttggtaagtttgcttttttcccaactacctcttgttccatcttccatacatgatgcatgcttcaccgccaatatgtcaatcttctgatagcagctcgcattttcatttataacaaacttgtttaactatgaaaaaattaagtagctaagaatgtaagcacagattcataaccttattcagttctgttgtctgatctgaaaattcagactacaaaatgaccagaaaaaccaaagatcagcattatattcggatcgcataaatgctgagaattaaggtagataaaccaaaacataacatatactatagattgctcatccttccccaccatgtgtcattaagaggactcatcatcactgacatcagatgaacttgttggtcaagtctcccccagatgattatttatctccgatgttcgtggccctgataaccaattaagttttaacctacaggtatgttttcttaatgctggtgctactaattaaccatctttgagcatttaagggtgccattaatttgaaaaatacaactaggtaagctagcttggtggtgtattaagacatgttcatatgctattatactataaacatcattaatgggtatgtagacagctctgtttaagaaacattacggtagtgggctttattttgcagggtcaaggcatatccatctatgttcatggcatattcctagtatagaaacatccattttagtcaacggtgtgtataaatacggcatgtctcccgtacgtgattcatgttggcgacctcttctcgctcgcaactaattaatcaattatccgcggttttaaattaatttgcgtcctagtacttactactcagagattcagagtctagcttgttaataactgaacaacctagttgatgcgtttggtaactaactagctagcagggttaggaggaacatggcatgcaatgaatcgatcgagagccgcatcatcctcaccgaccaatccaatttaaggttgggttcgtataggcagcgaaaggcatatgcaggttgcagggctggaaatcagagcgaagtttcagaattcaagtgcacatgcaaagagggacattaattcagaaattagaattaaacaggaagatgtcttgaccatctactacgtgtactagctggagtagcattgaatccatggagaaggagagatcagagagaggttttggtgtagtatttggtcccatgcatgcatgaacgacaattgaagtacactgacagtttgtgaccgggagtcacacaaggcggctacacatgcacgtacagtagtgatcgtgattgatggaggaactcgacaactagctagtctgaaactgcaagtgtgcagctgggtgccacggcgagcacgtcgttgtggatggccacacgggatcccatgaaagaaaaggtacggggaatatccgactccatgggcccacctgtcagcctctcctatcccctcctgccatttgccacggcctcctcctcccttttgaagatcatccctccttccttttccactgccattggattggaggcaaagagattcagcttagtaatagtaccgcttaaatctgcatgcgtctgtatatcagcaggctctccatggccatggtcgattcctcctagcttccttcattcctcaacgctgctgctgctgctgcatgcgtgcgtcgccgtcttgtcctttttaattccagagtagttagttagcagctaatcttggctttagtactccgtattagttagcctagctttggatgagcagaagggcagcgtgatcctgtgcacaaccaagacccaaccccaacacatggaagctgcggcaggggcaggaggagccattgcaggtagtggtcgcgaggcggcgccgtaggagaagcacggcggcgagcagtggctagagcagaaggcgaagccggaggcggtgtactgcgccgtggggaaggaggcggtgaaggaatggaaggcgaacctcatgtgggtgctcgccgccttcccctggaggaggaggaggagccgcatcgtcctcatccacgtccaccgcccgccttcccgggtcaatatgagtatgctccatcgctagctatttcattccaaatactattccagtttatttccaattaactcccgttcttcattgcgtgcgttcttcttgttgcagttcgctaattcttgcggtcttcttgttgtttgcagaggttttggttgtttatgcttcttattgttttttttttctgtttaattttacgggttctcaattgcccccatgcatctgttcttgcttgtaattaatccggttcagaaatggctttttttttctgtttcttggcatttgattgcactccttcgaaatggcaccattgcaatctcagtattccaaccattgcaaactttttatatatataaaattcatctcccgttatcggcaaatacctgatcttttcaaatccgctcttgcaaataacagaaaataattcaaaccaccttccctaaatgcgacaaatctaatttttctagaaagatcattccatttctttttggcaaataacaacccatttcaagctagctgctgtctcctccatggaaactggggttttttgatgctgcggctgttctacgtgcactgcttacattccttttattttcccatttgaggcctcaatttgttttctgacttgtcgtggacgtgcattatcaaggaaaaaaaatgcgtagaaatcaacatctcggacaacttaaactattgctcagaataatcttatacaaatacatctctgccaagtggaacagtactatagtttctgctaagcatatccgtcttcagctaaaagcatattcactgtttgtattttcagtctaattaagaattgcaatgctagctctgaccttaatcaggttgtaaaacatttccccttttatctggctattattttgatgaaatcaaaatgttagacttggctaccaatattttcttgtaaaatgacaccagctggctgtttatgttctctttgcttttcccaccaaatctgtcaacctgaaagtaggtgccttttgttatgttcctacctttacaataccttttacattacacttttgtgttccaaaaaatgttggatcttttgtgacatttttttttgggtactacctgtggatttgcagtgggggcatgggtcccagtaagtcagcttgcagaggaggaggtgaatgcatacaggcagctggaggaggagaggatcagcaaagtcttagatgatctcttggacatttgcaaaagtcaaaaggttgaaaccatgataaagagttcattgttttacatttgatccatcttgcttgctgtcaatatcagattgctagtctcaactcaccaacagcctctggctgtgttcttattatgacagtctccctcttctccatatccagcttgggttgctaacaaagttgctgaaaaaaactcgcaggtcaatgcgagcaagatcatcttctcttgcgacgacatcgcgagaggcctcctccagctcgtcgatgatcatgggatcactgatcttgtcatgggagcagcatctgacaaggcctattcaaggtatggctgtcttgttcttggaaattaatacatacaaatccagctctcgctgtcgctgctgttgttatcaatcgatcggtccaagaactggctggtccagcttggtgccagtggattgctgaattcaaaggcaaatgatctggaattctggatgcaatgtgatgttaggaaaatgcgggccccgagatctaagaaagctcggaaggtgcaactgaaggcgagcccctcttgcaagatctggtttgtctgcaaaggaaaccttatctgcactaggtatgcatgcatgactcaaaaaagtcttaatgccaacgatgcaacttgcaaaagcctttggtttttcttctccctgtcttgctcaaaatgggacaggtatttgtagatttctatgatagcactgatgacaaagactgaagactgaattgaagtagcacaccgtttaactcgtggttattcttctatcattgtaaggaacatgatagaaactttttttttctcgagataaacatgatagaaactgtggttgcgtcggcaacatttcccgacatagttgtctgggaatttaccgttcttctatgaccattttagctgttctcacattaagacaatgatcacagactgaattaggccagacatcctgctcaaaaaagaattaggccagacaaagaataatctgatatactgataatatgataatgtttatgacaaatgactaacaaaataacaaaccttgaacaaaaatagtacctgtggaagcactgagattgcctgaacatcctagtttgtgacatattattctgaacttttggcattcttctattagctttctagctgttctaacataaggatattctatttttcctggaaaaatattataagatttacatatttcctttaattccatttgtctgatccgttatagggaggtgaacgaaggactcaatagaacaggatcatcgacaactagcacaactccgaggtcgagcacttctgattactcgaggtcgagatcctcgccacgagtgcacagcctaagcagcgagcaattcggtatgcaggatccagccgaaccgacgacatcatcagttgatcagactcctatcagggaggacaatgccatggaccgtggcactgagggttttaatcatgaagcagttgctgttgctagttcatcaa

SEQ ID NO: 1297 - DNA, 542 bp, Oryza sativa
ggattggaatttctggcataggtgcatctgtcctcggaggtaaaggttctgggacaagaacagcatggctgatgcgtcggccatttttctgtgatccaaagcagaagtacacactcaaccaatcagcccattttcttcgctgcaaaagaacaacactatttaattcaaaaggaaagtcttaatcctcctgaaatgtgacttaagaagattactattgtagcataaatatttggcacataaacagcataagcacagtcgagtacagtagcctgcacctagcttttgtcagacatgcattctatagcgattgtattgcagagttaggatgaccaataacgtgaacatgtaaacaggttggcaatagaaatatagcatcatcgagctattaggctccatgttaccgtaacgaaaaactagaaatgaaattccacaaatcatcaaaattacgtcatagatcccccattagccaggtaatgactttccaggttaaaataaaagcattaagaaagtttcataaatgatcataggcaccagataacccg

SEQ ID NO: 1298 - DNA, 526 bp, Oryza sativa
  unsure (1)..(526): unsure at all n locations
acgaatctgtcatgatcggagccggcgacggcagccgtggcagcgtgtacaggggcgacctgcgcagcatggcggtcgctgtcagatgatcggccgtgacgtctccgtcgacgaggtcggtttctgccgcgaggtggaagccgtcggcagggcgaggcacccgaacctcgtcacgctcgtgggcgcgtgcccggaggcccgcgccgtggtgcacgagttcgtgccgggcgggagcttggaggaccgcctcgccggcgccgcgccggcgctgccgtggcacgagctgtgcggcgtggcgcaccgggcatgctccgcgctggcgttcctccactcgacgcagccacgggcgacggtgcacggcgacgtccggccggcgaacatcctcctgggcgaggagtgctgctcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1299 - DNA, 819 bp, Oryza sativa
aaattgaagaggactcaccaactccttcagggcatggttcggtatgtgctatacgtttcataaatcatacagtataatactagtttcaagggaaaaaaagttgaaagaatttttaaagaaaaaatgaacaaatcccaacatgtagaaaaaaactatctgaattccacattacatgacatctgtttacttgttcagttacatcaagtgctagacatctgtttattttcctactcctagattgtttgatcttggactgctgaaaatggtactaaaattgtcgaaatgacttgtttttgtctccactacagaaacataatttgaacagcacatgtttcataagtcgaagattttggccaactgatctgcaccagaatatacagcatcagtgtaatacacattatatgtgtttcagatagtaaacatttaaacaataaacggtgcattccgttttgacaggaggatgctggtgatgtgagcgatgcgtacgacaagttcaaggatgctgtgatagaagccgagaacctcaggcatgaggcatacgaggagactcgccggcgtcaaaaggtcgagcgcgacctcgccgacgcgacaagaattgtaagtagaggaaatgaatccaagctgcattgcatcgttggttcgatcccattgttcatgtcgaattcaccatggatgcttcccgctgattgaagttgcgtttactcgtcgtagtagtctcttcctttttcttctttagtttttcttgttttgtcttttctctcttctcttggcataagccggtctggcggattacgttgtataaacaaacattcttttctt

SEQ ID NO: 1300 - DNA, 535 bp, Oryza sativa
tatatgtgaagtacttctcttgatcattgtcgacaaatgtaaaatttactataaagggtcctgccatctctggaattgagggaaagtattggccattccataccccgctagtcaaatatggtgtggatgagttcaacagtgtaaagatgtattgattcgcaccacttggatctaactcaacactgtatttgccaggagctaggtcaattgaattcttcctagaaaccagacggctattgagaccactgatcttgctccaaccaagttttgcaccagggaggaaagtatgtgttgggtagtcaaagctttgccacagcgcatcggatgaattcaagaaattctgtaggacgaggtttccgctgttcaatagcatggcaactgtgtcgctagttgtgatatttattcgggtagaccaaacgatggatctgttggatcgatctaagatgacgagcccgccatcgccagagatcgtgagctctgaattgttggggtctgtgactgggttatcaccggttggcacccatactggagttag

SEQ ID NO: 1301 - DNA, 6087 bp, Oryza sativa
acttcggaaggggcgggaagagatggcccgccggcccaaaggaggaaaaagagggggaaaaaggaaagataaaaaggaaaaaaggattttcccagggatttaatattgcactttgcttattttaattggttaaaattatttccaaggctctgaaaattccactaaaaatcctgttagcgtattttgacatgtagaacccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcagaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcaattgagatacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtatacgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcacccgttggcaaacatcgcagagtgcgacgaattcagctatttctctcctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtaggccgtgcctctagggcagctacgtacccgtgttccacgatgcccaaatttaggtgctcaagatcttgttgcaatttgccacacatgtcttcagtgcataaggcattgcaatagctttttctgctcaaagcatctgctaccacatttgctttgccgggatgataatgtatccccatgtcataatctttaattaactccagccatcttcgctgtcggagattcaagtcaggctgagtgaagatgtacttcagactcttgtgatcagtgtatacttcacagcggttgccaataagatagtgccgccagattttcagagcatgaaccactgctgccaactcaaggtcatgagtgggataattggtctcgtgtgggcgcaactgtcgcgaagcatatgcgaccactctaccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccacttgaatttttcatctttctttagcaactgtgtcatgggcctggcaatcttggagaaattttcgatgaaccgacggtaataacccgcaagtccaagaaaactccggatctgagaaactgtctttggtggggtccactttgtaactgattccacatttgatgggtccactgccacgccttgagcagaaatgacgtgacccagaaatttgacctccgataaccagaagtcacacttgctaaacttggcatataactggtgctccttcaatttctcaagtaccagacgaagatgttgctcatgttcctcttctgattttgaatacacaagtatgtcgtcaatgaataccacgacaaacttgtcaagaaactccataaacactttgttcatcaagttcatgaagaaagccggtgcattgatgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctaactcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttctcccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaagggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagctggcggatctgactgatctggtgccattagtgggggtggagtcgagttgtggttgtgctgcttactgttgttgtgactgccaccgttgtagtcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcatcctggcggatagccttgtccacaagcttctcaaagtcctcatagactccggagattagttggttggtcaattcatcatcgagcccaaacaaaaacttctcctgcttctcagcatcggtgcgcacgtcctcgggagcgtagcgcgcaaggcggttgaactcatgcaagtactctgtaactgacatggttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcattccttgtcttcaccatctggaggaggataggtagaaataagagaaaggaagaaaacagccggctcggaaactaatctttcttataagattaagtgccattatcttaatcttgattaaaacactgaaaaagaggcacacaactcctaataaaggctgtcataccactcacacatgatatcgaccgccgactaacccacaagcaacaaacctaaacacaaaaactagcacgcaaacagactaagaagacgataaagctaagggcggcgactctgaagcttggagcggcgcttgcgatcggagaataggtctgacatctaaagagtacagagggataggaaccaacacatgctcaaaaccaaattaaataaagcaacaaatgactcaagtaacttgccgagcatgatgatttttatgcatagaacatttttcatgaacccggataaagacactaatgcgactgactaaaccatagcttaatgcataaactagttgcatggaaaatgatgcgcataaaattgccccatcgaacatagacacgacctaatgcatatcacccgataaattcccaactgactatcaaatataactccaaataaaatttttctaaaaccctagaccgagctaattttaaggatccgatccgaatgaacgaccaagatttttcccacaaaccaaagaggcaaaaccccaaatttttcccgaaacaaatccaattgcaaagaatatatgcaatgaaaaggattcagagggctcttaggtttttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagagaaaagcgagctaagcctgaagacttgactcctgcagtgggcgactccattccacaggcatccttgatggcagcgacgaaaccaacctcttcgagacatcttcaactgagaaggacttcaactctggtgtgggggaaaagagagcaagactgagtactacccactgtactcagcaagtcataccggaagaagaggtatgatgcaagatatatccaagggaggcctaagggtcttttgcata

SEQ ID NO: 1302 - DNA, 28898 bp, Oryza sativa
  unsure (1)..(28898): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaacagtgtaagcttcaattctccctctgaaattccagccataattagagaagaattctaagaccctcatctctaacaccttgcaataatttttcaacatgttgccatcctcttccttaagcaacaaagaccaaagtcttgcccagtgtgtccctctgaaaattacctgcataaaagagtaagtacatggtccattaaaaaccacatcattcctatttaaccacaccgcccagcacaacgccgctatgcccacaaaaacttgattttttagcctaatgttaacaccacttagccaactaccaagtaaatgagacatattgtgcggtgggcagatgccaaaagtgaaatgtactgcgctccacacatatcttaccatggggcaatcaaagaagaggtattgtattgtctcatgagacctacaaaagcaacatctaaggctacctttccacctcctcttagctaaattatccttggttaaaatgaccccctcttttaaataccacaagaagatctttattttcaacggaagtcttagcttccaaataaaagattgccttggtatcacatttccaaacatgagttttttatacatcgagttgactgtgaaagttccatttttactagcatcccaagtaaacctatccttttgccctctaaggtttatatcaaccacgttagctacaatctcatgccatgctttcaaattatctcctattatggctctcctaaaggagacgttcaaaggaaccctctccaacaccttagccaccaccacattcttatttcttacaagattgtacaacgatgggtatattttctctaaagattggtttccaagccaacagtcttcccaaaatctgatttgtaaaccatcctgaagtttaaacgagccaaaagagctaaaggtatccttcactcccattagacctgtccaaaagtgggagtcccccctttgcttttggacctgcattatagtcttcttggcaagatattttttcctcaataagttttgccagacaagttttgccagaccccctcttcattaatcaacttaaataaccacttactcaacaagcacttattttgaacctcaagattctgaatccctaagcccccacattccttgggtttacatagaacactccatctagccaatctgtacttcttcttgtgttcatcactttgccaaaaaaatctggatctataatagtccagctttttgattatnnnnnnnnnnnnnnnnnnnnnnnataacatatacattgcaaggctgctcaacactgagttgatgagcacgagacgacctccaaccgaaagtagcttgcctttccaactacctaatcttttctgaaatctttcttctacttccttccaatctttattagacaactttctgtaatgcatcgggaggcccaagtactttagtgtatatgaaccagttttgcacccaaagaggagagcatactctctttcaacctctatagctttgccaaaacacaacaattcactcttatgaaaattaatcttcaagccagataacctttcgaaagcacttagtacaagtttaagatttttagcatcctctaggtcatgctccataaaaagtatcgtgtcatctgcgtattgaagaatggaaagaccatcgtctactaaatgtggaatcactccatgaatcttaccatgctcgcttgttctctgaattaacactgccagcatgtctgccaccaagttgaaaagtaaaggggagaggggatccccctgcctcagtcccttttttgtttgaaagaagttcctatctcatcattaactttcaccgctacactgccacctcttaccacttgatcaatccacttacaccacctaggctcaaagcccttcattcttaaagtttgttgtagaaacttccaatcaaccttatcataggctttctcaaaatcaagcttaagaataacaccatccttctttcttttatgcatctcatgtaaggtctcatgtaaaattatagctccttccataatgttcctaccctttaaaaaagctgtctgagaaggctttatgattttttgggctaccaacgcaatcctatttgccaagacttttgtgaatattttgaaacttacattcaacagacagattggtctatactgttcgtttgcaactagagaagatcgatcaatttcctggtgcgtaagactgaaaaaactactaatatcatgtatttttgctacatctttccaatctttatggttagtacaggacattatccaatccagtgacatttttttttgccgggtcagccaaaggttgtccgaccaatctcattaagatttaaagaggagaaaacatttgttagttacaaccaatccagtgatatctccagccagatgggtggttagtagtttttatttgacaagatgcatccagtagatgatgcagaactgtgggacaaaaaaaatatcatagggattatggctatctagtaaatgatgcgaatataattgttgaaaaatcgaaagtagtaattagaccgcttggttgaaaagcctagggggatgagcttcaaaagaatatgggaaagggaagtcgtaggtttaaacattgctataggctaagcaatggtacctgctgtgttgatttcactaattaacatttcaatatagatccacaatgtagcttacatttacgtctgacaatcttatgcacaagaaaggtaaaaataaccctatcgattaaatagaatcatttgattgtgaaaatattattctgcaatagaacaagagcttccggcaatagcttgcagtagtcttggcattggaggtgtgtcaagttcaaatattccctcgagaatttgaaccacttcacccatagtaggtcggtcgaactcattatcttgaatacaccaacaagcaaccttgcaaactctctcaacctctgttaagttggcgtcgccatgtaagttgggatctatcaagctttctacatctccctccagaagcttatgcgcgactttcactgggaaataaacatctttgtcaccaccagtgatacatcctccatttgaattcctccttcctgaaacaatttccaacaaaaccatcccatagctataaacatcaacttttggtgtgataggcactccactaatccattcaggtgcaagatatcctatagttcctctcattgtagtcaaaactcgactaaaatctcttcctagaaactttgccattccaaagtctgcaattttgggagtgaatgattcactgagaagtatgttttgaggtttaacatcacagtgtataatgcagtcgcggcagctgtcatgcaaataagatagtcctctagcaactccaatagctatttgatgcctagtatcccaattcaaaattttaatatcagttgggaatagatgaacatcaagggaacgatttggcatgtgttcataaacaagcagtttactatcattgtcacaacagaagccaattagttttattaaatttatatgttggattagtccaatcgagctcacttctgctctgaattgtttttctccttgatgtgcaccagcaagctttttcactgctatagttcttgagtcatggagaaatcccttgaatacagaaccaaacccaccttcccccagcttttctgagaagtttttagtcgcatgctgcagatcaatatatctaaacgcaacaattccactctcaccttcaacattgtttgatgtgcaattatacctcttacttttgttccaccaaatcactagtgcgattgccagcataaacagagcagcgaagcttagaccaagggcaattgcaatgatcaatcctcttctgttctttttctggctttgctcctctcttgaagcaaggcgaatgtaaagggtccctccattagtatcagttatgccatcacactgctgctgttttacatcgaacaactcagcatgccagaccaagcagccaccattgccataagaatatgcagtgcaagagcaattacttaggcaaactagggcgcatttatctgcatttgtagcagcttcaatgctgtagccattttgaggcaatctaacacatggcatagaatggaacttgtcagtcaaacttgatgcggttttgttgctagcacagtctaatggagtatttctcatgcacccatctgtccgatcatctaattcccaatcctttggtgattttatggagaaacctttcatgcacttgcagaacccaagttcattatcgttacagattgtgaaaggtccacaaacagcaaatacatcacattgaactttgggttgtgcataggtcattacccaatcttgtgagccctcaagccaaacaaatgtctttgttcgacctgagacatccaagaaatgatggaaaaccactgtctcatctagtaagctatatgtgaagtacttctcttgatcattgtcgacaaatgtaaaatttactataaagggtcctgccatctctggaattgagggaaagtattggccattccataccccgctagtcaaatatggtgtggatgagttcaacagtgtaaagatgtattgattcgcaccacttggatctaactcaacactgtatttgccaggagctaggtcaattgaattcttcctagaaaccagacggctattgagaccactgatcttgctccaaccaagttttgcaccagggaggaaagtatgtgttgggtagtcaaagctttgccacagcgcatcggatgaattcaagaaattctgtaggacgaggtttccgctgttcaatagcatggcaactgtgtcgttagttgtgatatttattcgggtagaccaaacgatggatctgttggatcgatctaagatgacgagcccgccatcgccagagatcgtgagctctgaattgttggggtctgtgactgggttatcaccgtttgccacccatactggagttagcttggggattttgttgtaccatatgcctaggtaccaatttagggtgttatgagaggacttactgccagtctggaagaagccgagcgcgaacttgccgttgctggatatgagcttgccgtttccaaagagcgcttgcgcaggtgtcatggtgtccatggcagcacaagatgcagagatgtgtagtgacaagagtaataatccaagaagggtgagggcgagaggcattctgaacgagaaattgggatggatggatgcagagtgttggttaggaatgagaactgcagagccacagctcctcccctttatattttgtttgtgctcagtttgcttgggatgccaattttagactccattacctgctacaaatgggtaagtttggtcaatgaatctgttcgtttgtcacctgtatgactacgtaactgtgaatgcatgctgcaggacagatagaaaaacatcattttcatacaatcgtagtgatcaatttataactaaccactgcactttattttttttttcagagatcgttttcttgccctgtcagccgtgtgagccatgaagtagctccctcaaatgtgaaagagaatggaatcgtaactggggtggcacaggtgtgttgaaaaagaaaaaaaaaagaatgcttgatcggccttggaaataatggagacaaataatgaaaaatgccttgacttggtcatgccgtttagtgcttaatcacgagtactcaaagctggtactgaccatctgattgaattgacctgctcacgataggcaactccatcttttaggcttagttcgtttaaattagtgctagattgttgaaaagggatatttgctacacaatttaaaaatacttttttttcaaaaaaaagaactttattccactgtattttttaagtttatttattaaaatatttaatctatcactataatcaagtaataatgcggggcaaccatctactcaacaatctgttttaaaccgagcctttgccaggctacttcagtagttttattgagctcgttgctgctgagagtttggtatgcagctcgacctttatcagccgagagtttgagttttacttcttcgcatcctgcaaaattctgtcatgttgaaatatgctgcaactctaacgatttcgtttacaaccctctttattaagtagtacttttgaagagattgatgcagactgtatatatattgtataaattaactattaagttgactatagataatttaaagccagcggttggctatactattaaacttgctcttagtgaggtcaaacaacgcgggtgcaacgcgggtgcagacaccgcatcacagtttttttagctcgcggaattgtaggacttttcaaaagtctaaacagattctcagtccgtattttaccgtattttaatgtataatgtcattgactttttatatacgtttgaccattcatcttattaaaaaaattatgtaattattatttattttattgtgacttgttttatcattaaatgttatctctgtaagcatggtgtctaaacattaatgtaccaaaataatatttctttcctttctctcgtatccatgcaacaattcttttttttttactaattgctaagagggcttagatagcaaccatatttttattttcatcccctctttttcttccatgtaatcaaattttacttacatgataatagagagagagtttacttataaagatcattgtacctggcctaagcaatataattgaagagtcacattctagcgtaggccacacccaattaagactttagagtaaggatgaaaatatcaggaaagggttactattttcttgaacaatacaaaccaaacggtagagccagaaacgaaaatgataccgattctaccgtaatatcggaaaatatcatgaacgaagctactccctttgtcccaatatgatcatccactaaacaaaaggacacctagaccaagaatatcaaaacattcatcatttataaattaattatcattcaagcatacatgcatgcagggcattacgcgatgcacatttacttttttcacaaataaataaagagattttattagatgatgatcattttgagaaaactaatgatcaaactaggatggggaagtattagaatagggcatcggaaacaccgtatcacaataacaaggaagtttctatcaagtttgcattataaatttacatcatatacacaactactattgacgatttaaagcacaaactaactaataacatggagcgcagctagggatgaaaagaggactgacctgcgaacttatatgtcaacccgtgggcctattatggtccgacttaccacgtagagatgcaagtgggtcgatccataaaattatttacaccctcaattccaaaatataaggcacaaccaaccttaacccgaagtccaagaaataattaatatcacatcattgtcataaatcaccccaactagtacaatacatgcaaccaatagaattaaaatcttgtgagtgtaggatttaaaataataataatttatgggagagaatgtgctaattaattacatgcatgcatgcacgccttatattatgaaacaactttaaaaagtagttgtgccttagagcaaggctaataatacaaccgacctgctagctataaggacatttgtagccttctctcagcctacctatataatagttagcttgtcacaattaatacaggacccacttgtctctctcacagagtttttggttcttgtgtccaagccggctgtaagtttatagcccgcttctcctctctctcctctcttctttcctccaactcagcatttagccgacttatagcctactattatacttgctcttatattttagaacggagaaagtataaatcaaattaataggtaacccacgagtcaattctagagttacgtattaattttacctctccaactctccaagcgcagcatgtgttttatcgggcattcgggcattatgtatcgctggacctgtcgcggcattgtcccgttgtccgtaagttaggtgggctgtggtgggcttcttcggccacggtgatgaagacgatgggcctgcagcctcggacgagtcgtgaaatcctcctcctctgcgcgcggggcgagcggcgagcggcgagcagcgccagtccgccgaccgccgtcgccgccgacggagatggggcagatgtgcgacggagcatctccctccgcggtacggtctcgccgccgctacgtctcctttgtaccagttgtttcttcgatttgggggaaagcatattttgttattccacaaaatgttagcagatgcgccgctgaggacgatgcgaatcgctcgagatactgagggatccttgggggctagcccggatgctcgcaagcgtgagatttgtgggatgcgtcgtgctctccggtagattattcgattggaaaccgtcgccattttgttgttcgttaaaaggaaaaatagatttgaacatattaggtttttcttttcctactatttttgtcagtactttgttcgagggaaagaatgctgtatttatggttcatcgttcactgaacaagcgaatcgtaagattggcagtgttaacttcgttgggcatttgggcctaactcatagtacagtaatactatagtcttactggaaacaaacaagacaccagttcataccattgagcttgctctgatctatctttgtaccagggagaaagttacttgtcaggtgctcaaagcagcgctacagatggttttgatttctacagtgaatggaaggcatttgtgctatttgatttctacagtcgcaatggaaggcttcttgttgtgtattgttttttttcatatatcccatgcagtgtgtcattggattggatgccatttcacgatgaacagaattgaagtaagcatgatgagagatgcagccttctctatccagtttatgtactaagagaaaatttaattataacaatacatatactaaaatatattcagggttcagacttcagacaactactgaagggaacctctcaggtttacatcaaacctatcttcatgtcaagagttaattggctggtgcactgcttgttgtaaagcttattctgtccaggtacccatcaactagctctacatatgaaaaaaaaatccagctaggaatgttgatgtgtcaacttcttttgaagcttcttgcagttaccttgcttcttgtgacgacttgtgaggcttggcacatgcacacaacaactacttgtgaagctaatccaactctacttagctggttattaccatcgacttgccttgacctgttcaccaaaggtaacttttggtttagcagcggcagttctattcttctattatgttctgttatttactcatcttggcacttatctttctcagatcaatagttttgatggaaactgatgcagtatacagtttgcctttggcagatggaatggcctataaatcgcaactaactgcagcagcagcaacaactgtagatgaagaaagagagacaatcaaacatgctcatccgttatcttccttcagtgattggtaacacacaccccaacttttaaattccttgcagttaaggtagttagtgttaggatttgcgcgtaattctggcttacaaagttcttgtgttatagttgtagaatgtggctatccttgaaaatacaagttgcagcttagcagccaggcttctcctttttgtttgccagtgaacaatttagccttgtatttataggccatatataggccatgtttgcaactttgcataatatgagcagcatagttgtcaggttgtcacacatttgccaatgttaggctcaacaatatactctctcaactgacaaggcaattgcgcctgcgtgtccggaaacatctcaattggcaacatgaaaaatgtatacggtacactaatacctacagatcttacatagacacaaaatatattttgtctggaaggctggcacgatctcctgcttgggcacagagatcttaataactacgagtttatttaacatgatctcttaaagaccttagatgttatccctaattttctaaaaaggcaagatgaattataatgtcctggtagactacttttaattgtgaatcagcatatagatttacactgaatcaaaatattgtggtgtcactgaatgtgagtctcctgtgatagcacttagtagtcttggcaatggaggcatgtcgagttcaagtagaccctcaagggcctgtaccacctcagccattgttggtcgatcaaattcgttgtcttgaatgcaccaacatgcaattttgcaagctctttcaacctccactaggttcatgtcacctttcaaactggcatccacaagacttccgatgtctccattgagaagtttgcgtgcaacttgcatgggaaaaaagaatgaataatcaccatccctgaaacattcatgacttgagttcctccttcctgatatgatctcaaacaaaaccattccatagctgtaaacatctacttttgatgtaacaactgttccactaatccattcaggagccatatatccaatagttcctctcattgttgtcattgcacggctaaattccctccccaaaatctttgccattccaaaatctgcaattttaggcacataagatgcatcgagaagtatattctctggcttgatatcacaatgtatgatgcaatcccgacaactattatgcaagtaagcaagacctcttgcaactccagtagctacttggtacctagtagtccaatccaaaactatatcattagcctcgaacaagcacacatcaagggagcggtttggcatgtattcatacacaagtaacctgttatcaccttcacaacaaaacccaatcagtttaactaagttaatatgctggatgattccaattgaattcacttcagccctgaattgcttctctccttgataggctccatcgagccttttcacggctatggtagagttgcctaggtaccccttaaatacagaaccaaaacttcctccccccaacttctctgaaaaggctttagttgcccgttgcaaattaatatatcgaaatgcaacgaccccaatgccaccctcaggcttttgcaatgtgcgagtaaaccatttcccttttctcctccaaagtatcagtagaaggatcatcaaaaacaaagtggcagtgcttgcaccaatggcaaaaccacttatatttctattcttcttcttttctgaacctggcaactcttttgcagcaaggcgaatgtaaagaactcccccatttctgtctgaagaagcatcagatagttgcttcacgttatacaactcatcatgccaaatggagcagccatctttcccataggaatatgcagtacaggagcagttgctcaagcaaacctgtgagcattcatctccactggttgcagcctgcacattttctgcattgtggggtaacctaatactttgcatagggtagaacttatctgtgaggcttgtcctgtccttgctacttccacaacttaatggagtattcctgatgcaacctcctgtttgatcgtcaagctcccaatccttcggtgatcttacggagaagcccttcatacagtcacagaacagatccttattgtcgtcacagattgtgaaaggtccacaaactgcatacacatcacagtgaactacaggctgcctgtaattcttgaaccattcttggtttccttccaaccacatacccacaaaacctatcccaaagacatctagtccagcgtgcacgatagccgtgtcatcatacaaggtgtatgtgaagtaggcctctttgtcattgtggacaaatgtgaaatttggcatgacatcgcctatcatctctggcgctaggccgaagtatcgaccgttccagtccccactggaccaatacgccacagttgagttccatagcagatgaccctccccattgagccctaactccaaggaaaatataccaggagcctgatcaaccgaacttttcctggaaacaagacggcggttcatgccggtgaccttgtcccagccaatctttgcaccagcgaaaagtgtatctgttgggtagtcgaagctctgccagaaaatgttggatgagtttgaggagcttcgtaggacaaggttgccattgttcagaagcacggcaatggtgtcattggttgtgatgttggcacgggtagaccatatgatggatttggtggcatgatccaggatggccaggtttccatcaccggagattgcgagctccggtgaagtggggtccaccactggattctcgccattggcggtccacaacggggttagcttggagaccttgttgaaccatatgccaaggtaggagttgtggttggtgtaggaggactcattacctggcttgaagaagccgagggcgaacttactgttattggagacaagcctgtcactgccggcaagtgaatggccgggtgacacggtatccgtggcggcggcggagctcgccggagtgtgcagggagaggagcaggaggccaagaaggacatgacaagggagaagcatggggaagcagaagatgaacacgggggaagagtggtggagaaggaaaactgaaggaggaatggtttgaagctagcttatacacagcacgatgctgcaagcaggttgagttgctgttaagaattcagaccatggatttagttcagctcgcagaatcgcaggtcaacgtggtgttgtgactgtctgagcacacatctcaatcagtcgtaaccactaacgatattgtgtttaacctgaaacaaacctcgagaagtatgattggttatcatcagtataatagtaatctttgtcatcttggtcaaacctcaacgctggagcgtttggactcagaaatgatctgtgcccaactattcgagatcaaaattggttgtttattcctctgccagccatacgcaggtgagtaggtgtattctttatgtgaactcttttttcaaacccttgcgaaacactgcaagttccttcccattttcccaacaccaatgcagtgtactctacttgctccaattttgtttttaatggtttcaggtccaaatggaaaagctaggagacagaaaatttaggctagactttgtagtgggcactgatgagatcaattattatattcttatccaaaagcaaatttgtctgattttgatcacaaatttggaccactcgatcatgagttcatgaccaagggatgtaaaatatcaacttcaattagcatcttcgccgacatcagaaaaccctttcacacacggagttgcacagtgcagagcatgggccatggccaacaacaaaacagaagtccaagaaggatgcggaggatttggagaggaggcaagaagaagtgagggagtcaacgcaaacagtcaaaaatgcaagtataggcgtcagaattttttgaaacgagacaagcgtaggaattgactgaatgacgctcagtgtgaggttgcaactgtgctaatgctggaacaccgaaatctgtagtttgtgcaactacctggtataaactatttttttcttttacttgagatcaagttgttttttctttccttccacatgtatgttgattttctttgaaacatctgatttgaaatatgagtgcacatgacaatgtgtttagagtgtttagccatgccttaagtatttccagcctcatcaagttccttacgcaagtgttataattggcagatttgtgtggcgtgatgccaatgctagaacgttttacatatgctctggaacagtgtgaaaatggacagcactgcaacgtggtgtcgcttatcattgactctggtaattgagtttttgctggtcgtctgtacggctacgcatgctgcaagtaaaaatattgttcaacagtgctaaagtgattatctacttcgtaaaaaaacaaacctagacacggatataatattttctggtacaataaacctatctagattcattataatgtcacattcatgtttaagtttgtctcttgtttttttcatggagggagtactctacttcaacagtgatgtcgccttctcaagaattcttgcattgccgattgggcgagtgattgtgtgaactatgaactagtagtatacgtgaatctacgtatattagcaaatcatacttcatccgtacctaaatatttgacgccgttgactttttaaaacatatttgaccgttcatcttatttaaaagcttttgtgaaatatgtaaaactatatgtatatttaataatgaatcaaatgatatcaaaagaattaataattacttaattttttttgaataagatgaacggtcaaacatgtttaaaaaagtcaatgacgtcagatatttagggacggagagtatatcaataggcgatagatttgccgctcaaaataaaaaaagggtaagtctaaaaaaataaataaaagaagggtgtgaaagggagcagaaagctgtggctgggcttgcactgcagcacacagaagcgtgttaaaaaaacggccacagtcaaccaccaaaactatggtggcaggagatcaaaaaaaaaaaaactatggtggcaaacaatgattagcaaattaactattgccttaacaacattaatacattatcatgtcacgtcgtcgcgtaatcatgggtacccaataagtttggcactggcctccaaatctccttgagatctccatgtttagtgagagagagcattttgtcgttgagctgagcacaaatcggcgcactgaatgggcgttgagcgtggttgatgggccttctttacgtgtatttttattgggaataagttcacttctggtcctttatctttcagtgccatgtcagtatcttgtcatctaaaacaacttaggctgtgttgataagagaggaaaagagaagatcgagaactatattaaatttaaaaatagattaatatgatttttaaagcaaattttttggtagttcggaagcgtacacgcggcgaacgagagaaatcttcatcaatcatcatatgccgaacacaaccttaatactgtctttggattatattcgtgctggctttagaagatgagatatgcattataaccggttttgcggttgaccgatacgattgaaactcgactcgcttagataaaggatgtcaagtgaacttcttcctttttattgggctgcaccgctcatcgaaacgggccgtggctgggtttccgattggtccccgctcttgggcctcaccacgcggcaccacgggacggaaggtccatatctctctcgcattatcttcgtcgtctccttgggttgtgtggcggccagccgtcgccgtctcgccgccgcgaccctcgccggcaccggcggcccccgacggagatggagagtaacgggagcggagcctctccgcggctaaggtatgggtctcgtcacccctcttctcagtgcccctgcgagtgtcgctgtcgccgatcgagcgaatcgagagacggatatagcatgtttgggatggctagggttcaacttccggtagaaattaattagcgctctagagagtagagatcacgagatcaggattatggttccacttcggacggcattaaccgcggttgtcgttggccgaagtttataccgtgccccgtgttgtgattagctaacctatctctcaatcctccccactcagctctgtgtatcactcgcacgttctgatttctgaagcgagaatttcagattgctacagtaacctgacgaaactgaagaacagaggaatcggagtttcaatggcgaaaggctagtctgatcaacaccagtagggtctaactcattgcaatacacaccgatagctgggtctcttgagtttttccaagaaataatatgatggtttaggccggtgaccttgttccatccaaactttgccctagggaaatatgtatctgtgggatagtcaaagctccaccgagaaacttctaaagagtttgaagggtttgttaggatgagatttatttccactactcaagtgcgtagcaatggtgttattggtagtgattttagcttgggtagaccaaatgatggtctttgctgactggtttaagacagcaagattaccatcctggagattgttagctccactgctgtgggatcatcaattggcttatccctgtctgcaacctatgcaggacttagcttgggaacctgattgaaccatattcctaagtaccacttgctatttttttagatgcttttctaccagtctcttagaagccaagtgcacacctgccaatttttgagacgagcttgtcggtttcgtcaaatgctttcccaactgagatggtgtctgtcatggtagaactttctgtgatgcgtatacgtaggaagaataatagtaatataaaaatgaggagagctatagttacaaactgtaggattggtgatcatttctcagttctgctttcatttatagtagggaaatgaggacaaaagaaaaactagcaacttgtatataatgatggagagcaaaatggtatatagtcgaaagggtctgtacggtgatgtaagatctttttgaaacatccacggcgtgtatagaaattttaggtgacgaatgacagtggcttgacttgactagaaaatggaaaaaatatcctgccgtggggatagtggtgcaaaggtcctattggccaagacaaaagattcaacttgcacaagctatcatatattgttagtactgatctgaaagaatcttgaacaaatctttggcactattgcaagctacaagtactgtattggctgggtgtgaaaacagtcttatttcttatggcttccaatttccacgaatttacataaatatcagctaaataccatgtacacacacatatctataccactatctagcaaggtttgtaatgaaactcttgtatcttaatacaatgatgtgcacatcttttgcatattctcaacaaaaaggttcttgggttgtagttgccaaattaatgtgcctacccttgaaaaaacaagtttcaggctagcagccaggcttctcccttttgtttgagtgaacaattatgcctcgtatatataggtgatatatagccgatgtgtgcataatttgaacataactgtcaggatgtcacacattcgccaatgttaggctcaacaatccactctgaactgacaattcagtcgcgcctgtgtttttcaaaaacatcatatgacaattgtatgggggcacactgatacctacagatcttacatatcacagagacaacagaaaccaagtatattttgttagtaaggctggttccttctcgggtatagagatcttaattacatgttacgacacttagttcattcaaatacaagacatgatctcttagagatcttacatcttatgcctacttttcttaaagggcaagatgatatataatgttctgatacataacttgaaattgggaatcagtatacagatttatagtgaatcaaaatattgtgttgtcatcgagtgtgatcctcctgtgatagcatttagggtgtgtttgaggagaaggggattgaggagattgggaagatacgcaaaacgaggtgagccattagctcatgattaattgagtattaactattttaaatttcaaaaatggattaatatgattttttaaagcaactttcctatagaaaatttttaaaaaaacacaccgtttaatagtttgtaaagcgtgcgtgcggaaaacgaggtgctttctccctcaatgtcgtccaaacgaacgctgccttagtagtcttggcagtggaggcatgttgagctcaagtagaccttcaagggactgtaccacctcggccattgttggccgatcaaattcgtgatcttgaatgcaccaacatgcaattttgcaagctctttcaacctccatgaggttaacatcaccttccaaattggcatccacaagacatccaatctctcctttgagaagcttgcgtgcaacttgcatgggaaagtagaaggaataatcaccatccatgaaatgttcatgacttcggttcctccttcctgatatgatttcaaacaaaaccatcccgtagctataaacatctactttggatgtaacaactgttccactaatccattcaggagctatgtatccaattgttcctctcattgtagtcatagcacgactaaattctctccccaacatcttcgccattccaaaatctgcaattttaggcatgtaagacacatcaagaagtatattctctggcttgatatcacaatgtatgatgcaatcccgacaactatcatgcaaataggcaaggcctctggcaactccaatggcaatttggtacctagtagtccaatccaaaactatatcattagcctcgaataaacacacatcaagggagcagtttggcatgtattcatacacaagtaacctattatcaccttcacaacaaaacccaatcagtttaactaagttaatatgttgaatgattccaattgaatttacttcagccctgaattgcttctctccttgacgggctccatcaagcattttctctgcgatggtagagtcgtttaggtaccccatgaacacagaaccaaaactgcctccccccaacttatttgaaaagtttttagttgcgcgttgcagatcagtatatcgaaatgcagtgatcccaataccatcctcaggcttttcctgtgtgcaagcaaaccatttccctttactcttccaaactatcagtagaaggatcatcaaaaacaaaacgccaatgctcgcaccaatggcaacaccaattatttttccactcatcttcctttgtgaattttgcaactcttttgcagcaagtcgaatgtaaagaaccccctcatccccatttggagaagcatcagataattgctttacattgtacaactcatcatgccaaatggagcagccaccattcccataggaatatgcagtgcaagagcagttgctcaaacaaacctgtgagcattcttctcgactggtaggagcctgcaaattttctgcattgtgaggcaacctaatgctttgcacagggtagaacttatctgtgagacctgtcctgtccttaccagcaccacaacttaaaggagtattcctcatgcaccctcctgttcgatcatcaagctcccagtccttcggtgatcttatggagtagcctttcatacagtcgcagaacggatccttattgtcattgcagattgtgaaaggtccacaaattgcatacacatcacaattcactacaggctgcctgtaatagataaaccagtcctgcaattcctccaaccatatgcccaccaaacctcttccatatacatctattccagcgtgcatcatcgtcgtctcatcagacaaggtgtatatgaagtaagcctcttggtcattgtggaaaaatgtgaaatttggcatgaaagagcctgtcatctccggcaattggccaaaataatggcctttccagtctccgctggaccaatacgccacggttgagttccatagcaaatgaccatccccattgagtcctaactccaaggagtatataccaggagcctgatcaatcaagttcttcaaatgacatattggccgacatcagggaaccgtttcacacaagttgcacaataatgcagtagtgcatgggccatgaccatcaaaaaagaagtcaagaagaatgtgtggaggattggaggagaggcaagaagtgagggagttagcacaagattcaacaaaaaagggaaagactttttatccttcaagggatgtaccctcatggcttgcatgctattcaaataattgtgaaaaaatatgaaaaaaatgataacatagatcaatgtgtgatatataagttcacaaacatgcaagtttaagttcgacttatacaaactgtgtataattgtcagtagtacatgtactagttagagtttattttgttattttcttttatacttgcataggttttggagtaagatatcatgtattgatctacactgtcaaatatttttataattttttaatgacatgcaatgccatgtaaaagagaagaggacatccctttaggagacaaatatccatcaacgaaaatgaatgcaagtataggtgggatttcaacaagcataggatttaggaaaaaaaaatggtggatattgaatgcaaactagctcgcatgcagcccggcgcatgcaacggaaatagattaaatggaggagccaagtcgctcatcggctttgaagcctctcatcacatgagctcagattgcattgtgatcagattgcatcggcatctctactctgcagccgctgcctctgccgcctctttcatccgctgtccgtgcgacggcaagagagtgttgacagcggctgcgaagtagagatgccgacttgatctgagcttgggagccgatgagtgactcggctccgtcctatttgtgatgtgcctagaattgtgacgataaagacgtccgatcccgtggttgtacatggggcaattaactagggcggggctgtacaggagcctgtttgcatctgctctccactaaaatttgttttccttaatgctcgaatatcaaaatatgtagttttagtagtagcagaatcgcgagatttattgtcacacccagaaattctcgaaccagaatttctaagctgaatgtgcattaaatccctgtccaggaccagccagggtacacaaacgacaattgttgacatacagacccacgtcttacaaaaatataaaagattacaaatgcaacgggaaagataaaagtgagttaaaccgggaagcttgacttcagcagcgggcgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagaggaggtatgatgtaggatataaccaaaggaagctaggggttcttttgcataaagcagacatttcaaaacagtagttgaaagcagtaaaacagctgtagtaattaatcaatattaaccaatcactgtccaacgctacaccacgttgcaacaggcccaaccaaccacctgaactacaccagttcattaagctaaactaggagtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaaggggaaaatcgtgacaagaccctccacataaccctcccctaaccatccacatcacgctaaggtttcacccctaccccctcaaaaggcagtgggcggtcccctcttgcgccacggtgaatccggcagctggacaaccgaacatctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcactcacagcccgccattcagaatattttaattaactgacacccttgcggtggcaccaatctaaagctatgccaatagtgagagtctatgtaataatgtgatccccatttgtgtcctagttgaactaagcatggctaagcatttcctaagccaacatctagtcattttcatacccaagttatcaattgcataaggtaaccaatatgtggctgaggaataggacccatcccacattaaattgtaaaagaatacaacatttaatagaaatgcgggatattggtaaattgggtacaatatgatcaaacgtattgcatgacttgccttgctctcgaactgatgagacctcagcaacgtcttcgagaaaccgcggattgacgaaacggccgaaacctacgcgacaaacaaagcacacaagcaaaacatgctataagactactgaaacaggaaacaaaaccatttttaatggattctttgcatttttcttgatttactgagacttgaatggacttaaatggagctcggatgaattacttatgaattttagaagataaactgtgtttttactaataaagaaaaagtccttaattaattattgcgcaataatacccagggctgacatcatccaaggggggggggcggcgccgacaggcggggcccacgtgtcagcggctcaaaggggagaggaagggggcgccggcatgtgggccccacgggcagtggctaaaggtggccggtctaccgtggaccgggaccacgcgggtggtccaccgccggtccggatcggccgggaggccgatcggacggcacggcggcggctaggcacggctcggctcggcttcaaaaccggccggccggccatggcaaccggcggcgacgcgcacggtttcggcggcggttgccgtcgtggggcgggcggctggaggaaggggacgacctaacaggtgcgtcccggagagaggggaaaggggaatgggctggcccaaaggaaggaggccgagcgcgggagggagtgggccgacggcccaatagagaaaaagaaggaaaagaaaaagaaaaataagaaaggatttttcctgggatttaaaattgcactttggtgatttttaattggttaaaattatttccaaggtctgaaaattccacttaaaatcttgttaatgcattggagcatggggaactcaagaaaaattccaccacgctatttccgattattaattgcatttattaactagggatttagctctaggttaattaagataatttctttgggcaatttatttaaccaatttttaaagcaagaaaaggggggaaacttcagggtgtgacaaacctaccccccttaaacggaatctcgacctcgagattcggaagagctggcgaagaggtgcgggtgggtggcctttaactcatcttctctttcccaagtggcctcttcttctgagtgatgactccactgaaccttgcagaatctgattactttgtttctggtctttctctcgctggtttcgaggatacgagtcggcttctctacatacgtcagatcttcctgaatttcgatgtgatccggacttgcctgttcctcaggaactctcaaacatttctttaactgagagacatggaacacgttgtggatgccaagcatgttggagggaagctcaagctggtaagcaacttcacctctacgttccaagatcctgtatggtcccacaaagcgtggtgccaactttcctttggtttggaagcgatgtactctcctgagcggagtgacacggagatacacataatcccctgtttcgaaagcgagctcccttcggcggttgtctgcatagcttttctgccgagattgcgcgattctcaatctttccctgatagctctgactttctcttctgcctcatttaaaacttctgtaccaaacaactggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattaactcgctcggtctggccatctgtttgtggatggtaagcagtgctgaaattcaaccgggttcccaattcttcttgtaatttctaccagaactttgaagtgaattggcttcctcgatcagacacgatcttcttaggtacaccatgtaaacacataattcttgccagatagagttctactaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctagaatctgaagtggctgtagcaaacctgctggcctttggtgttctgcctttactcgttgacagacgtcacagagtgctacgaattcagctatttcccttctcatgctgacccaccagaacttctctttgaggtcttggtacatcttagtactaccgggatgaatggaatactgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggattacttgcttgagctatgcgaacctgctccaccagtgtgggctgtgcctctagggcaaccacgaatccgtgctcaactataccaaggttcagatgttccaaatcgcgttgaacctcacaacatagttgctctacccatgcaacattgcagtagctcttcctgctcaaggcatctgcaaccacgttagccttgccgggatgataatgtattctcatatcataatccttgatcagctccaaccatcttcgctgtctgagattcaaatcaggttgagtgaagatgtactttagacttttgtgatatgtatatacctcacaacggttaccgatgagatagtgccgccaaatctttaaagcatgaacaactgcggccaattccagatcatgcgtcgggtagttgccttcatgaggacgcaactgccgtgaagcataagagaccactttgccatcctgcatcaacacacatcctagcccctggcgagatgcatcacaatagacctggaaatctttcgtctgatcaggcagaattaagactggtgcagacaccaaccgtcgtttgagttcttcaaaactcctattgcattcagcagaccagataaacttttcttccttcttcaatagctgtcattggcttagcaattttagagaagttctcaatgaaccggcggtaatagcccgcaagtcctaagaaactccgaacctgagtgactgtccttggtggggtccatttggtaactgactccatatttgctggatccacagctactccttgagcattcacgatgtgaccgagaaactgaacttccttaagccagaagtcgcacttgctgaacttggcatatagctggtgctcttttaacttttcaagtaccagccagagatgctgctcatgttcttcctcggacttggagtagataagtatgtcatcgataaaaaccacgacaaacttgtctagaaattccataaacaccttgttcatcaaattcatgaagaagacaggtgcattagtgagtccgaaagacataactgtgcattcgaacaacccgtaccgagtgatgaatgttgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgacgtgctcgggcgaatgtatcccttctgtaactgttcatcgacttgcttcttgacttccgccaactcgttggctcccattctgtaaggcctcttgtggatcggtgcagttccaggtaccaagtcaatccggaactcggtatccctttttggtggcattgttgtcagatcgtccggaaaaacctctggatactctctgactatgggaatatcctccagcttcttagtggttttctccactgctacctcttgttcttcaccagcagcctggtttaaactgatccctggcttctgcggcactggagactggaaggttaccacctctccttttgcattggttaacttgatggtgcggctggcgcaatcaatcactcctctgtgccttgtcaaccaatccattccaagtatgacatccaggtccttggattcgagaagaatgaggttggttggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattgacacaggcctgaacgaacttgggtccagcacatcttggctttgggcactttccaaccgtgtgtccgggtttgttacaattgaagcagagttcgggtttttctcccaacctcttgggctgttctggcagagctagctgaactgattgagctggaatctttagtgaactcggagtagggttgaggctatgctgctcactgttgttgtgactgccactatggtggttctcgttgaagctacccgggtggtagggacggtgctgccggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaaagtcctcataatctttagagatcaactggttagtcaattcatcatcaagaccagacagaaacttctcctgcctcccgtcatcggtacgcacgtcctcaggggcgtagcgcgcgaggcggttgaactcatgcaaatactctataactgttctagttccttgttgcagggaacggaactctctcttcttttgtgccacaattccctcgggaacctgtgctttattgaaactatgacaaaactctatccaagtaacctctgccccagctggacgagtcaccatgtagttgtcccaccaaacagaagcgggaccttgcaactggtgtgtagcaaaagcaaccttctcttgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgctgctgcacctgctgcaacacttgatggtactgttgctgcatctgttgcatcatcattgtcatcatctgagtctgattgtccaacacctgagcaattgttgggttctcgggcggtggggacggactgttgtcagatgcactgttggcacgtgctccattgatcggctcttcgctgccactggcgttgttggagtcgcgtgaaccattccttgtctccatctgaagggaataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgataatgaccgccgactaacccacaagcaacaaacctaaacacgaaaactagcaagcaaacagactaagaaggcgataaagctaagggcggcgactctgaagctcggggcggcgctcgcaaacgagggataggactgacatctaaagtagacaagggataggaactaattaatgctcaaatccaaattaaacaaagcaaaagaagactcaaataaatacccgagcatgatgatttttacgcatagaacaacatttttcacgaaccgagacaaaagacactaatgcaactgactaaacaataacttaatgcatgaaatagatgcatagtcatactgatacgcataaacttaccccaccgaacatagacacgacctaatgcatatcacccgacaattcccgaccgactaccgaataaattccgaataaacttttactaaatccctagactgtccctagtcgagaaatccaattaaataagcgaccaagatttttcccacaaatcaaaagaacaaaccccaaaattttcccgaaacaaaatccaagtgcaaaagggcatatgcatatgaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccagggtacacaaacgacaattattgacatacagaccacgtcttacaaaaatataaaagattacaaatgcagcgggaaagataaaagcgagctaaaccgggaagcttgacttcagcagcgggcgactccactccacaggcaaaccttgacgacagcgacgaaaccaacctctctgagacggctccaactgagaagaacttcaactctggtgtgggggaaaagagagcaagactgagtactacccactgtactcagcaagtcatatcggaagaggaggtatgatgtaggatataaccaaaggaagctaggggttcttttgcataaagcaggcattt

SEQ ID NO: 1303 - DNA, 1114 bp, Oryza sativa
aacgtcttcgagaaaccgcggattgacgaaacggccgaaacctacgcggcaaccaaagcacacaagcaaaacatgctataagactactgaaacaggaaacaaaaccatttttaatggattctttgcatttttcttgatttactgagacttgaatggacttaaatggagctcggatgaattacttatgaattttagaagataaactgtgtttttactaataaagaaaaagtccttaattaattattgcgcaataatacccagggctgacgtcatccagggggggcggcgccgacaggcggggcccacgggtcagcggctcaaaggggagaggaagggggcgccggcatgtgggccccacgggcagtggctcaaggtggccggtctaccgtggaccgggaccacgcgggtggtccaccgccggtccggattggccaggaggccgatcggacggcatggcggcggctaggcacggctcggctcggcttcaaaaccggccggccggccatggcaaccggcggcgacgcgcacggttttggcggcggttgccgtcgtggggcgggcggttggaggaaggggacgacctgacaggtgggccccacctgtcagcgtcccggagagaggggaaaggggaacgggccagcccaaaggaaggaggccgagcgcgggagggagtgggccgacggcccaatagagaaaaagaaggaaaagaaaaagaaaagaagaaaggatttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgaatttattaactagggatttagctctaggttaattaagataatttcttcgggcaatttatttaaccaatttttaaagcaagaaaaggggggaaacttcagggtgtgacaaacctaccccccttaaacggaatctcgacctcgagattcggaagagctggcgaagaggtgcgggtgggtggcctttaactcatcttctctttcccaagtggcctcttcttctgagtgatgactcc

SEQ ID NO: 1304 - DNA, 61208 bp, Oryza sativa
taaaattatttccaaggctctgaaaattccactaaaaatcttgttaatgcattggagcatggggaactcaagaaaaattccaccacgctatttccgattattaattgaatttattaactagggatttagctctaggttaattaagataatttcttcgggcaatttatttaaccaatttttaaagcaagaaaaggggggaaacttcagggtgtgacatttatgcaactacatttaaactttaccccctccgtttaaaattacttgccaccctagctttctctttagtcaaacatttgtatttttatcaccaatttctagacgttcatatattttaacattatgagatttattataagatttatgtttttggatttatcatgagaaatgctttctagtaattattcacatgttattgaattatacaaatttctaaaaattaataaaaaaatgtataaatattttaatttaagataaaactagtaatttgaaaggataaagtaccttttttttacttgaaatcagtggaacgtttggtggtctgttcactgttcttcggtggtctgttctacagtttgttgggctgcaggtctgtactgcatcccaactgttactctgttacagcatctccaacaaactctccaatagtctctccaagttaaaatttagctattttagcaaaaaaattctactccaacagcctctctactagaatggctaagccaaataactggccaaactcctcctctcaatggccaaatttggccagcccaaattgccttgctatttgtgggccccacgttgaagatgcttctctctcacctcctactacttgcaatcggcgcagctagctaccgccggcgacggcttcatggtgctggcttctcccctctcgccgtcgtcatcgccgtagtcttcgtcgtccctcgccgtcgagcggcgacggatgggcacagagcccgagcagcggccgcggatggcggcgatggatggggacggagcctgagctcccggcgacggatggcggcgacggatgggagcggagcccgagcggtggcggcggatggggacggaacccgagcggcggcggcggtggatgaagacggagcccgatggtggcgacggatgggagcggagcccgagcggcggcggtggatggcggcggcggcggcgatggagggggcggagcccgagcgcccggcggcggatgtcagcgacggatgggagcaaaacccgagcggcggcggcggatggcggcaccgcggcagtggatggggatggagcccgagtagcggcggcggcggtggcggtagatggtggcggcggcggcggcggtaggtggcgccggcggcggtagatggcggcagcggatgggggcagaccagcagaggaggcttggggaaagggggagaaagatgaaaagaaggaaatgttgagagactgacgcgtgggtcccactgtaatagacttagaatagagagggtgaatggggaggctgttggagtaaacaacgagtttgacttgctaaattagatggagagttagccaaatagacatttggagagactgttggaggtgctcttaggctgctgtagttgctgctggctagttgatgtaagcgtagcagcaatgttgcagcagctagctctttcgaacatgtcacaagttatttttctttccttccacatgtacgttgattttaaatcattttgatttgaaatatgaaaatttaatgtatcagccatgcctagagtatttccatcttcaccagttccttgcacaaatgttctaattggtagtagattaaatagagtgaaaatggacagcagtacagcacttccgcaggcaggatttggatccagtgcagttaataatatgactacaacttgtatagtccacttctagctgttaaatctgaaattgagtgttaaggatctgtttggtacagctccaattcttaaatataacttcaggagttgagtcttgagtggcgttgtggagctgcctaaatccagctccacaactctagtacattttgtgagagagctccatccaactccactcccagttttggtggagctgaaactgtttggctgagctccagctccaggaggagtggagttagagttggagttgaaggatgcatctggttactgtagatcactacggaaagaatcgatgagtactaaatacatcgatattgtagctaacgatctgatccgttcattaaaaaaaaacggatggctgccattatgcaggtgatcccaaccccagcaaacaggtgatgacgcttatcattgactctgtttgttgcgttgcttctggtcgtctgtacggctacgcgtgctgcaactaaaaacaatgttcaatgctaaaatgattatccagtccacttctcaacttttccggtgccttttctagagattgtgctcggtcaccttctctcggtatcgcttcatgctctcttcgtaacaaaataaatcaatcttgtgttaggatatgaattgtgttatatcctattacgaggttgacttattttagaataaagggagtagtttgctagttggtttatccgtgaatttaaattttgaaacttaattttaaattcgattttaagaaagaagcaattcgtaatacttttttctaggcattagattttatatcggggtggtgtcgatgacaagaagtgaatgatcacctgtttcttttcttagaaaaaatgcaaaaccgcagtgaaaataatactctatccgttcatatctagcgtttaaatgttcgtcttatttgaaatttttttatgattagtatttttgttgttattagatcataaaacttgaatagcactttatgtgcgactatttcttttttaaaaattttttttataaaattttcaaataagacgaacggtcaaacgtggacacggattctcatgactgcacttattttggacggaggtagtaataaagttattctaatatcactaaaacactaaattagtcaccctaatatgcaaaaagcctcaaaacagtactacagtagcgcagctacagtacgtgggaagccaacggagaaaaacagcaaagcttcctcggactgaacgtcggcaattcaaatccatataatagaaatcttgaagaataagcctggtttattttttttttgtcaagagacataaaagcaatggataaaattgaggggatctaacaaactttaatctgaacgaaaacatatgtttactgaaacctagattaattgaaagtaaccgatagaactatgacaaactttgcttgtagaaaccagacttcactatagagctaacaaaaattccacactaaggtctggtttagctcctaactttttcttcaaattttcaactttttcatcacatcaaaactttcctacacacacaaactttcaacttttccgtcgcatcattccaatttcaattaaacttccaattttggtgtgaagtaaacacaccctaaaatctaacggttagatcaaattctagaagaagaatgaagttagagaaaagcttgtcaaaacttgccccacacgaaaaccgaattgaaaagggggattacgaataaattagctcaaatttattgatcaattcatacaactaatctaccttatttatatttctaaggtaaagagaagaatagttcagaaggacactatataagcatagagtgatggtggtgtttgaatctactgaagatgaagatgaagatgaagtgtttcacgtaacacgaggtggtaataacgtgtgattaattgagttttaattattacaaacttgaaaatggattaatctgatattttagaacaactttcatatagaaagttttcgcataaaatgcaccgtttagtagtttgaaaagcatgccactttaatctaaaatttaatcctaacttttcaggagtaaggaacaaacagactcatccaaaaatgattcagaacaaacagtcggtacttgattcagaagatttgtacacacaccactatataaaatcttgggtacaaactcaactcacacgtaagatatactccctccgtcccaaaataagtgcagttttacactatttacgttcaacgtttgaccgttcgtcttatttaaaaattttttatgattagtatttttatttctattagatgataaaacatgaatagtactttatgtgtgactaaatattttcaaatttttcaaataagacggacggtcaaacgttcggcacggatattcatggctgcacttattttgggatggaggtaggatataaaagataaattcagcatagaatagtaacgcgttgttcacatttgaatttttcttattttagttccttaatgtgtaggtcaaaattgaattcgatttctggcagaacaatacatgtcaatataccctacattgttttttttagaatttttcataattatttgtattggatttatctctactacttaaaaaataagagatgcttccatcgtccgtcaaaaaaccggcaaaaaaaaaagggcgagcgagaaaaaaaccaggcgaaaaaaccgtaattgtccgataaaaaaagggcaaaaaaattccgattccctgcaaaaaagggcgaaaagaaaccggcgaaaaaactagacgagcgataaaaaaaccgtaaccgtccgataaaaaaaaagcgaaaaaataatccgattccgtacgtgccaaaaaaaaggacgaaaaaaatcttgaaaaaaatagcgaaaaaataataataaaaaagtccgactcctatccggttctctctcaaaaacgaaaaaaatccgactatagatccgattcccccgaaaaataaaaggcgccagtccttttgagtccgagatacccgccacccctcctctcagtttcaatctgtaccgtgttatctctcaaatcttggtgaaataaaataatgtgccggattgaagatctgtttacaaaaacgaaacctacatgtcgagagcattccatttttatattattttattttttgggtttgtacttttgtatttgagtccctgtaatttttatatttacatttgagtccctataatcttacaacaagatacttgtggtcgtttttggtaaaaataataaaaagagagagaacaaaagcagaaaggtgcataaaaagaaaaacaacaacaacaaaagttctatttcccgtaagtcctgtattggaaaaaagcaaaaaaagaacatttgaagaaaaaacaagaaaaaaaatgcgtgagaaaataattgtaaaaaaagacaaaagaacacactagaaaaaaaaggcacaaaagagagaaaaatatggttttcattgtaagtaaaaaagcaaaagaaaaatgataaaaaaacttttagaaagaaatgtgccatttctgaatggtttgagaaaatcgcgcaagaaaaaaaacaccatttataaaaaaacaagccgctcattaaaatacaaacattgtcattgacatgattattcatgaaaaacgtatattatcattagaattttttcacccgttgcaacgcacgggcacttttgctagtaaggaaaaaaaaggcattcttctctgtttcttcttctcgtcgtcctctcgtcatgtgattatttgagctgagagagagggggactaggcgaaaaaacaagaggattaaagttaattcatttagaggttatggatgaactgatagggataggatgaagattataagtacacgccacatcggatgaaaactatgtcaatgtatcacataagagcacccgcaatggtaaggtgctatctataaaatatgtacacctcaacaatagactagattaatagtaaaccacttcaatggtatgtctacatgggtatctatagctctctaatccattgcctcgtttttctctatagactatcttcatgttagtagatagctttgctctctctcttcatttaatctcttccaagtaggaaaatatgctgacatggatctcttgtagagagcttatagataaccattgtgggtgccctaagatggaatcgacacccaaatcattgaggggctcgtgttgatttacactggtttttatagcttgggggacaatgtgtatcccggtttcgcggttgagggacgcggatgaaactcggacccatagctaagggacgtaatgtggactttttttgtgggcgaattcgcgcagaaaagctcgctcgcatgggggtgatgggccggcctgtgctggtggcctagaatctctctgactctcctctctctcttcgcctccttgtcggcggccagccgccgccgccgacctcgccggtcgccgccaccggcgccgccggcggagacgccgagaaatgggacggagcctctccgtggcaaggtatgggttttcttcgtcgcccctacatacactggtatctgttcctctacgatttggggatcctttcgcaggtgcccccgcgagcgtcgccaaagcgagacgaattgtttgatcctcgtttcgcttggaatggactagggttccggtagaaattggcgcgcgcttgaggagacaaaggttaatggggatttagagttcatctctcacttagcagtttgtacatttcaattttcaagtctacagttacataacgttgatgcaagtattttttggctgatcagagttacgacgaaattagattattttggggggtgatatgttccaaataccgaagactgattctgattgccgctgctgtttgttggaggaccagaagacatctcacaaatatttttggggttggcatataatacattattatgcagtctcgtgaggtcttaatctccatttcacaagaagaatcctgtaaatgatgcacagctgttatctcgtctcataaggtatatttaaagtgctatcctcttccattgttgctaaatgtacagtttggtgctattgacataacatggctaacatcaaattgagctattgatcgatcccttcttgttcaagcagtgtgtcttggttcagtaaaaaaccaagtgtggctggggagatttcagttgtttgaggatgaccttactcatgatatattccaggtacaaggttgacaaattcttactgggaacaacacaattagacagcagtttataccggcaagcttgttctaaataatctttgtaccggcgagaaatttacttatcaggtgctcaaagctgtgccacagattagcagaggactttggtttctgcaggagacttggattatcaaatcatcactgcttttattttgacagattagactccaggcaactactgaagggaagccccaggattacatcagagctactttcgtgtcaagaatgaggtgcacggtgctctattgtatcttacagttggcctgcctcttctgaagcttggttcaggtacccatcaactacctgcacatataacaaaaaaaaaagatgcagttaggagtgctggcatggaatgttgatgtgtcatattcttttatgatattatacaaaatgatgtcatggaaaaatatcatgctcttatcatgcctctcagccgcacatatatttctgggattatgataagttctcaatttaagatgtttgtataagaaaaattctgcttagtgctcactttgaatatgggttgcctgcaatagcttgaagtagtcgtggcactgggggtatgccaacttcaagaagaccttcgagatattgaacaacttcactcattgtaggtcgatcaagctcattatcttgaatacaccagcatgcaaccctgaaagctctttctacctgctccaaatcaacatcgccatgtaaattttggtccaccaaactcccagcattaccatccagcagcttatgtgccactaacagagggaaatattcatagtcatcacgagttgcaaattctttgcttgagttcctcgttcctgagatgatttccagcaaaaccattccatagctgtagacatcaacctttgatgtaataactgtaccactaatccactcaggtgcaagataccctatagttcctcgcattgtagtgagaacttgagtaaactcccttcccagaaactttgccatcccaaaatctgcgatttttggaacaaatgatgcatcaagaagtatgttctctggtttaatgtcacagtgtataatgcaatcctggcaactatcatgaaggtaagctagtcctctagcaactccaagagcaatttgataccttatgctccatttcaagactgtagcgtcattgtgaaataaatgggtatcaagagagaggtttggcatgtgttcatagacaagcaatcttctatcaccctcacaacagaaaccaattagtttaactaaattgatgtgttggatgattccaattgatcctacttcagctctgaattgcttctctccttgacgagcaccatcaagcctttttactgctatgacagtagactcattaagaagccctttgaatactgagccaaaaccacctgcccctagcttatctgaaaagttttttgttgcatgttgcagatcagcatatctaaatgcaataactccactaccactatgaaaattctttcttctgtgaccaagcagccaactcttgttccttgggatcttcgctatcaagaagagtgccaaagcaaaggaagcaacacttgcagtgatggcaacgccaatgaatattgatcgtccactgctttttatactttgcacctctttggcagcaaggcgaaggtaaagaattgctccatcagtattagcaatatcaccacattgtagctgtttcacattaatcaattcatcattccaaacagagcatccagtattaccatagtaatatgctgtgcaagtgcagttgctcaggcaaatttgtgcacatccacctgcacttgtaacatcttctatgatttggccattactgggtaatccaacacacggcatagggtggaacctgtcttgcatactggtgtttctgtttataccacagtctaatggagtatttctcacacagccgcctgttcgatcatctagctcccagtcattgggtgatcgtacagagaagcccttcatacacttgcagataggaagcttgctctcttcgcagactgtgaaagctccacaaatgccatacacatcacactgctttgggttggtgtaggttggtacccaatcttgcacatgctccacccacaaaaatatcttggtctgaccagagatgtccagcataaaacgcatgatcgttgcgttatctagtaaggtatatgtgaagtacacttcttcatcattgttgacaaaagtaaaatcaattaagcgttgacctgtcatctctggtatggaaccaaagtaatgtccgttccattctccactagaccaatatggtatagaggagttgagagctgcaaggatgaacctggtagaaccattgttgtcagttaactcgtaactgtacatgccagaagctgggtctacagagtttttcctggaaacaagacggcggtttaagccagtgaccttgttccggcctagcttcgcaccggcgagatgggtatttgttgggtagtcaaagctttgccacaagacaaccgaagaatttgaggtgttctgcaggacaaggttgccattatccaatagcttgaccattgttgtgtttgctgtgatgtcagcttgggttgaccagaagatggactttgtggcctgatctaagatgacaaggtttccgtcaccggagattgtggcctccggcgaagtggggccagtgacaggctcatctccattggcaacccatgctggagtgagctttggcacctggttgaaccatatccccaggtaccagtttgaagcattgtgggaggacttactgctggttgggaagaagccaagcgcaaacttgccgttgctggagacaagtatgtcattgccggcgagtgtctccccagctgagatggtgtctgtcaccttgcaggatgcaggaatgtgcagtgtgaagaggaggaacaggacagtgatgggaagagccatggtgaacaaatcaagaactagctagcacagctgcaaaggtacttgggtgaggtagatgacagaggatgccttggctgtgtacatccagtttggatgtagaggccgggtttaatcaattttatctaaaaaaaaaggatgacagaggatgccaactgcggcttgcgcgtgtggatacgagagaacacactgcaagagggaaagtgagtaagcttgcatggtcgttgggacttggcagatggtaacatatttgaaggcagaaagaaggatggagtcattggcctgacctagcatatatggcagtaaaaaaattacatcatgatacagacatataaccgactcttagggctttgtgaccaattagtcggctggcgaattaaagaatccgaaagtacggctgatttctgtcaaatggtcaatcgaccgggttgtaatttggactcagttgttggtaaatgatacttcctccgtttcatattataagactttctagcattgtccacattcatatagatgttaatgaatctagatatatatgtatgtgtatagattcattcataaatgaaacggagggagtacttcaatagtggcataaatgactttctgaaaaccagaaatttgtagcgctagtgatgaatgatccaaatttatgtttagcatctgtatcggccggcgaattaaagaatctcaaggtatgggtgatttctgtcaatgatcgatcgggttgaatttggatcaagttgttggtaaatggtagtaatttgactgtggcacaaatgacatctgaaagctcgcaaattgtaccgtagtggcgaatgatccaagtctgtgctcaacatctgtttgttttcaactttggaaactaaaattaatcatgtcttcctggacttctatatcatttgagatgtttattaatatcttatcatttccgatgttttggactgtggagctcagagataacctggtcaaatagctggagacaaagttggcgtccagtggcactgtggcagtgatatccggagagaaatcgtcgtctgtttaacctttaaaatataatcatgattagcatggccattaaacaaatgttccttgtgaaattggcacataataattcgatcattcaccggaaggccagaaccaaacgcgacagcgttgctgtctgaccgatctcgacgatcttggacaggctctttgatatacaggtttatgacttctgaacaaatggatagcgagaggcgtggcaaagccagctgaaagcctgaaatggtggttgctactagctgtaagttgtaacagcctgctaagcgcacaaagtcgttggcaaattcagaattgctacaccatatcacttgttgactggcgatacagatttcagccactttaagagctgaatgaatgaggatgcataagagcaaggtcaatagtatagccactactgtctcccaaacatctataatcaatctaatagttcattcatacaatagttaactataaaaatatattacaccattaatacctggtcccacctctcatacacacataatatcttagagtccgtgttgcagccggctacaaatctgtagcctgatttcttctctctcttcttttttcttctcgatatatggttatagccggcttatagcctgctattgtacctgctccaaggagtccccagtacatcgtctggtcaataaaatcaaggaagtggcaaaaacattaaacatgggctttcagcaggggcaaagcgtttgcttgagctacaatcggcatttgtatagctatagttacctttttttttcagcccctaggggatgcaaacctttcttccttctatattaattgaaacgggcatcgtctcgtgccggtttgttaaaaaagagagagagagagaaagaacaaaatgatgaactaacagtcgatctggctttcaaacttgttcagagtaaaagtgatgaatcgaccatccgggccaacacaagctttatctcagacgccgtcgaccagcgatcagtaaactcacgaataaagccattcatgtgtgactgttattctgaagactgaagagatcagaaattgcacatggagttaatttttgggacatttaattatttgccacttttaagatgtgtcaattaagaatttgccactcgttatctatgacatgtgggccttcatgtgtctatgacatgtgggccttcatgtgtctatgacatgtgggtccagtggtaaatcttttagaaccactcgtaagagtggcaaatagttaattattccttaattttcaggtgaacattgtgctagttttgtactttgctgaatcctgaacgacagatagcaagactgtaaaaaaattactatgttaacaagacaacttaaaaagaagaaagatgtcaggaattacaaagttccttttaatttacaaggattctcgaacttaaatatttgctggaagagaatacagggagcatgttgaatttgagcttccagctattgcttgaagtcgccttggcattggaggcatgtcgacttcaactaggccctcgagaatttgaaccactcctcccattgttggtcgactaaactcatcgtcttgaatgcaccaacatgcaaccttgaaagccttttcaacttccttcttgtcgatgccaccatgtaatttgtaatcaaccaaaccacccatatctccgtcaagaagcttacacgccacaagcaccgggaaataaacgtcatggtcaccaccacaaggacatgaggcatatgagttcctctttcctgatattatttctagcaacaccatcccatagctgtaaacatcgacttttgttgtaataggaacaccactaatccattcaggtgcaaggtaacccgcagttcctctcgttgtagttaaaactcggctaaaatcccttcccaaaagctttgccatcccaaaatctgcaatttttggactgaatgaatgatcgagaaggatgttctctggtttaatatcacagtgtatgatacagtcttgacaattttcatgtaagtaggccaatcctctagcaattccgatggctatttcatacctaatattccaggtaagtgtagtattagtctgaaatagttggtgatcaagagaacgatttggcatgtgttcataaacaagcaacctcctgccaccctcacaacagaaaccaattagtttaactaaattgatgtgttggatgattccaattgagctcacttcggccctaaattgcttctctccttggcatgcatggtcaagccttttcactgctacaattgtgtaatcacttagaaaccctttgaatacggaaccaaagctacctcccccaagcttctctgtgaaattgttagttgcacgttgcaaatcaatgtatccaaatggaatgatcccattgcagaactgataatccttccttgtgccacctgatagctttgttttattcctccatttcacgagtagtaggataactagcagcaaaccaaataaagcaaaacatgcagaaagaacaccaataaccattcctcttttatttacctcttgactatacaattcttgtgcagcaagacgaatgtgaaaggtttctccatctgtattgctactgccagtacattgattttttcttatgttaagcaattcattgtgccaaacagagcatccaccattgctgaaggagtaagcagtgcaggagcaattattcaagcaaacttgtgcacactcacttgaactgtcaacacttcctacattctgggcgtttgggggcaatctaacacaaggcatagaatagaacttatctgatgagcgggttatggttttgttgctgatgcagtctattggagtatttcttgagcatccacctgttcgatcttccagtacccaatcctcgagcgatgttatggtgaagccctttatacaattgcaatttggaagctcgttatcggtgcaaactgtgaaaggcccacaaattgaatagacatcacattgagctttaggttgggcattgaccattacccaatcttttgatccctcaagccaaagaaacgtctttgattgacctccgacatccaatatttgacggctaacaatattttcatttgccaaattatatgtaaagtacttctcttggtcattgttcacaaatgatggaatgaaaaaattatggcttgccatctttgggattgaggataagtactcgccattccatgctccactagaccaatatggcgtggaggaattcactagtgcaagaaagacctgattaacaccagtagggtctaactcttcgcaatacataccagtagctgggtctactaagtttttcttagaaataatacgacggtttaggccagtgatcttgttccatccaagctttgccccggggaaaaatgtatctgtggggtagtcaaagctctcctagaaaacttctgaagagtttgaggggtttgttaggatgagatttccactactcaagagaataacgatggtgttatttgttgtgatgttagctcgggtagaccaaaggatggcattagttgagcggtttaagatggcgagatttccatcacgaaagatcgttagctccaataatgtgggatcatcaattggcttatccctatttgcaacccatgcaggagttagcgtgggaacctgattgaaccatattcctaagtaccacttgttagtttttccagacgcttttgtatctgtcttgaagaagccaaatgcatacctgccatttttcgagacgagcttgtcatctttggccaacgtttggccagctgagatggtgtccgtcgtggcagaacttgctgggatgcatagggagaacaatagtactatgaaaatgaggagagacatagtgaaactgtaggataggtgatcactgctcttcacttcttcttgcattttatagtaggttaatgaggcccataggggataataagttaacaaaggatacgcttgcataatgttggagggcaaaatggtaacagtgataacatatctggacagtgatgtaataagatcttttgttatgctttgcaaaatatccacggcatggagactttgtgtggaattacagtggctttgactgggaaaatgaccctgggtatagtgatgcaaagatcctgatggtccagacaaaaagaaaaaaaatcaacaagtttaagttaccacagaatcttgaactgaacttcagcgttattgcgagctagcagtgctgtagcggcaacggcacgaacgagaacctggtgtgtcatgctctgtttggttcatgggactaattcattagtcccttttagtccctaagaatttaaacagatgtgacaaaaaaaaaagactaaaagtgtatattgggactataattcattagtttctcttggaggtacttataagaactaaagtgatagcctctctcttctctgtctcggtccacatgtctttagttcctgtatctaaacagtaggggactaaagtttttagtctagagactaattttagtctagggactgaatgatccattcagggccttagaacttaaaacagtcagtctcatgttgcttccagtttccaggtcccattaattcctggtcataaaatggtgcagggctggcgtattaattggtggtgcatcgtgtggattggctgcctgatcagtgacactgatggacagatgactattggaggcgttttggttggagagtggaaatgcaaagggtaacggaatttggaagtgatttgaatggagggaatccgatcgaacaaaaccctgactttgtttggtcctcaggtgcaatgcagcgttggaaaccatttcctttctgtttggaacgatcgatcacatgtaacttgagtccagtaagtagtgaatacttagcatccaagcttttgatgcgaattttgggcacaaccatcgaccgttaggccactggtcagacatccatcatctatgataaagtacgcgattataatttaacataacctaagataatagtctgactttactattatctagagatgttaacgagacgagctcgagcgagctcacctacctaggctcgagctaagcctgtgtaacctttaagcttccagacgaactcggttcgagctcgaccatcaagcttagttaacatatattttaagaatataatctctaaataaaagtaattaatttctatttagttatatttgtgaatagaagaaaaagaataaagataaatatatgatattaatataaactattttatcgtgtggatacatataaatggcagcatatttgatctattagtatataaagtaaataataaaaattatatattattaggcttgacaggagcccaagctcggctagtctagagctcgaatcaagcttaaattgagcctaggacaagtcgaactcaaaattttgtttttatagccttactattttattaacacctattacaaatccaagtcctaatttataatcgactacttagatatattcgacacaaactctaaaagcattatgtaacagggggtgtcatgctattactgaactgaaaattaaactcaacggtctctgaaatatacagagagacaaaactcattataactttgtacataaagtatatatgttttaaatctgcaaatgcaattgagtttgattttaaattatttgcagggtataaaacttacattgcatcctctaactcctcctcctccctcttcttcttcttcttaagaattccccctcaatccccttcaaaccaagcaaagccttcaaaattttaattacaccaaactctaaaatttctgcattttacaaaacacgcaattcgaacaaaaaaatctctaataaggaaaaaaaacagctaaacgatattaaaagatgatatgattaacagtttcaggtttatgataaagtttagaagcttaattatgtccctccctttcagtttatttttaaccagttgagccgcacaagggattctgcccattattgttaggtacaaagaattgtttaatcttcatgggaattctactcaaccaaatcagattcatttcagagccaattacacctcctaaggtaatctgcctgtgcagggatcattgttaattgtatagatcttttttattccccagagttgtccatatcaccttacactctccccatcatgccttacatctagcaactctatcaaatcatttttgtcagcctcacttgggttcctcctaaactctaacttccactcaccaatcgccatcattaaaaagctccttacattgtgtccaagctggattctatataagttcggactatttactcttggggatattttatcagcccatacatctgtcagaaatctacagtgttccatttatacacttttctttcatcatatcttaaggacaatatctagcaaacaaatggtccgtattgttcaatcacacatattttatcatgcagattaaagatataattcctataattccatagttaagtcttttcacctctagctctccttcataaagctcatctagcatctccttcactacctcctttatgtgtgcccacatcttcctataaaaacctataggaaagccaactgggctccttaaaagctcttccatacaaaaagttatagttaaaatccaactatatcctcatcagacattcttaacctctcatcccacacttcttgctgttagtggatattgttcatgacctcttttaaaaagagtatcttggagtcatcataaattgttcatttgtgcctatgatatctggtattgtaccatcccccaattgtagagaaaacaaatgcaactcttttcgaatgatattgtcactcattcttggaatttctttagaaaaataaagtataactttcagcctctgcaccaattaatgatgcacacaactatatttgtgggcactaggatttgaatcctaatggggtccgaagtcatgcatccatgactatatcactacgccaatggtgcttcccttattcttacgacactatggagaaatttaatataaaaaggtgcaaggagaaggaatatattattacttcctagcatcattagcaaaaccgcaaaacgatgagatttagaattaagactagggttcaaacgtggccacaagggcgcaacgtaatgaccttgccattgatctcactattgcatgaatcatggagcagatcctgatcagatgtttgttagatctgcccacccaaatttctactaaataatggatagcaaaatggtagaatatatcaaaagtaggtgataaacaactcaattgagagagagagagagagacaaggaagatggtaggaattccaaatccccttgtagtcctagaacaatataatagttgcaaacaatatgtctgtcactcaatacatatatttgtatcaaaaggaactatacgtatttaaagggattcttgagctgaaatatttcatacaaaagaagctaaggaacatgtcagatttgagcttccagcagcaattgcttcaaggagccttggcattgggggcatgttgatttcaactagaccctcgagaatctgaaccacacctcccattgttggtcgattaaactcattgtcttgaatgcaccaacacgctaccttgcaagctatttcagcctcctttatgtcgatctcaccatctaatctataatcaaccaaaccacccatatctccatcaagaagcttacgggctacaagcaccggaaaataaacatcatgatcaccgccacaagaacatgaggtacgtgagttcctccttcctgatattatttctagcaagaccatcccatagctgtaaacatcaacttttagtgtaataggaacaccactaatccatttaggtgcaaggtaacctgcggtgcctctcaccatagtcaaaactcggctaaaatcccttcccaaaagctttgccatcccaaaatctgcaatttttggaatgaatgaagcatcgagaaggatgttttctagtttaatatcacaatgtatgatacaatcttggcagttttcatgtaaataggctagtcctctagcaattccaatggctatttggtacctaatgttccaagttattgtagttttgctctgaaataattggagatcaagagaacgatttggcatgtgctcataaacaagcaacctcgtgccagcctcacaacagaaaccgattagtttaactagattgatgtgttggatgattccaattgagctcacttcggacctaaattgcttctctccttggcatgcatggtcaagccttttcactgctatagttgtggaatcacttagagaccccttgaatacaaaaccaaagttacctcccccgagcttctctgagaaatttttagttgcgcgttgcaaattaatgtatccaaatgcaataatcccattgcaaaactgagaatctttcaaagtgtcaccaaagaactttgttttactcctccgtctcagcaataacaggatcagtggtagcaaacctaataaagcaaaacttgcagaaataaccactccaataaccattactcttttattggcttttttactatacaattcttctgcggcaagacgtatgtgaagggcttctccatctgtattgctactgtcactacattgactttttcttatgttaagtaattcgttgtgccaaatagagcatccaccattgctgaaggaataagcagtgcaagagcaattattcaagcaaacctggtcacactcacttgaacttttaacattttctatgttctgttcgttttggggcagtttaacgcatgtcatagaatagaacttatctgaagaatgagttgtgtttttattgttagtgcagtctatcggagtatttcttgagcatccacccgttcgatcttctagttcccaatcctcatgtgatgttattgtgaagccctttatacaattgcaatttggaagctcgttgtcgatgcaaattgtgtaaggcccacaaactgcatagacatcacattgagatttaggttgggcatagttcattacccaatcttgcaaatcctcataccaaaggaacgtcttggcttgacctccaacgtccactatatgacgactaacagtcctttcatctaccaaagtatatgtaaagtacctctcttggtcattgtgaacaaatgttgaattaaaaacagtatggcttgccatctctgggaccgcagcaaagtaatccccattccatgggccactagaccaatacggtgtgaaggaattcaatggtgtaagcaaggactgatcaacaccactagggtctaactctttacaatatacaccagcagctaggtcctttgagttcttccatgagataatacgacggtttaggccggtaaccttgtcccatccaagcttggccctgggaaaaagtgtatcagtggggtagtcaaagctctgccataaaacttctgaagagtttgaggggtttgttaggatgagatttccactactcaagagcatagcactggtgttattgttagtgatattagcttggctagaccaaatgatggtcttggctgaccgatttaagatgacaagatttccatcatggaagattgttagctctaatgaggtgggatcattgattggattatccctatttgcaacccaagcaggagttatcttcggaacctgattgaaccaaattcctaagtaccacttgctacttttctgggatacttctactctttctgtctcaaagaagccaagtgcatacctgccatttttcgagacgagcttgtcctttctacccaatgcgttgcccattgagatggtgtccgtcatggcagcatttgctgagatgcatagggagaacaggagcactacataaatgaggagagccatgatgagggccaactgtagtatatgtgatcactggtcagttctgatttcatttatagtagggaactgaggcatatatagagaagtagaaacatatatagtaatccctccgtttcaggttataagacattttgactttggtcaaagtcaaactactctaagtttgactaattttgtagaaaaaatagtaatatttttaacctaagacaatatattatgaaaatttgttcaattatagatttaatgaaactttgctggtgttgtaaaatattactattttgtctacaaagttagtcaaatttagagttgtttgattttgaccaaagttaaaacgtcttataacctgaaacggagggaatgcttatgtaatattggagggaaaaatggcacagttgatacatgtctcgttggtgatgcaagatcttttgttatgaattgcgaaacatccacggcatggcaaccatgtgtgacgaatgacaatcgtacctacaatacttttttcagctagatttcgatggcgcagcaatgcaaacaaccatctagagacggccacatcagagaggcaccgcctgttcttttcttctaaatggctgaatggatgaattaatagatgacaaccataccttacatgagcctgtcagttttcctctaaaaagatattatggctgtgtttagttcacgtcaaaattaaaagtttggttaaaattggaacgatgtgatggaaaagttataagtttatgtgtgtaagaaagtttcgatgtgatagaaaagttagaagtttgaagaaaaactttgaaactaaacacggcctataatggaagatacaccacagtcagaccattcacacacacacccatgagtgcacacctatacgaacgccaataaattatctgagaaagtagagacctcccgtattacgggaaatgtactcattttgtacgggcacatgtactcatacccactgaaattttacatgcatgaatttctaaaattgatggacaatgaccttaaaccatggcgggctgcagcggtgattattgagccaaagtctttatacaagaaagtgatggctttttcttatactccctacgtattttaatgtatgacgttattgacttcttaccaatgtttgaccattcgttttattcaaaatttttgtgaaaatataaagatatttatgtcatgcttaaaggatatttgatgatgaatcaagtcataataaaataaatgataattgcataaattttttgaataagacgaatggttaaacgttggacaaaaaatcaacggtgtcatacattaaaatatggaggtagtataaagataatatatatcaatccggtctctacatcccttatggatgtacaaatccaaaagtgatggctatttgacaccgatcttaagtaaatattcagcaaacacgtacctattgtttgaatctctgcctctggtaagtcgtgtaaagtaaagtacccattcgactagtcagttttgaagcttccaacttgttagtagttgttaacaggtgactcggtagtttttagtgatgtgtaacaatattgagtggccaaaatgcagtagactagttctgagcatgtcgactagcaaggagcacgatctgtgagacatgccagtatcagtatgccactgatgcgtatcagcgtatgatgacctctccaaggatgggaggatgccaattaatttgctcaaagggttaactcaaaagtgccaatttacatgaagcacttcatatgaattttgcatatgaatgttaacattagggttaacatgtagtctttttatcttcctataaaaagtatggagttaaataaagagtaaagtgcatttgcggtccttaaacttgtagtgttgtatcatataggtccataaactctcaaaatgtatatcaaggtgccagaacttgtcaaagtgtatcatctaagtcccaaatcgacacatcccctctatgatctatgtggcgctgatgtggcatgccacatgggcgtgacatgtccttttcttttttttcttcttttctttttttttctttttcgttttcttctcattcttctttttttcctttcttctgctcaggtcacagagaaaggagaagaaagggaaaaaaagagaagaaaaaaagaaaaaggaaaaattttaaatgggtcatatttgtcagtccaaaataatgccatgtcatgtctgtgtggtatgccacatcaacgccacgtaggatcctaaggggttttggtgatttgagacctagatgacacagtatgacaagttctgagacttggatgtgcattttgagagtttagggacaaagatgacacatccctacaagtttaaggaccgtccgtacactttactcttaaataaagcatggtggttacaagtgcctcagtagcacctgaggtcctgggttcgactccacatgggagcgaattttgcaggatttaacggctttgtgctttcagtggtaggcgacgtacccgtcgacagcgaggcgcatgtggtgacttcgtcaatctcaaaagatttgccggcccagtcttcgaagatgctcatcggggtgagtgcgcgtgcgttgtgaatgtctgcgttgtaccgtgtaattatcgaaaaaaaatagtgagagtagttgacaatctagcccacatcattcttttctctcttttttttaaaaaaaaatgttggtggtgtgaggtggtggaagatttattactcaccggtcaccgctaccaatactatactctttaaaagaagtatatattgtaacactaccctatattcatctgtgccatcaaaacgtgttgggcctcttggttttcttttcttgttttgagattacacgggagagtcatacgcacacacgaatacgccccataacacatgctaaaccagcgagacacatccatgatctcactaaaattatgataaaaacccacctacatatgcgtaatattcgtacgtatcagggtttgaattttaccactacatgactgatgattctcccttattacatcttgttttggccccaactagttccttttttgtctgcaaaaggacatgtttctgttattcatttgttcatccatgggccacctcgcccagtcagcttgtgatccttgcgatgtaatgcagatgctaaaatttgacgatgaggatggaggtttttttttttttttttgccccctgttttgttgtgacggcggttgagcgggccatttgatccactcgtgtgcacgcgcgccgtaaggcctcgtggccccggaacttccccattgcttcggtgtacttcgaccagccgatcgacgcacccggcggccacatcgtcgatggcggcgtgctggaaatcggcgcgcggaggcggagggggaacctcgtcgcgggtgtggtggccggcttgtcgcgcggcggcgcggccgtagcgctcgtccgttagcctgttagagcggctacaatagtatactattagccagctataaatataatttaatgagataaaagataagagagaagagaagcgggctatagatctgtagccagctgcagcgcggactccaagacacggtgtgtgtatgtcaggtgggaccatatgtattaatagtatagtaagcaactattgtataaatttgttatttgattggagtattaaacttattaagcttgctcttaagctaggccgcgcacgatccaatctcgcacgcaccattgtcctggaggattctggagcacgtacgatccaatctcccatcgcagccaactccctcagtatttacatctatggtattgttgattaattttctatcaatccattttgaacttcaatatatataatatttttaagtttgaaaaacataaaaatcaatataacaagtacttttacgtaaagtaagtttttgttaggtattattgctatttctaatagaaaattatggttaaagtcgtgcgcaaaaaattgaataattaagagttaacattaccggtaatatattttttttttcgaacggtcaggctgttgccgacgttttatattaaaaagaagatgtcccattttaagaagcaaacgggaccaaaacttacagtgtccaggtacattaccggtaatataggggctgatcagaagagagttgtgcagcagcagcaacaggactaagctcaatataagttttactgcttgcactgtacatacagcacaatcgcaaccatatatagccggctgcaaaccagcacaaacgatctgccccatactgaaactactaatctactcataagtacatcgagcttcatacaaagcaatcaaactatttttgttctcaggttttgtaactgtcatacatgattatgggggtgtttagatcaggggtgtataggggtgtatagttctgacgcgtaacatcgggtattatgtagggtatcgcatgtgtgttcggccactaatagaaaaataattatagtatccgttagtaaaccgcgagacgaatttattaagcctaattaatccatcattatcacatgtttactgtagcaccacattgtcaaatcatagagcaattaggcttaaaagattcgtctcgcaaagtaattgtattctgtgcaattagttacttttttagcctatatttaatactttatgcaggtgttcaaacgttcaatgtgatagagtgtaaaattttggggtgggatctaaataggccctatcctgagttggtcttcctttgtttgtttgaaaggcgatcaccatgatgaaattgagaaagaggatggataaaagtaatcggcaagattcagcataaaaacgtctgtcctccacttgaccactgcccattcagtcattcttgggacacaatggagaaatttagcataaaaaatattaaaggagaaataacatattattactacgtactctcttcatcccaaaataaatcaacataggatcgatatattatcattggtagagaaactatctttggtcggtcgacccaaatccacaatagtccaggtttataagaggaagatctttagtcccggttgttggaccaaccgggactaaaaatcatcttttgtcccggttggtaactccaaccgggactaaaattcatcttttgattccatgtcaggccgtgtcagggccctaggatcattagtcccggttattaacaccattcgggactaaaaacctatttttagttccgattgatgttactaaccaggaataaaaatcaaaacacactatataatcctagtaccgatcctcttttcccgtccacacaacaaactcctccctctatctcttttttcctctctaacttcttatctctttccttatctctaactcctagccttctctttccttttttccttccacacagcgaagaagagggtgggccggccagcggccggcgcagcggcgcggtggcggtggcggcggcggcggccggccggcgcggaggggaggaggggaggaggggaggcagcagtggccggccggcttttctttttttttcacaatttatgatttatcctctgatgtatttgatttgtgtgtgatgtgaatctgtgatgtattttttagaacttgtgatgtaattgttttaagagtttgtgatgtatttggagatgatctatttgaggatttggagatgttctgtgatatgtgatgatttggatttaggatttcttggcatgattaggggatggtgtgaaatcaatattcaatgctaaaaacaatgaaaaagagaaaaacaaaagaaaaaatatctatttagttccggattcatagtcccggttgggggttatgaaccgggaataaaaagcacttctccatcaatgtattacacagtacaaccaatctagacatggacttgtccggattagttatactatgtaactagccagtagagccgcgcgttcgcgcggctctagcccctgtctattaaatgctatatggttgtataatgtaaataggttctcgaagaatattgatttggtaggaagtgtagtcaattttttatctgtaacaaacaatattttcgtgattataaataattaacatgcctaatgtgtaatatttactataaatataatactggaaggttctaaattatgtatattagtagcatgtattatattttaaatatctgcccaaatgaccttttttatttaaaaaatcctttaggcaaatatttaaaatataataacttctaacaaacttttgaggaacttgttgttttagacattcttgaaagagagcatggaacgtggcaacgcgaacgagaagaggcggcaccaccagacgttactggggcatttaactttttttcacttttaagatatggcaattaaggatttgacactcacagtctataatatgtgggtcctcatgtgtttatgacatatggttcagtgacgaatccttatacaagtggcaaatagttaaatatttcaaagttggcgtgcaatggcttctcctcagttcttttctcttgtttgctcattttttatttctccatctacgcccgcacttcatcccaactcgacttgtgccaccatctcctcctccctagcaatgatggtgtgacaggcggacatgtggtgagtggtgacaaggaaacgggacacatgtgggttttcctctcttttccactatttttatcttcttcctaatttttttcttggagtagctatatttacggcactatgttttcacaacattagtcaaatcgtttttacactgtaaattacatgcgctcacattgtaaattttaaaacttaaactgtaattacattgtaaattttgatgcttacattgtattttttttctaatacacaatgcataaaagaattagaattaaaagtaatttattatctacttggaaaatgagacgggagagataaaagcatacttacatatagaagaaaccaatcatatagagaaaagtgatggcaattaaataaaaaatgtggtgacatattttttttgcaaactcttatttttctagctttaactctcgattttcaataatatttttttgtcaaatttatacaagttgggtcttttttactcttgcatgccacatgccttctatagatccttctaatggaagtgtcctgactcttctttttccctccatacttttaagtcgttctttccagatccaatggctcatattttacagtatacgtggctcaatcaggaaacaaataaacattcttcattgatgatgatgatgatgatgatgatgatgatgatgatgatgatgatgtcacatattatcatagattcatttattttgagacgcagagagtaatgactagcatttaatcattagcagaacagtgaggtccagcattgagaccagagttcaaacgctggccacgaggacgcaagacaacgacctttccattgatcttgtcgcatgaatcacatagcatatcctaagatcatagatttgttagatctatccacctaaatttctattgaattatggacaacaaaattgtagattacatcaacaataggtggtaaaaaacttcattggaaaagaagaatgatgacaggttacaaatccctagtcctagcagaaaagtcaataataatagttgcacatagcatgagtcgtagcagaaatgtcaacaataatagctgcacatagcatcagtccgtcactcatgcatacatatatatttgtagtttggctgggtacatatggttggatgtagaggttgggttcatgccatttcctaatatatatacgtgtatgtatatttgtaggaaaaaaggaactataaatatttacaaggattctcgaattgatccgaaaaaactagatgaggtacatgttggatttgagcttccagctacaattgcttcaagtagcctcggcatcgggggtatgtcaatttcaactagaccctcgagaatatgaaccacttcatccattgttggtcgattaaactcattatcctgaatgcaccaacacgcaaccttgcaagctgtttcggcctcttttatgttgatgtcaccatgtaatctataatcaaccaaaccacatatatctccatcaagaagcttacggaccacaagcactggaaaataatcatcatggtcaccaacacaaggagatgaggtatatgagttccttcttcctgatattatttctagcaagaccatcccatagctataaacatcgacttttggtgttataggaacaccactaatccattcaggtgcaaggtaacctgcagttcctctcaccgttgtcaaaactcggctaaaatcccttcccaaaagctttgccataccaaaatcagcaatttttggaatgaataaatcatctagaaggatgttttctggtttaatatcacaatgtatgatacaatcttgacagctttcgtgtaagtaagacaatcctctagcaattccaatggctatttgatacctagtattccaggatattgtagtattgctctgaaataattggagatcgagagaacgatttgacatgtgctcataaacaagcaatcttctgccaccctcacaacagaagccgatcaatttaactaaattgatgtgttgaatggttccaattgagctcacttcagccctaaactgcttatctccttgtggaatttggcatgcatggtcaagccttttcactgctattgttgtggaatcacttagagaccccctaaatacagaaccaaagctacctcctccaagtctctccatgaaatttgtagttgcacgttgcaaatcaatgtattcaaatgaaataattccattgcaaaactgggaatctttcaatctgtcacctgagaacttagttttactccgtctcaccagtagtaggattagtggtagcaaacataataaagcaaaacttgcaaaaatagcaagtccaataaccattcctctactatcaacgcctgcactataaaattcttttgtagctagccgtaggtaaagagcttctccatccgtattgctattttcactacattgatcttttcttatgttaagcaattcattgtgccaaatagagcatccaccattgatgaatgaataagcagtgcaagagcaattagttaagcaaacttgcatgcactcacttgaactttttacactttccacattatgggcatttgggggcaatctaacgcatggcatagaatagaacatatcagttgaatgtgttgtggttttgttgttaatgcagtctattggagtatttcttgagcatccatctgttcgatcttccagttcccaatcctcgagtgatgttacggtgaagccctttatacagttgcaatgtggaagctcattatcgatgcagactgtgaaaggcccacaaattgcatagacatcacacggagctttaggttgggcatagatcagtgtccaatcttttgagtcctgaagccaaaggaacatcttttcctgacctccgatgtctaatatctgacgactaacagtcctttcatctagcaaatcatatctaaagtacttctcttgatcattatcaacaaatgatgaattaaaaatagtatggcttttcatctccaggattgaggagaagtaatcgccgttccatgcaccggtagaccaatacggtgtggaggaattcaatggcaaaagcaagtactgatcaacaccagaagggtctaactctttgcaataggaaccggtagctgggtcaattgagtttttccaagaaataatctgacggttaaggcctgtgaccttgtcccatccaagctttgccccaggaaaaaatgtatctgtggggtagtcaaagctctgccagaaaacttctaatgagtttgacaagtttgttaggatgagatttccactattcaatagcgtagcaacggtgttgttggcagtgatattagcttgtgtagaccaaacgatggactttgttgactggtttaagatggcaagatttccatcatggaagattgttagttccactgatgtgggatcatcaattggcttatccctatttgcaacccatgcaggatttagcttgggaacctggttgaaccaaattcctaagtaccacttgctagttttctgagatgcttttctttgtgtctcaaagaagccaagtgcgtacctgcgattttctgagacaagcttatcgtttttggccaacgccgtgccaattgagatggtgtcgatcgtggcagaacttgctgggatgcttaaggcgaatagtagtactacaaaaatgagaagagccatggtgagcaactgtgggcgatcactattcagttcttctttcatttatagtagccaaaaggaaatagtaattaattaagattaattggattcatgtcattgcaaatttgccttttcagaaaaatattgttacaattcatctgtttgtagcctggcatggctatgaacagatgaattgtaatgtcatttttaatacacaaatttataatagcatgatccaattaacccaattaattacataatgtttcgacggtgatgtaagatcttttgctatgaattgccaaacatccacggcatgtctactatgtgtgacaaatgacagtcgtacatatattatacttctcaccctaggtcttgatggtgttgcaatgctagagatggccatactagtgatctttgttttaactattcttatataaatttagtcccaagttagaggaatttagtttagaacaaaattaaaacaccttaattacattataaaacggagtatatgtatttactagctagcgagtgggctccaacctaatgttttcttttaaggccgcttttgagatggctgatcagccaaatagctgtgtgtctgacaagcttactaattagtccttgattagtaatatatgttactgttaccaacttaaaaaatagacttatttgatttaaaaaaactttagaaagttttttttaaaaaaatgacatcatctaagcagtttaaaacacgtgttcatgataatctagtactatctttgttccaagacataaaaatttataggattcaaattttatactactagtagaatacccatgcgttgcaacaggaattaaatcaaaattgaaatccctggtgcacacctgtcagactagtcagcttccaacttgtttaacttttactaacaagtatcttgtcgttttattttagtgatcatgtaaacattatatatgtgggctaaaaggcactagactatagctctgtgctccatgtgaactatcagggaacacaacatatgaggcatatatgccacaaatgcgagacatatatgccacagatgcgtattacctccatattaatgcacgagtcaccactcaccaatcaccaattcaccatatagcttttcctatctttgccattattgcgaagcagtgcctttgtggcaaaggcagaagccagtggcagcaagtatgccgagcaatgagatttgctctggtgagaaaaaaaaatatcttacgatatcggtacctcactctttaaaattgtttttaactccaacgattgaaaacgattcggtatcttgagatatcggtacctcgaaatactttttgttagaccggagcaaatcttgccaagcaatataagatatgtgcacaacttctgtacatcatccatatatagcactttaggctgtgtttaagttcacgctgaaattggaagttgaaattggaacgatgtgatggaaaagttgaaagtttatgtgtgtaggaaagttttgatgtgatggaaaagttaaaagtttgaagaaaaagtttagcagtacttgaagtgcttgaccttctgttattcactggattttgtgctctgggagttgagcacgtttcgtcagtatgattcctagccccccgcatgaataattcatagcggggaggtgtcaatctcatattgccattattcatcatattattgctgtgaactatttacttgattgtaagaataaattaaatattttttaccataaggtttacgaataaacttaataaaagtgagaaaaacatcgctactaaaattatttttgcatgttcttggctttatttatctcaagcggtcaaaaagaaaaaccattatgaagatggttaaagccgtcttagggtcataagagaaacgcccatggatttttcggctagtttcacaaggtagtgtgcttccttctctaatattcgcgtttctttttttgtcttagggtcataaaccacatgtgaaaaactatttttacatgcagctgtggaatccgcttatataaatcattgattcctataggccttaagctgcagtggttggctaaacgcatgtataaatgtgttacggactggctacacaaatggtttttctagtgcatggtgtttaggcaagcgcatccgccgaattaacttggtgaaaaatatattcaaccgtgatgcaagatcttcacactcttaccaattgtacgacgccaccctgaaatatcccagaggcaaatgatgccttctatcctaactagccaagagcccgtgcatttcaacataaaacaaattgagtttctaacttattaagtcaattaagcatatatttagtctaagtagtactcgtatgattttctttattagacaagtaggtggctttgaaatttagggagaaccagcagtaaaacggaagatacggaagataattcgctggagggtcttataataatatagattgtgatactcaaaagtaaagggccaatgtggcagaatggacaccataactactgatattttaagtagcatagatactattacggacgtagaacaccctaaaggtttagctttgagtactctgatcataaatattttttgatgttccaaataagtttttgatcatatttgattgctaagttttaaatatttgaccaaatcaatgcttagtttaaaataagaaaaaaaatgatatgcataaattttctttagaaatacttccataatactataaacttatgtattttataaacatattataatacacaattaactgtcaaaattttaaatattgaaccaaatcttttccaaaactttagatatgtacgacgaaatagagtactcctccgttataaaatatgacaaactaaaattagattagatatcactagtccaatgtgcgttatggacggagggagaaacacctaggggttttccggttagctccacaaggtggtgggctagatgatctggattcgaaacctcaccccttctaattatttaatattagattcttctctagtatttgagttttttttttcgttatggacggagggagcacgaacttgctactcaggtgaccactagatgagacgcctagatgcagataagcagctgcgcttcagggcctcccaggagcgggcttccactttacgtgggctcggacacgataggaataagtccacttaccttctagtatcatctttatatcgagtttaattgacatccttaaaccacagtaacaaaaactccacccccaccttaacgaaactatccaaatcaagttccatagtaatatggatgatggttttgttgatgtggcatcctagtcagaaaaaaaataaaaaacatgtgagactcttgtaaatggcatacatcttcttcctttactcctttaaaaatttcggctgaaataatatcatatcggagggatccgataggaaattttcgaatatgtattccacttacatatgggcctcacatgctttttattttttttttctgactagaatttcacgtcaacgaaatcactctgatttgaattgttttgtcaagatgagtggtgattggtgaagatatctggtggttttgggatgtcaattaaactcgacacgaagatgagagatggtaaatagacttattcctacacgatacgatactccgagctggtggaggcctgcacggcccctcgctgatctcccggagattttgggccgagcggccctgaacccaaggcccaacaggcaacatgaggcccaagctccatctctcggttccgccgcccgtgttcccccattgcctcgtcctcgtagcgccgtcagccgtgttgcaggcgacggcaaactggtaagccgatgcggagccctagacctggagcgtgacctcgtcgatggcggcgtgctgagatcggcgttcgcggcggagggggggacctcgtcggtgtggtatgcttgtcgcgcggcggcgcggccgtagctctcgtcgttgggcgcctggtaagacgcacgacccaatctctcacgcaccagcaccactgtcgtggaggatttggattctggagcaaagatccaatctcccatcgcagggggaaggaaaaagaaggtactcctactcccctccgtattcacatctatgatattgttgattaattttattctatcaatctttttgaaccttgaccgtcaatataatacctctttaagtttgaaaacataaaaatcatatagatagatatttctttataagtacctttacagaatgtttttttcttagatattagtgtgttatattctaataaaaaattatgattaaagttggcgtagaaattaaaccgaataagagttaaccgtactatatattgaaactactccctttagtcataagtacatggcgcttcggacaaagcaatcaaactatttttgttctcaagttttgtaaatgtcatatacgaatatatgattacccggagggagtaattaacgtgaatgtgcaaggcacgtcaacatatgtagaatggagtaaatactcttaaattgttatttgtagaatggagtaaatactcttaaattgttattctttacactaacaatggtgagaaacatcaattcacaacagatattttgagtctcgatttgtgcaaaaatgagaactgttacaaatatatcagttgagttcaaaggtaacaacaaaaattaaggttccacgacctaaattattactacccatgtttgctaatgtatgttgatctaaccaatgttaaaaaaaaaattggagggagtattttattataatgtaactaaatggagaacttgtaaacattttattccatcaatcttcgtaaaatagtcatgttttgaccatcctaatcctgagaccaattttgaagaaatcatgaatagcaatggtgtttagtaggttgtcttgaacatctggatacacattaacttatttatttcaaataaaagaaatgaaatggctgcacataccttcatgataagcatagtttccactatttggccacaacagtacactaatgattgtaaggagtacaaactttctaaaaatcaggaataagatggttttaaagcatttattagataacatataatttacatatctatgcgcctatagacatgtacgtactcgtcacatggtcaacttccaaaaaccttgcaacaataatggacctttctatttcagcttgcattaacatttctcggtagtgatctctttagtccccaagcattagaagaaaaatcgatattatggctgcaaagtgtaatgacatggttggtttaaatagaaattattaaaattgccaaattatgagtagtgtttaaacatcaatggtaccagatattcatcaacactatatctctcactctcattggccaagccaaaccgaagtccttaggccctacatatgcataattcttcttgtcaagggttacatttatattaggggttatattttgttcagtaacccctgatatagaacgtaccaattgattcttttctagcgcataggaacaaagagaattatgcttatgtagggcttcgtgacttcagtcttgcttgaccaatgagagtgatagataaaagattgatggatatctggtaccaatgatgcttcaaaactacatactttagccattttaataatctctattttaaccaacaatctcattgcactttgtagacatagtatcaatttttttctaatgcttggagaccaaatagatcactagcggaaaatgctaaggtgaaatagaaacatccttttttgttgcaacgtttttgaaggttgaccatttgacgagtatatccatatctatagactcatctgaattatatatatgttatctactaaatgctttaaaaccatctatacctaatttttagataagtatggtcagtatagtcgatacaggcactagtgttccgttgtgaacaaacagtgggatgtatgctcctcttgaatgcacgtgcacacatttcatttgttatgtttgaaataaataaattagtagtgtattgaatgcatcatataacctatatgtatccatatgttcgagaaaacctaccaaaacaaaattcacgatttcttcaaggttaccttaggattagaatggtcaaaactggattgtaatacaatacctaatctcctgaggggaactgatctggcaactaacatggactaatgttggaactagaaattgtttacaagttttgcatttataatttcattgtaataaaatattagtttaggttgtagaactttaaattttcttcttgttacctatggactcaattgatagtatttgcaacggttctcatttttgcaaacgttgggattcaaaatattttccatcaaccagtgtttctcaccattattgtataaaaaaaataagaatataagaatatttactcaattctttatatgtcgatgtgccttgcacgtgcactaactattatcatctaggtctcatttggaatactcccttggggttgataatacttgtcgttttggacaaggacacagtctccaaaaagtatatatatagaaatatcaacaaatatactccctccatcccaaaatgatcatcatatgtgtttatgcaccaagaccaaggataatttaaatcgtatcaatcaagacattatgcacacattctcccacaatgcatgcatcgattaaaacaccatgccaattacaccctaccatgcacacattctcccatgatgtattaattgtattccgattaaatccgtgtccatacagttatatgatgatcaatttgagaaaattttggattccattatatgataatcaatttgggaaggagggagtatgattttattgaagtactttttaatactaatctacacatatggttttcatatttttaagataaatattttagaaattatttatagtcaaagattttaaagtttgactttacccttgttcaaagcgactaatattatcagcttagagggagtacaacattttaacccccaaaaaaaaaaacccattttgtaagattcttttaccatagttattcaatttcaaactgacatgtcatagattaaatactacatacagatataaaaatgttataaacaccaattttatcaatttaacataagttctacatcttgactccatcctgactccatcctggctccaggatttccagatgacatttacgttctcatgaatatctaaaatgacattgtctatatataaactagaatgttctaggggttccatattatgaaattttaactgttggatcaaaatataaccatccataggggtggcaatttcccccgtggggccgcccctacggggtcggggacgggtgctgattttgacctgtggagagtccgggtcggtgccccggccatgggcgggggcgggggatggcagccacccgcggatgacccgcagagccccgagggtgtatattagactattaatactaatattgcaagcccaaaaagccgatctagcctatcatatacaaagccaaaccttaatttccccaccctctaccctatcctcatttcctcacccacccagccatcactctccaccggcggccgagccgtcttcctccagcagtggctaggcgcggatggcggcggccatgtgccaccatccacgttagcgtcgacggccaaggaacgggcggcggcgatagtggccacgcgttgccatccgcgtcggcattgacggccaagggcgcggccaaccgtgttggtgtcgacgtccaggtgcaacacgtgcatctcgatgcctcccataccgatgtcgcctacccaccccaccaccctttccctcgtgggcatcacctccaacgccattgaggcttgccagaccacgaagccccctcctctcagccccatttcatctcatttcttatttacactccctagcttcggtgccaccatcctcctccgtcttcggcagctcctactaccagatcaatcaccacctcccactacctcctaaccactccaatgacaagcttcccccgccaccaacaccagcccgtcacctcctctcccgtggccaaggtggcgccatagccatctcacttgtcacccccacggccaatggcccaccatcgtgctgccactgtcccggtcgttcctctaagctacgaaacccctccgtccacctttgccaccacttgacaccaaccccgaaagcaaactactcacgagcttgctagagttgccggagctggagaagatcttggagcatgaatcgtaggtagagaaggtcggaaattcacgtgatttctcccctaaaatctgtcatatgatgtctagcattcctgatctgaaatttcgggtcaagtatttgaacttcagaccaaaggtcaagtttccccctgatttattaggatgtaacacgtaagtttaacaatctgctgggagtgggaataatggttacaatcattacaagggtggcataatgaagcggcaaggaagcttacgatataaacggcagatgagaaatgtgacgtgtagaactacctaggtgaacgaacaacgatcaaaactagtgattacattattttcgaatctaaacctcctgcaagagtatgaagcaatcttggcattggaggtgtctcaacttcagatagaccctcgagaaactgtagtacctcactcattgtgggtcgatcaaactcattgtcttgaatacaccaacatgcgactttgcaaactctttcaacctgctccagtttcacttcaccatgcaagtttgcatccaccagactgtcaatgtctctgttcagaagattgcgtgcaacttgcacggggaaacaagcttcatgcacgccatcacgcgaagattgtttactggagttcctgcttcctgaaatgatttctaacaaaaccattccatagctgtaaacgtccacttttgatgtgatagctgttccgcttatccactcaggagcaagatatcctatggttcctctcattgtagttacgacatgactgaaatcccttccgagaaactttgccattccaaagtctgcaactttaggagtgaaagatgaatcaagaagtatgttctctggtttgatatcacagtgtataatgcagtctcggcaactagaatgcaaataagctagtcctcttgcaactccgagggctatttggtacctaatagtccaactcaaaactgcaccactgcttgggaagagatgggcatcaagagaactctttggcatgtgttcataaacaagtaacctcctgtcaccttcgcagcaaaacccaatcagtttaaccaagtttacatgctggattatccctatggaactcacttcagctctgaattgcttctctccttggcgagcaccatcaagccttttcactgctatgatagtcgagtcacttagcgaccccttaaatacagaaccaaaactgccggcccccaacttctccgaaaaatttttagttgcatgctggagatcaacgtatctaaatgcaatgattcccatgcctccctgaacattatccattgtgaggttatatctcttcccttttctgatccaaatcatcagcagaaagatcaaacccaaagcagcagtgctggcaccaattgaagcaccaaggatcaccccccatctattgtttctcctactttccagtacttcttttgcagaaaggcgaaggtagagaacaccattaccttgttgtcgtacattgagcagcttgtcatgccaaacagagcagccaccttcaccgtaggaatacgcagtacatgagcagctactgaggcaggcagctgcacattcatctgcactagtagctgctcctatgctctgggctttatcaggaagctgaacagaagtcataggatagaacttatctgccgtgcctgctgcagttttattgctgttgcagagcagcggagtatttctcacacatccacctgttcggtcatctagctcccaatcttcaggtgattgtactgagaagcccttcatgcaggtgcaggaggggaatgtgatgtcgttgcagaccgtgaaaggtccacagaaagcgtagacatcgcactgcgatttgggtgccgtgaagatggtttgccaatcccgcgacccctcgaaccacacaagcgccttcagctggccggagacatccagtatggtacgtgatagcaccgtgggatctgcaattgcatactcgatatacttctcttgctcattgcttgtaaaattcagtgatagccatgtctgtcctaccgtctccggtatgttgctgaagtaccggccgttccagtctccgctggaccaatacggattcgaggagttgaacgtggagaccatggaggtagggccgttgtgtccgagcaactcgaaggaatacatgccaggagcttgatcaacggtgttcttcctggagacaagacggcggttcacaccggtggcgttgttccagccgatctttccaccctgcagaacagtgtctgtcgggtgatcaaagctttgccagagaatggtggatgatgcattggttgtgctagtgctacgcaggacaaggtttccatcgtccaggagaacagcatgggtggtgttggttgggatgttggctttgctggaccagaccatggaggagttcttggcatgggtcgttgcaacgatggcgaggttgccatcgctggaaactaggagcttgcacgacgcgagatccgcgacagggttttcgccgttggcaacccatacaggggtgaatttggggacggtgttgaaccagatgcctaggtaaatgttcggagtgctattggaggaggacttgttactgtcggtttggaagaagccgagggcgaacctgccattgctggacacgagcttgtcgccggcggcgagctcttgtcccggtgagatggcatcgagcgttggctaaagaatgggagggacatagggagtagccatggtaactgagtcttttataacatccaagatccaacttgacgttattgtttgtaaatagctagtccttaagttctttatgacatccaaattgatgttcatagtatgaatcttgtacatttaatgtactgcaacttgtactcctacttgatactgcaactggattatattaaacgcgacagttccatcagccatcacaggagaaaaggcagtgatactgcaacttgtacatgattgcaactggattgtaaaaggacaagtcagtcgttagtggcaagtagagagattctttttctcaacatggaatagttggaagttgttttccgagtattctttagtctttcctgtaaattattttcaaatcttctgtggaaagtttcttgaatcatgacggtcttttttaatcatatctaatgaaagttgctaaacataacttttttttaactattactagaattgaagcgtgtgaattcacgcgtttgcgcgttagactacccctgtttctttggtctttggtttgctcgatcagtgcacagctggatgacttctggtcggcatgggtctaacctgtattttgtgcacaattacagtgggcaaagactccaaagctgcaaatgattgagagccagtcaattggaaaactgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctgatgtgggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccaggtaatgtattttaattagccaacaccattgcggtggcactaatccaaagctattgccaataatcaagtctatgctttaatgttgtccccttttatgcactagttgaactaagcatggctaagcatctcctaaaccaacatctagtcattttaatacccaagttatcaatggcataagggaaacaacatatagctgagtaataggacccatcccacatgatatggtaaaacaatgcaatatttaatagaaatgcgggacatttgtaaattaggtacaatatgatcaattgcaatgtatgacttgccttgctctcgcactgatggaaccacagcaacgtcttcgagaaaccacggatcgacgaaacggccgaaatctacgcgacaaacaaagcacacaagcaaaacatgctataagactactgaaacagataacaaagccatttttaatggattctacacatttttatgaatttactgagacttgaatggacttaatcggagctcggatgaattagttatgatttttagaagattatctgtgtttttactaataaagaaaaacccttaatcaatttattgcgcaatattgccccagggctgacgtcatccaaggggtggggcggcgccgacatgcgggacccacgggtcagtgacactaagagagggagaggggcggctggcaggcgggacccaccgggcagtggcacaaggcgggaggggcgcggctggcaagcggggcccaccgggcggcggttcacggggaaaggaggaaggcggcctggctcggctcggcttcaagccggccggccggttatggcgagggcggcggcgcgcgcgcacggttgccagcgacggcaaccggcgacgggaggcggcggcagacggcgcaaagacggcggcggcggccgaagcggcggcgcgagcgaccctagcggcgacgctacgcggcgggcggcgcggcaaagggagagagaggaagagagggagaccgatcctcaccgaggggctcggccggcgcgagggaggagcgacggcgaacagcaacgatgagagacgggaggacgacggcgacgggctccgggaggacctagagaaaaggttgggaggggttagagagagggagatggaccacggcgatcggaaaccatggccgacggcggcggtggaggtggtgctcacccgtgcgcgaggggatgagggctccggcgacgaacttcgacggaggaggggtggacggggtggatctcggccacgcgaatcgaacggcggcgacggcgcaagacggcggcgagcctagcgacggctagcggcggccggagtagcgggaagaagcggcggtgggtggttgcacggcgcggggacgatggggagcacgggaggggtcggcgaaatggggaaaaagagagagggggtgccggcgatgcttaaataaggggagagggggcggcgagtcgtggccgggaacggcgcaatttcgccggagtagtggaggaggtggaggaggagagagagagaggcgggattcaaatttgaatcccggccatctcgcgggcgcggggggtgagcgggagtggggcgtgggcgcggggagggcggggcgcgcggggaaagtgggcgacgtggcccgggacgcggaaggcggaggaagcggcggcgtgggcggcggtttcggcggcggatggtggcggctgccggaggttagggaaagggctgacaggtgggccccacctgtcagcgcccgagggagtgagggggaggcgacctggacttcgggagggggcgggagagatgggccggcggcccaaaggaggaaaaagagggggaaaaaggaaagataaaaaggaaaaaaggattttcccagggatttaatattgcactttgcttattttaattggttaaaattatttccaaggctctgaaaattccactaaaaatcctgttagcgtattttgacatgtagaacccaagaaaaattccacatgccgattccgattattatttgcatttattactttagggtttctctctaggttaaattaaacaatttcttcggacgatttattttatgaatttagagcaagggaggggaacttcagggcgtgacaaaaaccgtaccatctctaactagcttagtttgaatcgatgtatcgatcatggaaagcatggaacacatgaacgctacaagaccggggagaacggcagccacatgcactctaatttttacgcggtagagtgttttggttagctggcatattttttttttctgagaaacacaatacaaacgtcagacgctcgcaacatacacacactcacctcctataaacgtatacatgcacactctatctctatgtgtatctccgaaaaactaagccagcatatctgagattgacgaagtcatcacgggcaccttgttgttgtcgacgggtacatcgcctatcattgattagatcaacattgcaaacttttatttttaaaaagtgcttagtttaaaaacataaaaaatgttataggtagatttaccttagaagattatactataaacttgcaatattttaattacaaacttttgtaatatggtactacatccgtcccaaataagtacagccgtgaatatctgtgtccaaacgtttgatcactgtccgtcttatttgaaaattatgaaaaaaaataaaaaaaattagtcacacataaagtactattcatgttttatcatctaataataaaaaaaataatactcatttaaaattttcaaataagacgaacggtcaaatattggtcatgaatagtgtaaaactgcacttattttgggtcggagggagtataaaattgtggtcaaagtagtatttttaaaacctacaacattctttcttgagaaaagctaaaaaaaatcaaatgacatgctctgaaagtttcctagtacaaacagagtatatttatgactcaagagagtaatatttcctagtacaataccagaattctgaaaggtccctgaaactagcattgtctccatgcaaggctgataaggcttatggctctgtgtttgctgcggaatattttttattaagctagaggcctagagtaaatatgtatttcacatcatttatttgccgggtcgaccgaaaaatatttcacatcattcatgcgcatcattatatatagcaaaacaaataaagcaaattgtgtacacttgtaactgcgtgtttataaacggagcatataacatcttatggcacaacatgtccaaaatcatcaacatagcacacaaggcattacaagctaaaactctcttcataccaacatatgccacaaaaaagccatggaaagacattattttatcctagcacttcttttggcattacaaatcagtgttgggtctctgttttccatgagctctgtactatagactgaagtagccttggcatcgggggcaaatcaagttcgagtagaccttcaagaatttggaccaccttacccattgtcggccggtcaagttcattctcttgaatgcaccaacatgcaagcttgcaagctctttcagcctcctcgacattgacatcgccatttaatttgccatcaaccaagcttagaacatccccctcaagaagcttatgtgcaacttcaagagggaaacaaacgatgtgatcagcataactattagactctctatgcgagttcatctttccagatataatttccaagagtaccattccataagcatacacatcaacttttggcgtgacagccactccgctaaaccattcaggtgctagatatccaatagttcctcttgctgtagtcataacccgactaaaatcccttcctagaagctttgccattccaaagtcagcaatttttggaacgaacaaatcatcgagaagtatgttttgtggcttgatatcgcaatgtatgatgcaatctcgacaactctcgtgcaagtaagccagtcctcgagcaactccaagagctatctgatatctagtactccaattcagggttacactgttattgcttctgaataaatgagtatcaagggagccattcgacatgtattcgtaaacaagcaacctctcatcacccttgcaagagaaaccaatcagtttgaccaaattggtgtgatgaatgactccaatggaactcacctcagccctgaattgcttctccacttgacaataggagacaagccttttcactgctatagcggttgacccgtttaacaaccccttgaacacagaaccaaaaccacctgccccaatttgctccgaaaaatttttagttgcacgttgcaaatcactatatctgaatggtataactccagtaccagcataaatgctgttcaatgcttgacagtgcaacttctttctgtgcctcctgatcatgatcagtagcaagacaagtgttaagatacccaaagcagagaggcttgcagatacaacaacccctacaactaaccctttattgctttttctagcttgaagctctctagcagcaaggcgaatgtgaagtgtttctccattagcagaggtgctgtcatcagtttgttgtttcacattaaccaatttaccatgccatatggagcaaccattgtaattaccaaatgaatatgccgtgcaagagcacttgccaaggcaaatactctcgcattcgcccgcagtcgtgacggattctacggcatgggcattgtagggcaatctagtggccggtacagcgttgaagatgtcacttctgctgctaacacaatctaatggaatgttcctcctgcacccacctgttctgtctcctagttcccagctgtcaggtgattctatggagaagccttccatgcagctacaagatggaaatgtgttgtcattgcagattgtgaaaggcccacaggtagcagcaacttcacactgatcatttggatgggtgaagactgcttgccaaccctgtgtgtcatttaaccaggccaaggcctttctttgcccagttacttctagcacggtgtacagtggtatggtttcatcgtgtatgcggtatgtgaagtacacctcttgatcattgttcacatattcgatttggaaaatgaatggggtataatggggtgacttgactaccatctccggtatcctgctgaagtaccggccgttccattcgccgctagaccagtattctaccgatgagttccataccaactggtaaccacccttgggtccaaactccatagagtacacacttggggattggtctactagatcccttctcgaaaagatacggcggtttaggccggtgatcttgttgagaccaatcttcgcactggggaggaaaacatcggtcggatggtcgaaactctcccacaaaatgtgtgatgagtttgaggagctttgtagtacaaggtttccggtgtccaagagcacggcaacggtgttgttgcttgtgatgttggcttggctagaccaaacgatggagctatcggctcggcttacgatggcgaggttgccatcgggggagattgtgagatgtgatgaggttgcatctgtgaccgggctacccctgtttgctatccaaacatgggttttgtttgggactttgttgaaccatatgcctaggtaccagtagctgagagtgtcatttccagaggacttactgccggtgttgaagaagccgagcgcgaacttgccgttgctggagacgagcctgtcgtcgccggcgatcgattggccgggagagagcgtgtctgctgcagcagagattgcagggaggtgtaggctgcagagatgaagcccaagaatgacaaggaggatagtcatagtggatcacaaactgtgagctggtggatatgattggaagaggggatttcagagggagctgccacaatgttggaatggatacttaagtttcttgccacttggggcacttaaataggtgttaggaaatggtgaggagcacatgagaaaaaggggtagcaaatgttatcagggaattgagcaggatggcatgggttctttttttattggaaaaggcatgacatatttttgttgtctagtgtacagtgatcttcttctttttttttcattgggaaagggatgaagttgttgtctagagcaaaggtgatcgagaatccgacaaatattattcttgtgctggaatattgatcaatcatttaccccggactcgcatggcgattgccgattggtcatgagtgcaatgaatggaatgctggtccagggatcctgactgcctactagaaaatgtggcatcggttgtaacttcacatggtccttgcctgaaccttttagagcctcaggaggccatacccctgtgcctcttaaaagtttcttcattcttagttcttcaaatcattttgtttttacatctacagtttgagatatctgaatcctttactgtagagataagtttactctattcaaattgggtaactcaacagagcagagagtgtgagcatgaactaggactgaacctatatatggtcatcttagttcatcaactactgtacgtgtatagatagatatggagtactggttgtaaatattcccactgatttgattactggagggaaattaaagtcagtcgtgcagatgaaagcaattgtggggcgcaggctcacacctgcattagcctttgtttaatgctcatattcttttttctcgctgtttgtgtgattgcagtacatggtcggagccgcatggcgaagtatgaactggctttgccgacaatcccaaagctgtaacctggtaccagtccactgctagtctttgtttttatgaaacaatttgatgaagggtagttggtgacggacagtgatcattgctctgaaaccttctgcaagtcttccctcgtatgatctttttttggatggttatgataattgatactcctaataattgtcttccttttggattgtgagttcagacatggccagttggcccttcgcggaagaacaagcccaagaattgatccaaaagcccataacatatcagtcctcagtgcttatcagttagtatcagatttggtaacagtgaatgtgtcgatcgaattgacccaaaacacactggtagtataaagcattttcctttttctgcattcaatctgaaaaaattgagtatatggagatagtcataacaatggcatggagtatctggatctggaggaacaatagaatcttcagaaacataaattctcttcttcagatcagtttctctttaagacaagaatttgccgtggttatccaaagggcgaaacaatcttatttcccaaaagttaaacaatggctagagaacttgtaatcacctttggtgtaaattgtactttgtaaatattatatatttattaatatgacactgtaggattctttcgtatagtgttttacttcaaaaggaaaatctgaaaaaaaaaattgcaatatctgacaatcaaagagaaaaattaccaaacacatgaaatttcatggctccactgcaagcctacaaataaaatgaaatatagggtggttgattcccaaatcatccgcatacccatcgacatgcagactgacagaaacgtattgcctagctaccatcttcagatactagcatcaaacaacccacgaaacagacaaacaaatcccacagtttgccaagaacagattgtattccatcaatgcgaacccaattcaagcgagtgattacaggataacacagatccatgggttaattaacacttctagatctaacaagccatgaactcgaacaataacggcatcaagccctctcgcccctgatgcggcgggcgagctggatgtccttgggcatgatggtgacgcgcttggcgtggatggcgcaaaggttggtgtcctcgaagaggccgacgaggtaggcctcggcggcctcctgcagcgcggcgacggcggacgactggaaccggaggtccgtcttgaagtcctgcgcgatctcccgcaccagccgctggaacgggagcttccggatcagcagctccgtgctcttctggtacttgcggatctcccggagtgccaccgtgcccggccggaagcggtgcggcttcttcacgccgccggtcgccggcgccgacttccgcgccgccttcgtcgccagctgcttccgaggcgccttcccgccggtcgacttcctcgccgtctgcttcgtgcgcgccatggatgatggattgatggatctctctctcgatctctttgctgcgaaattcgaatggattttttgaattgaggcgtggggatttcgggttgggggcgcgggggtatttgtagttggcggaaggcgcgggatcgcgaaaaattttgggatttttggggggtggggtttggagcgtcggattaggtggacggctgggatgagtctaacgatggccgcgatccgcgggtggggggaagggcgcgacgctattggctgggacgggatgggggaggatcggtggacccagacgtcagaggatcttgggtgggagcggagatgatgacttttttttagcccgattgaagatgcggcccaggcgtaggcccattctggcctaacagcggcctggtgggccacattgcttgtggacacactcattctgcacaggattaagagactttggttttctcaagcagtaccaccggtttgcaactgatgataagctgtaattcttataaaccatttaagattaatctgtgcataaagatttttgtatatggtttttaatacttaaatggcaacgctggaaaataagctacgaagaaaaacaacaatatcaacttagaatagtttttagtcggagttgataagctgaagaacaaacgatgaagatgcctgtaagattgttggtagggtcaaatccgtaagttttgataggataaggttacatgtcaattcaattgaagccaccaaacgactaggagggcaaactttgggaccaaatcacattagtcatagggttcatatgcccggtttgagatagttgtaagttgatggataatttaatttttgtattgctatttaatggtataaacgaaagaaatattgaaacgttattgttgaaaagcactccaaaaaaaatttatgtagaatgttcttttgcatgaaatatattgtttaagaacttgggaagtgtgcaaacgaaattctaaaatccataatcaacgtggccatagttccgcataagagattgtgcaattttttttcatgttgtatatttaacgcatattctataactttatacaattatatcggttgcaacggaataataggaaaagatgcacagatgggtttcattccatacataaaggctgtgtacgcttttcaaactgttaaacggtgtgtgtttaaaaaaaatatataggttgctttaaaaatcatgttaatccattcaagttagttttagttaatagttaattagtcatgcgctaatgagctatttcattttccgtggcggagggatatgttcccaaccaacacaaactaacacaacctaaggctctgtttaggtcccacgcaaaaacttttcacactgtcacatcgaatgtttgaacacatgcatggagtattaaatatagaaaaaaaaaactaatcacgtagattacgtgtaaaattgcgagacgaatcttttaagcctaattgcttcatgatttgacaatgtggtgctacagtaacatttgctaataacggattaattaggcttaataaattcgtctcgcagtttacagacggaatctgtaatttgttttgttattagtctatgtttaatacttcaaatatgtgtccgtatatccgatgtgacacgccaaaacttttcgtcctgcgaactaaacagggcctaagtgtggtacaaaccatgtacactctactgcccttgtagcttcatctgcaagatcacgcacatcagtccatctgcaagaacgcatttttgggtttttatttccaacgtttgaccgtccatcttatttgaaaaatttatgaaaaaaaaattaagaaaaaaagtagcgtataaagtatttttcatgttttatcatctaataacaataaaaatagtaataaaaaataaataagatgaagagtcaaacgtcgtataaaaactgaaaagtgcactctttatgagacacaggaattattcacattgttcaaaagctgtggtgaaccatgtcaaggcgtggagcaacggacatcaggcgtcaaagctccggaaaggatcttataagaggtgatcagcgatgataattgagaggtgaccggcgtgctcatcatgcttttccgctaaggtttggcctccgtcgcggctgccgtatcatactccaactacacccacccgaacgaacaagagtcacgcagccgctcattggatgatccccccctgctgtgttttcaccttatgcttggtcaatcagtccgaggggctttcaaaggaatcaggggctgaaatgaaccctccccactgagagagcatttgaggttgcaagatgatgctgcagtcatatcaaccagatagatggagatcatatagctttactagtacatgatatgccccccccccccccccccaatggccatattccctttaacttgccacttgtggactaggcttatcatcccctttgcggctccattttgggttaatgataggcaacgcctctcgaagaaatatgatatcttgttatagtgggagaaatcaggggtggagctagagtattaaggagggtgccaaggaacccggtcaaaaaaaatatagctatatctggcatattttcactataaattagacacccgcattagcttaaacttgatataaaacagagtaaattaaacaagtggcaccccctccatctcactctagctccgcccgagaaatggtggttgatttgagatctaaatgtcgaagatcagaagcatttaagattgtgattcatgctgaatattgtaagacttcttaatttcactgttaaaaaaactagatttgaagggagagatgtcccttcaaacaatttttaagaaaaaaaacttagggattgaacacatgacttcagagttgaaaccacacacctcttatcactagtggcatctcaacttaatttcactgtaggaaatatgtcattttcataacttttttatatttgatggtggttgatttgagatctaaaatgtcaaaggtcagacgcattgaattgtaattcatactgactattataagattattcttaatttcattgcagaaaaaaaatgtcgctttcataacttctttattgaaggaagaatccattgcgtggaaattggtatatagaaaatatagaagaaaatagttgtttcgtagacctctattttctttccttccccaaagtacacaaaggactcgtaattttctttgaatagttgataacagtattttccttcgttttgatatatccaaaagaaaaacatgtctatgtcaaatacaaggctgaagaagattttgattattagtgttcgcaaaattggcagacaatatcattgccagcttcaacatgagtagttcagacttcatacgctacaaactgttcttaaaagcaatcggattcggatgatatcgttccaaaaaaaaaaggcattcagatgaactctatcaaccattggccctcctttcttgtaaggggcaacagcagtgctaacatccttttcaaatactcgtaacgtatcttcttggtggggccttagaacaaataaaataactattatcaaattctactcactgctacaacattctcatcatagcatatcttctagtgggcccttaagtatagtgaaactgttaccaaattagtactctctccatcccataatataagggattttggaaggatatgacatatcctgttcagattcgtagtagtagaatgtgtcatatcctttcaaaatctcttatattataagacggaaggagtatgtaacattgcgacaacattatcacataacatatattctgagtgggcccttgtgtatagtgaaactgttatcaagctatatgtaacactgctacaacattctcataaccactgcaagttcagaaaaagagtttatcttcccattcagtgggcatccaagcagttttcgttttcagtgtgcacagttaagtgatctccttgttatttttctttcaaattcatatgaaccacacagttgctaagctagcagattctttaaaggcattagctttccaggaagctgcagaaaagattgtgtgtggattggccacttacctttcaagcttttggagcagacagcacaaaatagccaaagtgcacagggcatagtcggccgtggacccacctgtcaattctgggacatagatgaccacaatgcattcagataacaaagccctgatctctcgataattgcaggagaatatgcttgtcccactgacttgaaccttagcaactaatgcttgatttccaaccaacataatggttgattgttggtgcagcactgccatatgattagatctgaaatcttcactcctatttcttccctacaaaatggcatagaaaatgtgattcacagaagccaatagcacctttttttttctatccacgcctcattctcgagcaacatcaggtattaacacactaatagaattccaaatcaatctgtacagcaatttttttttactacagatctaccacacaatgtacagcagtacaagccagtttggcagtaacacctaaaaatcacacgttcacaacctagttctatttcaccacactcccttatgcttgatgcaacaactagaagcaatggaaggctctaaaaatcatatggagtaaccaaaccttcaggtctaagtggcgccagcacagggcgagctggcgctggctcggcctggcttccctcggactcggagcagccagaggccttctgtggtgccccaaacagggactgccggcatgttgggcacgtcgaccgcgccaagagccaccggtcaatgcatctgacatggaacccatggttgcactttgggaggaccctgacatgctccccgtcctcaaagtcggagaggcagattgcacacataggactcacagtattgagcttcaacccagttgagtagagaaggataggcatggatcggagggccttcctcctcagcccgctctgagccagccgcgtgacccgactcggctcaggatccaccaccatccggcttgaacaccttagcgcgcaccggacaattgagttgagcccaagcgcacagatcagtgcacagagaagaacagctaggatcatgacgatgtttgcatcaaagttgctcccgggagaaccaccttcaacgatggtggctccagacaccggctgactagggccagagggttgcccagagaatggggtgtgcagcagtatccttcttgagtacatctctacccttggtgtatggacaaaagccttcttcggaatcctgcaactgaagatcttgggctcacctagttgcgtgggtctgccctgttcttcctaagatagaaccataagctggtttgtgatgaagtatttatagactcttcgacacaacaaataatatggtttcatttatttatttggtttagtacgacgggctatcccattggtcctgacaaccagttgagacaaatgcttttggcaaaggccagaaggtgcacaattggaagcttctttgcttgtggcaagtgggctgcatctcagtgggttttctggggatcggggggccacaagcagcaccatctattgtctgcctaataatactataaagaacatacgcaagaatagagattaagctggaacatggatttgtgtgtttcagaaataagacagctcaaaggtcatcatggacgactgtaaacattctggcaaggacctacaaatttgacctttaatagttggtgcgtgacttagctggacctagtcaaacacaattccatgtaacacacaaaatatagacaaaggcacaaaggagaaactatgtgactccccttgctccttcttagtacaatcttgtctactttgaagaaaggaagtgaataaactagttaactatatatgcaaaggagaaacaggaataccttcatgcataacgttataacaacagaggtgtaatctcttttgcttttgggagggtgcctctcggcaaactccattcaatttcaacagcttcttgtcgaaatatttaacacttggacacggtgacaaactcttaatcttaaagaaatttagtcggcctaatctttggccagcccagcaacaaaataacgttggaaacagatgagctcttcctctctcccccgcgtcgctctcgcgcgggcggctcggggggcgaaaccctagccgcccgcgccgccacccccctcctctcccttcacctcgccgccgccggagctcgtcaacggcgagccgggaaggcggcggcgaggccttccactgcagcaaccctttccttggtgcgaggaggacggagttgggctgacgacgtctaccaccacgaccagaggcgacgacggcggggcagcttggggtggcggcggatctggcacttctttggccggatttggccgccccacgtccggatcgggaggcgcgacgggcagggctcgccggcagcgcgcggtcggccgcggggcgtcgcgggccagcgcggggtggcggcgccggcgcggcctggcggacggcgggcggatccggcggtggccggatctggccgccctattgtggacccccgtttttataacaggaatcaatcgtgtgaacagtgccattttcctggatcaagtagtctggtacacacgaactcatagctgaaatatcaagtgcacatacacgagagtctagtacgaattattacatcataagcccgcaggcacagtcttaaatcatcggaccgagcggtccggaatacattccaaaaacagaagtaggtaaggcagtggagttaaggcagtggcacgccattgccacaggcaacgaccgtaactaagacctactgagcgccatcgtcttcatctccctcctagtagtaggcatagggatcctccgaagcttcatctcccgcttctgattatatttgcaagggtgagtaccaaccgtactcagcaagccaccacagcaatgatgcacatgacagaggaattcaaaggatggctatggttcttttgcgcaaagcaagttttgtaattcttttcacaagcctaagacctagcatagactgatcaagttttaataccagtgttcatattaaataatgatggttctgtccaccatccattgtgatcccaaggatagcttcccgccattgagtcgttatggttttctgaggacgtccatattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgctcaacacatgagcctcgtcccaacacatgagacgcgtcacggcaaagcttttcgataacctcgcattggcagtatccgctccatgaacttaaatcctcatgcactctaggtgtccatgtttctagcagtgtgaggagttctggcgctcccggaaaagagaagtctcacacatattaaattatggttcaagttaagttctctctcacacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatccttcgtccaccccagtcgaaaacaattgtttaattttatttctcctttcacaaatcatgtcatcaacatcatggcaatgtggcgctcatgtctccacatgccgcatctcaattaccttcccaaaagtaattgcccaagcatcatttgataaatatgagtatgcatgattctagaatagcatttctaagcaattgtcataattgactagggactcatacgtaaacatggttacgaaggaataaggggcaaacaataatcaaggcatggcataatcacaagtaggatgttcatcattgcatgcaattttatttgtaaacaaaacaattttacaattgggatcaacatgttaaagaaatagtgatgacttgccttgctcaaagtcttgcgggtcttggccttcacttggatccgcaactccctcgggctctatagttacgtgtgaaaattgatttgaattcggttagaattcaaataaaaatccaaataaatccaaatggaagtcgaacgcttaagtcgattcttttatattaactttactattcgcgaactagggcaaacccaatttcgatttttatatcctaaactattttgcgggtataaatattttgttatcataagtttttaatttaatctacccgagcattatatccatataataggttggaaatttctatcgcaagctaaatatcggacggaatcctaaaattatcttataatattatacaattaaattttagtctaggactaaacgactaaatataatatacgtctaaaattcctagtgattaaatccgaatttctaccgtaaatcaattacttatagagattacccaaaataatctataatagtctataagaattcatctaatcgtttagttcttaattacatttaaactactaccgcgaataggtttttttgttaaattaccaaaaataatccataatttatattaaatttcgcaattctacgtctataactagtctataactaaatgctaattattttaaattttctaaacttccctaatctccctctaatttcctatctatttcccttttctttttcttcccttctttttctttttccttcctttctttttctttttcttttctttctctctctctcttttcttttctttttccttctctctctcccttttcttttctttttccttctccctctccctcccggattctctcatccttccttcttctttctctccctcgggttctccctctctctctctctctctctctcgggtctctgctacccggggcggcgacggcggccgagcaagtggtggaggcagcggcttaccgacggcggtggcggcgacggcggcgacggcgacggtggtgacgtcggcgcaaggtgcaacgcggcgcggcggctttcttggcggcggcgcggcggctctatgcgacagcgcggcggcgtggtggcgtgggtacaggagaagaggtgaggatgaaagggaaaagtgggagtaggggggcttatataagggggggggg

SEQ ID NO: 1305 - DNA, 7684 bp, Oryza sativa
  unsure (1)..(7684): unsure at all n locations
gctcggcagtggccacgtgacggcgcgcggcccgatgggacggcccgacgggatggcggcgagcgacgcgcaacggcacggcggtagcggcggtgcacggcgcaaggcgatgcacggcggcgcgtcaacgcgacgtaaacgacggcgccgtcggcgcggggttagggcgnaccaggcgcggtgatgacgacggcgtcgacagagggaaggtgaatcggcgtgcggcgcgcggggcgcgaggacaacgcggcaaaggaggggctagggctaggggacctcgtcgaacactttaggtgcaatgaacagtgccgttttctaattaacccgattttggcccatttattatttaaatttgattctttaattcccaaattttgcataaatgaagtatactcaatatttgtgccattccaatccatggattcattctagattaatttattccatgttttatatattattattgtaatttacttgaacttaattagagttaattctcattccattgcttttaaatttgatggatataaatatggtcgtaataatattttactcatttctatcctcaccaaatcttattttaagttgcactttaattacttactttgtccatttactttttagggtttattcctaaccaattatccattattcgcgatttataaactccgaacccaaactccaataaaataatcgaataaaatcggcatgatgcaatttatttaaaaagtttttgaaaatccgcatttttagagtttagatttttgtcgtcgaattttcagggtgttacacctatccccggcgtgacggccggggctcaaaggcggcgcgcgtgtcgcggctcggcgcgggtggccgtgggacaccgtggtccagcacggggcggcggccggggattggcgcagcggcgacagccctcatggagggcggggccaactgcatccgggcggcggcctgggcggatggatggcggcggcggcggcggtcctcccggagggcgcggccagatcgtggcccgtggtcggcgcggcgcaacatgggcggtcggacggcggcggtctggccttctggtgcagcggtggtggcgttggggtgggcatggcggctcgtaggccctgaggcagggagtgaagggagtgatggcagtgctaagggagctggcggcagtgggtcgtcttcctcgctgccagcctgcaccctcgcccttcctggagctcctccccttctctgtggggagtttctatgttggattgaggcggcagccggttagtgaggggagctcagaccgccgacacgacgccgtccaattccgggttatccttcggctaaagctggcaaggaggtcgacgggtggcaggacggaggaagtctgggccagttcctagggtggcggcagctctatgcagcaagtgtggtggtcggcaggtggaggggccccggcgcaatgtggtggaggcctcatgctgatctgcttgtgaggtggttcctgagttgatgggcgacgaacctcaagcaaggttgaagggtttccgggtgaaagcctcgcctgatgattcatcgggctggcagcggctacgcttttgggcgtcgtaacccccttgagggcgctggcaaggatacctttctcccttggcgagttttctctaggtgaaaaccacatctccttagatgggcgatggcggcatccttgatgtcgtgacctccttaggggcatcacttttagagtcccgtctttgtggtgttgtcgttggcccggcggcgatcggccacgcatagcgggggtcgtctcggtgctaggtttttctctcagtgggttgtgcttgtgtgattagcatgtggctttggttgtgcatttcgatgcacctccgacctcgacagcctctgtcgagttttttcttgtaactttattcctttttaatatactcggatggcctccttcggccttcccggcgaaaaaacaaaataacgttggtgccctttcttgttaatttatggaaacagtacccctaaatgcagaaaaaaaatcccagataagtttgtcaatttaaatttactggatttatcatcaaatttcatcattaaaattaacagatccaaagggaatcaattgcaaacttgatataaattatgtagattctgcaacttgaagttcaactatataactgtaggaacaaggagactgcaccaagtactgaaagatgaatcatttaagcttaaacacaaagcaaatggagcagctacatattcttagagcactcacaaacaaattatttattggctattgcctgttttgatcccctccactttgtgtgcgccagaaccagctagctagcgaattgggggctgacttgtcgccttagagctgcttgggccatcaacaccaatcctactggtaaagcacctatttagccgacaaaaaaaagcaattctaacacgaaataagttaaacttgttatcttgaagcattataaaaaccatgagtgctcctttgtccacaaatctgcatgtttctttcatgcagtattgacatatacaacctcaaagcccactcaggtgtccaagacagctgcatttcatattcaattctggcacaaaaataagtcaatgtgtgatcttaaggcattacataaaccgtgagtgatgtttcctccccagagctgcatgctaatttcaatttgcctatagcagtccaactgccactctggtatccaagtcagcatagtttgatgtctcatcaatgtgtaataacaaaaaaattacttaagtagtcattcaaagtaccccttgagatgattaaatataaatgataaaaatcacatttcctaaatttggtcgataatgagaactaacaacattttggtgtcaaatacatataccaccagtggactaaagggctgtgagtttgtgtctgtatatagttagatgagcacgcaaatggcgaaggatcgaatgcctgagagaggtacttgaatcgcagggattttagatgagatagtgccccaaaagagaaaaaaacattgaagagagttaggatcaaccaaaattttcaggcaatagcttgtatacaccatgaaggtaatcactggaaggttttttttagtttcaacttattcttctgtaaaaaagaagctatcatatgagtttcatgtaaaatatcaagagcatgtatgtgccaaaggttgggaatactcgattcctgatatacacaaaattgtttgcacattttgcctcaagcacttcttggtctaaccattgcactaacacttcctcagtgatgcagctgtggacatctatgtgtacgtgatatgactgtaccaagctctcttattaatgttatcttaactcatcactttatgctttggagtcctagtctatataaccaatcttaagttacaagcaagagatatactttagtatccacacagcaaaatgagacaaagtaacccatgcagaaaaaaaatggaagtaaaatgtattttatttgcttgttgcagttttcaactcagaaccttagcatcagcagcaagtattacatatcaaagtcttttatgtattatagggtaattccccaaattgacaatattggcaattcggcagacagcatcagatattttctcagtgataatgcatgcaatttgttgataacaaggatgaatttacatgatcttcttgttttgaagctaccatcggtgttagccttatttggtatttgtcaaagcaaagaggaaaagcaccgttgatctgtgctatgcttgtcagcttcactttgctagattcttcatcaaaagagaaatcccacgtcctatctcacttctcaccctctcatctttccatatttttttttccaaaaatgaatgcatacttatatatgactcaaactactattacaaaactggcaactcaacaatatcaagccattatatcatgttaagacttaagaaattgcagaagtaagccaaaagagttcctttaacttacacatgtgcagtgcttcgcttttccattggtaaagacaaaatagtgcaagcattgatggtagaaccaagataagcaaaaataaaaggtaaaatatacaatatgtttcttttcttcgttcctccttgctaaaagacattgaagatggatactagacaggaaagaaaaaacgatagacagagataagaatcgatgccatctttatctaatctgtactatcagaacaaaactgaacttaagctttatcttatagaatttatagactacatccatgcttatcaaaaagggtatgatttaaataatcaggtgtggataatattcacaggaaaagtaaagcaacacaggctaaagcacttaatgcctaatggtgaaagtgctcgcaatttataccttcactaacatgagcatgaattatatggagcaaaataaatattagattagatcatcagcaaataagagagagcatttgtatcaagaaatgcttacacttccttaacattttatcaggcagtgtcacatactttagatagtgtatttcagagtttagttactacggaagttcagcaactttaaaattagcttctaatgtttgctagctagctaacttatcattcatcatcagtcccaaaactgcatcatctgtaatgaaacaaattacctgcaaaggtacaaagtcatctagctaattatgcatatgaatagattgcatgcttttattgatcttgacatagtctcgtacggactgtcagactcaaacaagacaaactactcaccagtagattgtactgaaggttgcaaacaactactcaattcttccattccgacataaaaatgcatccccaattatcacctgcatgtacactacaatacaaatgatcaaaatggcaacgaataaagtgtcaaactatcaaacttcacctatataagatgtaacagaacagaacatagatatgtaagaatgctcaagccagtgctaacaggaaaacattctgaatagtaaagaaggttttaccaattccatctccatctgcaaagaatgttcctgttgatatttcctggaacacccaccaacattttcgtaagaggattctgcaacatagggaggaagaaagaggatgcgaagttagaggcctagaggggcaggcgcttaacctcgcaaggacgccggccatggcagcctcgcactctccgacgacctcgccctcgtcttcgggctcctgcgccgcgagaagcacgacgcgtgcaggctcgcccccatcccagcacgatctcccttttgccccccctccaattccccactacagcactaccgcggctacagcaacgggctacagcctcaggggagagagctccggcttcccaagatcctccggccccccagcgccgcccgccatcgccgccgaccagcgcgccagcggcggaggcggcggttgcgttgcagcttcagcttgtgcaggaggaggcgaatcggctggttctgtattggactctgctctctttgttgggccagggccttgccagattccggcccatatttgaaagcttcttcttcccccttgggcctcacgaagccgatagttgtaaataaagcccaggaaggaagtgaaaggaaaaaaaaaaacagatggctttcctgccttcctcaacagccagatcgccccccacctctccaactccagtatcttctagaaacctctagaagtttcttcccgagacaaaagtcttaaaaaaaaaattatctcgcgagggagaaggcgccgccgcggcgtgatgtcctccgggctccggctgtacctgacgacgcgcggatcggagaggcactggcccctggcctggttggcctgatcgcttaggtacattttgggtttgttcatggtttgatggttgcagcttgggattatacatagagactttgttttgaatttggggggcaatttcctaaatctctgggtgttagggtttggacctccaatttgggcgtggaatcgctacgatttgtgctgatccgtgcccgatcggtagtagtacaaaataaacagggccggattttgaattgtgtagacgagactgctgactgcatgcgttgtattgctctctggtgcgttttttttttctgggatttcgctctcttgctgcatcatgcatgtagagttcatgcttgcagcgccgggtatgaattttcactgtctgccatcaattttgcatatgaataggtggtgaggacttctgaatttgctacccgggatgagatgagctgataaactgtgacattttagggcattcaatctgcctctatatagggtttgtatgactctttaaaattcatgcaaccatgccatggatgatggattgtattgcaattactctgcgcgtacagatgtactagtcataaacatggagatagtacctttggttcacgatgcacaactgcgagatcgatcaatgacctcacatcacctcaacatatcgttcatgcaacttaaacaaaagtcgttgttaatgtatagcagtcgatcagtcactggttgatttggttcaaaatattgtttatgcttgttatcatggagtttgtatatctgcaacagcctatgcctaagttcatcgtatatgatatgttgcacataagattctccatttctagggcttttgtatgctttttttaataggattaatgagccgagcaaatttctgttgcagatttggcctggtgaaccttatgcagttttctgttgcagtgttgctgcaatctgatactgggtgagttgtatctgctattccttttcctagctattttcaagttgcagtgttgcaagatgatagctttgtttttccatgtttcctttgtgtcacggcggcatctgagcaaggcattcaacctgagacggcaacagcggcccagcagcaagatcgaaccaaaaggatgaagcggcccaacacacgcttcccgttgagtgagtggacccagtagcgaaaggctgggccactgtcagtgagagagactagatggagcattgctatatagttggcaggtgcgagagagcgggatatgaaatattgtattcaaactgaaacctcaaactcaattccaatctccctcctgctcctctgcttctcgtgtctctgttcttcttcttcctcaagccagcttcttttcccttccaattcgagtcacaggagaaagttcgttgtgactcaaatctgagttcgtgacatttggtatcagagcatcgatcctggagaagccaaggtacacgtcccatttgcaatcgcaggttgaggccatggagaagcagaacctcgacttcggcaaaattctcggcgacatccaggattcgctgaagtcgttgaacgacaagcaagcggagacgcagcaaccgtggcgaagctggatgcaggagtcggaggatggcggcctcaagtggaatcggcgattcaggatttgcacgacgaggttggcaaacttcgtcaacagctggatctcctcggcaaaccgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1306 - DNA, 4883 bp, Oryza sativa
  unsure (1)..(4883): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattagtcccattaattcatccaatcggctagttgtcgtgacctttacagaaccaatgatgcatattgttttctgtgtggaagaagaatcctcttttgcatggattgtaattctcatttgcacattgacctttgcacttatattagtctcatgtattctttcaacacctaaaagttttatcataagtatttcatttgcccatacattgacctgctaaaaacctatatatatatattctggatgagaaatccttttaaaagcttttctagctaggatgagtttaatgcatatatatgaaaccagccacacacatgatcaacctaacattgcacaatgctagcaagattataatatcgagatgtcaaattcaatcattagcaatatgaaaattagtgctgttgtggtctgaatatgatagattatctcttttatataaatcaatataaataattacctgttgaaaaccaacactgatctcataatatgatttgtaaaaaaagggtagcatatgtgtgtcccacttcatttttcatgatctatatgggcaggggctgatgctttaatttagatctcatctgtaattaaccagctagtacttttccagtagccagggctttctttctttgattatttgcttttctttcttgtttgtttcattcgcgaaaagactatggaccatgcataatgcatctttgttttcaaaaagtcactttctagatggaacctcgacctgagaaatcatggttttcttgtagagcttaaagtttggtcatgcttccttttactataggaaatagtgaagacatcccataaatcaataaataattagccagctaggcatgtcttgatctcgagaaatgttcatatttgctatgagattttgttcaaatttcctgtgaaaaatccttgcagtccaagcgatgccttaactattttgcatcggggcatagtactggtactgaaccaactaattaattaagcttagagagtggcttagctagctagcagagataccagctagctagtgatcataattaatttctaggggatttccattattaactctataggttttttttggctaaaaaagggtataccatttcgttgaaaaacaggaatcaatataacctatgctgttatcctatttttgcagcaagtccctgcatgtaattagaatattaaaattagtacctattttttttgcagggagagactacattaagtatgccttcattacgacattaatcgtgccctaactaacaaccttaaattggagctgtataaattagtcacgtgcagccagtcttgattaattcttgaaactttagttaatcatttgtcaagtgttgcttaatgttgtatccaccaggcaaaaaatagtaccacttaattattttgtagcaagctatagctttcttcagtacttcccactgattgcagtgtggaattaaattaattaattagtctgcttctgacttcgttagtttcttcccctttttttttctgaaagaacgttttcttccctttcttctgaataaaataaaggagatgaattggttttcatacaacctggcactcaattgagagaaaatactgatagagtttttttttgaaggaataatgaaagagtttcatgtgcaacaaaacttagaaattaaaggtgccaactccagaatcagaatgtgcaagaatgaatctttcttcctgacttgtgtgcgatgcagctgaaattttaggtcagaattattcctgttctaaatgtagccttacctcgtttctgagcccaagtgtgtattgggtttgaaactgatagtaatggcccaaatggcttaattacaaggaggacgctctcttggatcgctaactaattgagtccattccaccaacagcaagattcatagcaggccttcatgcgggccagagcccactttaggcccagccttctctgatgcagttcagtgctgcttcagttttcagatagtgacagatggggctgaaaaattgcagatcgagtcccttttccttcatcaccggagaccagggtttccccgacggtaggcacggtaaccacggtaaaatttaaattattttctaatttaaaatttaaattattttctaaatttatttaaatttaaggtggttaccgtggtttttttaccgtaccccacgataaaactggtaaccgcgtgattaccgacggtaatgtaaaccctgcaagagacatagagaaaagatggaacagaacacgacgaacagttgttcagagctgaaaaccgctcaagctgaagcttaattgttgatcaggtactgctggtacttaacactaatcgattgcatggacaacacaaaatgtattattccctccgttttaggttataaaacgttttgactttttgacttttactattttaaatttaactaagtttctaaaaaaaatagtaacattttcaacccaagacaaatttattataaaaatatatttaattattgatttgatgaaactaatttagtattataaatattactatatttgactataaacttagacaaacttaaaacagtttgacttatatcataaaactgagctagggagtattattcgagaattcatcacagagccaacgctatctgtgtgtgcgcgcgctcgcaaatggcttgcatcaaaattgaggaaaaaatcattcaaatctgtatattcgcttaaagcaaaccgttacaacaatcattccgtacttattcgctgtccacacatttcacacgtactccctctatcctataaaaaatcaacctagtactgaatgtgacatatcctaatattacgaatctgtacatacatccgtccaaattcattgtactagaatatgtcacatgtattagattcgttttttagggacggaggaagtagctctatttttcttacaaattacaatcatacagtacgtatacactgtctacgcatttcacccactacatggtatctctcttttccttctgtatctatactccctgctgtcatctgaatgtctagatagagtaagccataagaatttttttaaggaaaggcaggagattttgccttatgtagtaagccgtaagattacgtagtatagaggtaggaacagcacagcgagaagcatcccgataatcaccctgcagattgaattaattaagcagttaggatggtaacgtcgaaacgaggactctctccgtttctaaatgtttgataccgttgtctttttagcatatgtttgaccattcgtcttattaaaaagaattatgcaatatgtaaaactatatgtatacgtgaaagtatatttaaccatgaatcaaatgatatgaaaaaaaattaataattgcttaatttttttaaataagacgaatgatcaaacatatttaaaaaagtcaacggcgtcaaatatttagaaacagagggagtatatactttctcacttaattagtaaatcagttggaagatcttacgcggtgataataatctcaggatgcagcccgtattcttttgcaaatatgaatgatgaaatggcttgtggtacagcagcctgcaaaatgtttgcacagatcaagagatcatcagttttccttgcgtagaacaggattacaatggcgagctaacataggagagtccgaaacgttccaatttgggtaaagctaagattaactctgagtctctgaccattatgtttgaacacagaaaaaactggccattatgttcttttaaaaatctgaccattgtgaacttaactatttgagtaaatctaagctaggaagtgatcaagattaaaagttatcaatctcagggaaaaaaagattaacaattatcaatcgtcttgccatggtaaagaaaagctactttcaaccattatcaaccgcgctcgctttctgaatattcaagcaggtaattaagaagggttggatttccatcatcgaagcaagaaaagaaaaagattaaagagcgtagttggaaggtaatatggaaatgtgtcgtgagaaagttgcgtttggtctctaaacgtctgactacaaataacattgtaattagatacctgtatgatggcagcccggagtttgttgccgtgaaggccaacaattttggatgcaatggtcatcgcaatgggtccaagagcaaacttcaaaacctgtcccaggatgcagccgcacagatcacaagctatgatactttcctgactttccatggacaaacctgcagataaaatgagcatgaccccgccccaaaaacaagtgtccaagacatgcatatttgttacaaaggaaaataaaagacaatctgttactgttagtgggaaatttaaaaaggaaaaataatgtatatcccctgtacctggtgtatcatatactcctatgatatatacataggcagaacaatttatatttatgcatgtatgagcacatgtcaatgttttaatgcgagtataaatttgtacttacccgtgctgatcataggcagcgctcctatgcccagtgacaaggacgcgatattcac

SEQ ID NO: 1307 - DNA, 4958 bp, Oryza sativa
atgcatatataatatatgcatatatatatatatatatatatatatatatatatatatatatattatatttatatatgtttcaatacatatgtacatgcataatatatatgtatttatacatatatatgttttgcaaatgcatatgtatgtatgtgtgtgtgtgtctatatatatatatatatatatatatatatatatatatatatagccactcatatagggcaccatggtgcccggcaccatggtatcaaatgcacaaaatcactcaaatttttcaaaattttcaaattgtgagtatatacctagttataataattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtggttaatgttaatacctaagtgctttgaactgcttttgctttgcgcactacaaataaatgacaaacgacgagagatctaattaatatacacttgtatgtatttgaatcggagaaatataaatgtagagcatgtgtactcacagaaaatttgaacttccgcctaagtctttctctccagttgccgcggaccaaatgacggaaccgataccaagccctacatggagtttaaagctatgattcgtagtagcaattaacataacaagattttcttaattaacagaggaacttatgacagtacctgtctataagttcgaaaaccttgtcaaacgtagactcttttttatccattgagtcatatacattgacggtgcaggccgacaggtcgaagagtaaaagcacccagtggaatctacaatgtgcgtgggatgcattacatatgaaacacttagcaagttcatacgggaatgaaatttggtataggaagacagtaaaattaaactaactctgtgttgtacggcaacagtatgaacgtcttgtaatgctgcgcctttaggagatggacgagattgtcctctgtggcttgcggatattggtcgagcattgcgacgtttactttccgagggtcgatgaatccagtatcgaaaaccccccgccgtcgggccctttgaatctccattctacaatgataaaagggagtatattattttctatagtctacttatatacaaggacctaattaattaaaggagacgtagtaagaaatctaactgaacgatatacttacaaaatccagcaactcataatagagacgtcgagggcatccagctggtatagttcgtagattcccttgaaattgatccagagaatgtcatcctttaattaattaggtctttgttcttggcggcgtcaactttcgccttcttcgttgcccttgtgtgggcaagcggtggagcttggggggcccttgactttgaaggtgccggaagaggagcttgcggaggagtcggtgcaggagcctaaggtggagacggtgctggagcatgaggaggagtcggtgcaagagcctaaggtggagacggtgcaggagcctgaggaggagtcggtgtaggagcctgaggtggagacggtgctgaagcctgaggaggagatggcagagcccgaagagatggtgcatgagacgccgcttgtcgcccagggaggatgatgtaccgcctgcgccatagaataatggcatggcttgtgtctcgtagatgcgtctcaccgtctcctccagggtaatccagcgcgaggtcctcgtacgcgccttcgaccaactcaacttcgaccttggagtatcctgctggaatcggcctgcagtggtaagtacctgaaaggtccattgggatggccatgcccgacgccaccttcatgtggtgagaggttatttattagtaatcaacatatataagcagcaactagcggaatggccaaatctaaaatatataaactacgagcttacctttattgataagttcttgaaaggaatatgcagctcacatggtgtccactgaatgatgtcatcaacggggcaagtggattcgtcctgggtttgtatggcgtccatactctgtgatcctacctgccccattgaggcgcagctgctacggtttcctgacgggctcaccattgcaggaggaatggtcggctggggatcatgggaccgatgtgcggccatgcgttcatcaaccttccttgccacctcctcttgcatgctgcgctcgtagctcgataccctgaactctagatctgcaatcttcaccttggtatctctcttgctcctcatccgactcctgtacgtgtggatgtcctccttgaacctaatcttccaaggaatcacccctttcgctcgtgttcgtcctggatgctctggagtctgcagggcgagtgacagctcgtccctctctctgtccggtcggaacgtgccctaagaagaggcttccactgcgtctgctagtcaacgcgcagcctcttgtatctgatcgccgaagaccagtgggccatcagctgggttgagcgttccaccgtgagcatagtaccagaacttcgatcgttccggctaattagcggtggccggttcgatacccctctcaagcaagcttgcctccatctcctcccacttcggcatcgcaacgctatagccgcctgaccccaagtggtgatggtacttcttcttggcggcattttctttgtttctttccattatcgcctgcccttgttcacctgtcttatatgcaacgaactcgtcccagtgatcccttagctttgggaatgtgtcgaagttcggtgtctgccccttcaggatatatttctggtacagatctcccttgaagctctgaaactgttctgccattttcttcagagtccaccttttcactttgtcctctctacccgcgggaagggtgaatgtctcgagcattgtggtccacagcatctctttcttcgaatctgggacaaagctctcatgatctctgcgtgcccttgttctttgccagtacaccgtactgacaggcacgttatcccgcacaacccaaccactgtgacatacatagttcttggcggcttctgccggggcactaggtcgtccatcttcttccacttccgttatgatgtgccgaccctcaagcttcttcgtggtacctcgttacccgcgtgccctcttctgtccaacggagggttgacttccactagccttctcctcctggttcccctccacatccctttccacgtgcccctcctggttcccctctgcatccctctccacgttcccttcctcgttcaaatactggtttggatcctcgttcccctcttcttcgttccagtactggctacttccctccgcgattgtatcgtacaatatttgttcctcatcgcgattagccatctgttcatacaggaaacatctgctaagtcatgagacatttatgttttaacaatcttatattaaaactcaaataatcttatatgctaagactaaaatagtcatgtatgctaagtgtaactgtcgtatattagaaccctacacaatcttacatgctaagtctaattacaaatctaataatcttatactaaaactcaaatagtgatatatgctaagtctagatgacgtatattataggaccctagctagtcaataattatatactaagtctaattacaaatataataatcttatatcaaaactcaaataattttatatgctaagactaaaatagtcatgtatgctaagtgtaactgtcgtatattagaaccctacacaatcttacatgctaagtctaattacaaatctaataatcttatactaaaactcaaatagtgatatatgctaagtctaggtgacatatattataggaccctagctagtcaataattatatactaagtctaattacaaatataataatcttgtattaaaacttaaataatcttatactaaaactcaaatagtcatgtatgctaagtgtaactgtcgtatattagaacactacacaatcttatatgctaagtctaattacaaatctaataatcttaattgcattacaaatataacaatcatatatataattacgtcacttgcctgcgcgaattccttcgagggctagctctaccactccggcttgagagatgactctgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattcatctgcctataattgcatttcacgttcacgttcgttcgctcgttcacgttatcgttcacgttcgttcgctcgttctcattcacgttcgttggctcgttcacgttagttcgctcgttctcgttcacgttcattcaccttgttctcgttcatgttcgttcgctcgttcacgttctcggtgtggcggcagtgggacggcggtgtgccggcaacggaacggcggcgcggcggcggcgtggcgccgcgcgcggcatcgggccgacgcatggcgcggcggcgtggcgccgcgcgcagcatcggcgtggtacgacggcggcgtgctgcgcgcggcgcggtgccgtcggggcggtacgcccggtggcggcgttgcacgccggcggcgttgcgcgccggcggtgtgcggcgcgaggatcggagagagagatcgagggaggcggcgtgtcacgccccgaactagccccgagcgggactagaccgtgacgctccaaattaacctgttaatcgataccagtcccaggaaacagtgctggtatcacaggaagacagaatatcacagcaacagaggtctctttattatagagtaggagtacagtcatattgggctgcggacagatcccgagctcacaactgcattacaaaagggaag

SEQ ID NO: 1308 - DNA, 40466 bp, Oryza sativa
  unsure (1)..(40466): unsure at all n locations
tttcaaacggccacccaggcctggctgatcccatcatctgtcaagtgttgcttaatgttgtatctgacggcggcggcgactggccggtcggccaccatggcgcgtgcgcgcgggaagcaacggcgcgcggcgacgatttggcggcgtcggcgggaacggcagcgagagtggagagggagggctcggcgcggctcacgggcagagcggggagaaagagagagagagggagagagagatggggagggagggaaatatgggcctaaagggaattcggcccatcgaacccgagggaggcaaaatagacttttgcagagggaattgatttgggaaggatttggattcgggattgaacttgacgatagatcggggattcgagatctgagatggcacagacactagacaacaagcaaagaaacagatttcgcaattagggtttttaagagatagttttcccgctaggcgccatgacggaacgggcgctgcacggcggcggctctcaccccagagatgcggcggcggcggaggaggcggaggcggcggcgacgacgacgagcgcgagacgacggcgagatacggcggcggcgtcggcgcggggatgccctaggcagtggcggcgaaggagaagccgagagagattgatcgggcaaaaacttctaagtgttagtggagaagacgagggcgcgcatcgggaatatatatacccctagatctttagtcccggttgatgagaacaaccggnactatagatttagtcccggttgtttagtcccggttgttctcatcaaccgagactaaagatcttttcccgctattttcaaattctttttaaacccggttagggttaagaaccgggactactgataagcgcactgaatattattttccattacatatgtgtttctaaaatagaagataatgcattacaattatttaaagtacaaagattaatgacaattacttcgaaaaattactgttgtctgtaataaattaagtggataaatcgtaataagcaaatatatgatttagaattaataaaaattgtaataatcatatatacttagcatatgaatgatattattaaattcgtaaaaactctaattaacatatgtatatacatacggcatgatttacaattaataaaaattgtaatcatcatatatacttagcataggaattatattaaattaattgttaaaaactctaattaacatatgtaaataccacatgcatgatttaaaaattttaaaaattcgaatagtcatatataattagcatatgaatgatagtaaattaaattgtgaaaaactctaattaacatatgtaaatgccacatgcaggatttgaaacttttaaaaattctctagtcaattataattagcatatgtaaatgccacatgcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataatcgtgcgtaattaacatatgccatacatcaattgatttatatggataatcaatacatccaaaatagtttacatcgtgtacacaataattacggcaatacatcggcggtgacggttgaccgcacgtactttctcctcactattgttcccttcttgtgatcgctacgtgagtaaggggtgtcttcatttgataggaggatgctagggtcaatcgtcaccgtgaaagggggttgcccatccaactgatcgtaatcctcgtcagtcttgtcctcaactccgacgatttttcttttgcttgggagaaccacatgacacttaggctcgttaggccatctgcccttctttcctttgctagacatgtccttcacgaaaaagacttgcgttacatcattggcaaggacaaaaggttcgtccgagtatccaaccttgttaaggtcaaccgttgtcatcccactgtcatcaatcattacgcctccaccagtcaacctaacccattggtaccggaacagagggaccttgagaggaccatagtcaagttcccatatgtcctcgatggcaccgtaatacgtgccagttgttccatcgtgtcccatggcatcgacacgaacagcgctgttttggttcgtgctcttcatgtcttgggctctcgtgtagaatgtatacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccatgtaatccatgcatcggacttaccgatgttcctggcgcgaactagagccaagtgctcctcgacataaggagctaccaatgaagattgttgcagaaccgtgaaatgggctttacggaataaatcgttgtctaccgtcattattgctttccttccgagagttccctttccccgtagtcttccttcatggcgtgattcaggtaccccgattgagcgaagatcttcgataaattctacgcaaaattcgatgacctcctctgttccataacccttggcgatgcttgcctctggacgagcacggttacgaacatacttcttcagaatgcccatgtacctctcgaaaggacatgttgtgtaggtacacaggcccgagaatactgatctctttcacaaggtgacaaagcagatgcgtcattatattgaaaaatgaaggtggaaatatcaactcaaaactgacgagacattgcaccacattattctgaagggcttctaatctattcggatcgatgaccttctgcgaaattgcgttcatgaatgcacatatctttgntatcggtgcccggacattgtctggaaggataccccttattacaactggtagcagttgtgtcatcaacacgtgacagtcatgagactttaggtttgtgaacttcttttccttcgtgcttattattcgcttgatattcgtggggtatccagacggtacctttatgctctccaagcattcaaacatactttccttctctgccatactaagagtgtagctggctggactcaagtaatggcttcctttctcctttggttccggctgaaggtcgccgcgttcttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaattgggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggttagccttatgttcgaagtgcttgcctttcttccgtaccggatggtttgctacaaggaatcgacgatgacccatgtaaacaaccttcctacagtgcttaagatacgtactttctgtttcatccatacagtgagtgcaagccttgtaccccttgttggactgtccggataggttgctaagtgcaggccaatcgttgctggttacgaacagcagcgctcgtaggttaaactcctcctgtttgtcgttgtcccacacggggacaccttccttcttccacaacagtttaagatcttcgaccagtggtcttaggtacacatggatgtcgttaccaggttgcttgggcccttgaataataatcggcatcattatgtacttcctcttcatgcatagccaaggggggaagggtatagatacacatcgtaacggggccaagtgctatggccgctgctcatctctccaaaaggattcatgccatccgtactcaaatcaaacggtatgtttcgtgcgttctttccaaattctttaaattttctgtcgatgtttcgccactgcgaaccatcggcggggtgtctcagcatcccgtcctgttgacgctcttcagcgtgccatcgcatcattctagcattccccttattcctgaacaaacaccttagccgtggtattatagggaaataccacatcaccttagcaggaattctcttctttgttagctgcccgtcaacttctcctggatcgtctcgtctaatcttgtatcgtagtgctttgcaaacagggcatgcttctaggttctcatactcctcaccgcgatataggatacaatcattcggacatgcgtgaatcttctgaacttccagtcctagcgggcagactatcttcttagcctcgtacgttgtctggggcaatttgtttccctccggaagaatgttcttgacgagtttcaataaatcgccaaatgccttgtcactaaccccattttttgccttccattgcaagaactccagagtggtatccaactttttgtgcccctgctcgcaacctgggtataacgaagttctgtggtcctctaacatcttgtccaatttatgggcccccttttcactttcgcagtcctccttggcatcctgcaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaataccttgctctccgtgggatgtccaacaattatagcttggcataaaccccgactcaaacaagtggaaatgaatagtcctggatgcagaatactccttctgattcttacacttattgcatggacaacaaataaaacccctttgcctattagcttcggccactctcaaaaaatagtgcacgccgtcaataaactctttggaccgccggtcagcgtacatccattgccgatccatctacatgagtcgaaaaaaatcgtacacaaataattattcttacaataatgacagtcatacaataattataagataattacaaactgtttcaacagtcatacaataatgacacatctttattcatacaaaaatcataaaatattacaccaaataattcttatttactatttctaaagttttaaactaattttaatgtgttttacttcttttaattttcattttagtttgtttctagtattcaagattaactttcactatagttttccttctcaactattttataaaaccttctttatcaaatcaactaaatttgtatatattctttctaacccacacaaattttctctctcatcaacttacaactaaattttagagacaaaaaagtgtgcaaaacatactgcaaatgtaatatgacaaaaaaaacattggaggatgaagttgcaaactttttaggcacctccgatttgtatgtaattaccaaaataaattcactagaaattttggcatgacctaccctcttttttgaagaaattttgaagcttgctcgggcagctggaggaggaagaagacatatatatataggggtgggactttaattccggttggtgttaccaaccggggctaaagatccccgagatctaccaaccgggactaaagttacgatcactaaagatcccgggggcctgacaggccctgacagcatttgaaccgggactaaagatggtgaccaaccgggactaaagatcaaatatgcccattacccttttgaaccgggactaaaaatcatctttagcctcggtttttattgcatccgggactattgtggaatttggccgaccgacgaaagatggtttctccaccagtggatcaaagactccaagtagcctagtataatatttagcctgtcaatcaggacaatgacatgtcagcaatgaattcaggatcaaaatgtaggggttttcttgagaggtgaattatgctaacggacaacttaacaatgacagtgacagaccagtgcagctacttttcatggaaacaatggcatctattgcttaattaatgacaatgaaaatattgcttgattctgttcagacctactggattgccatgaggccatccacactgcaagagttgcactcccaagctcttgaacatgtcacatgtaccgtgtagaacagcgtaaaccattcaaggcacaacttttacaatgcataacccctctgttctttttcggtgttgtattagaatacatgcaaacctcaaaaatctttaccagctaaaatatcgaaaaaaataataagatttgatatgtggaaatgagtttgttaaatttggcattttagttatatttctactaattcttatagatatatgattagacaaagagaatggtaacaacatgtgcatttgatactctctcagttgtactagacaagtaaaaaagacacaagggagtacaaatcagtcagcacatatttcattttggcacttgatatttagtgccatctcaccactcatattatagttttattattgatttagggtccgtgcggctgccctcctttggaatcactacgaagcagggtttaatctttcggtttggtcatttgtatcggggtggccgaaataccgaatttttggtctgaaattatatgaattattgaataaaatttgatcaaaatattactaaattcacgaaaaaatgaaaaaaaataaaaatttcggccgaaataatatcacatcgggaggtccgatagaacaaatccaaaattttgaaccctgctgtggagcaaggttccagcttaaaaaaggaaagaagaagaagaagaagacaaacagcggaatttcaccgaatttgaatgaaaattcaaaattcagtttgaataattctaccaaaaatagatcgatgatcataaagataagtaaaatccaggagaatcctgtcctccgggctgatcgagcctatgtgaggggatagggtttggcttctcgagttttggtcttcgtggaccgtctacaaattcaacctcaacaaacgacaaaaatttggggaccgacaaatctcgccagcttaactgattaatgctaattatacgtgaaaaagactttttaaaaaaaaagggggggggggggagggagatacaatagtcgtcagatactacggctgaataactcgtacatagatgaatccatatgcgaggggaaaacatacgtatatatggtttctctcaactacttgaaatcttgaattaacctgaacgccttatccgaacaaaataataaaattgttaatctcattcaacttcagcgactaagggcacccacaatggttatctataggctctctataagagatccatgtcagcatattttcctacttgaaagagattaaataaaaagagagagcaaagctatctactaacctggagatagtctatagagaaaaacgaggcaatgtattagagagctatagatacccatatagacatactactgagatggttaatattaatctagtctattgctgagatgtacatattttatagatagcaccttactttaccattgcgggtgctctaattgttataattgaattcagagagaggcacagacagtgatagatcctatcattaattaattcattatgatagatgttcttcatgaatgcatgcattcgaacgtacgtacctctggttagtagtggatttgaaaacagccaatacaataccaacaagagcagccagtatgtttacgtttcgaagaacttggatgatgaacttgacctccattgggagccgtcttacttgctcgtccaagacgtaggttgcagcttcccagtatttcttacatgaactagccaagtcccctattatctttagacccggttgatattatcaactgggactaaaaattaacgcgtcgtatataatccctcacacttatcctctcctcctcgatcgcaaactcctcctcatctttaacttcctcctcctccctttcctcctgtctctctctctctcttatcctctccttttcttgaagcagcagcgaggagcgagcgaaagcggcacgcgcgcgggggcgggggcggggttggggggcacgtgctgggctggggaggcggcgggcggtggtggagcgatggcggatgggcggatttacaatttgtttttgtatatttttgttgaatttgtttttgggaatttttgatgtgaatatgtgatgtatgtgtgatgtttcttttagaatttgtgatgcatttgatctatgattcggaggtgatttggggttttcgtgatttggggatggagtgaaatcaatatgcaagcagttaaaattaatgaaaaaaaggaaaaaaaaaatatctactcccgattagtggtaacactaagcgggactaaagatccatctttagttcccgttatttcactcgggactaaagaaatgcatctttagtctcggattagtagtcccggttacaaaacaggactactaggggttgtgaaccgtggtttaaaaccacttctccaccagtgatgggtttgtcagaaatgaaatttaatcaatacaaataatggaattgactaaaaataataataaaagtaattaactcagagcattatgtatgtatatgagataatttagttaaatcaaaaagtaatttatatatacgataaaagtatatgtcgacgagtgatactcgtggaccggatgagttgagcattggaggacatggtagtcgaggtcggagaggtggacgatactcatggtgggcagggccgtcgacgggggagtgcgaaaacgacgaccgcacagggcccccaacttttgggggccccacaccaccatctagggtgggccacatgcctggcgatcagctaatgagagctagggtagaagcaaagccaaggcatcgcaagcgtcaaacgattggagatcgcatgcgtcagttagatcgaggtgtcgcaggtcaatgaaggagcagtccatcctataattcccaggtattgtgcgtgcgtgcatcgagacggcgagggcgcgaggcgccgcgcagctggcagagcgtcgatcgagcgggcggcggtggtggtgcaaatcgtggcaaccatcagcgaggaggacagccggaggcgagcgtggaggccgagcctaaagcaacttctagcgggcgcttgccggcttcactaatcacttcatcaggtaatttactaatttgacgaactactgttacagtattgtgagtgaacaaacaattgaatggattcctgattgaatcaaacacatgtctttgcttttgttgataaaaaaataatagatttgtttcgtcaatcacctcatcatgccttctagaaagataaagtatgattcgggtgctgaaaatatgtcttcaacattattaattatgaacaattaaagattttatttaaacaacactatacagatgatgattttcggtagaacagcagtgatacctactcttttagcattaatatttgatatatttttaaacattgcacgaaataatacatactaaaactgaaattatgccctctatattaaattagatatatgaatttttttaaaatttagagctttgatttgtatttcgctccgaggccttaaatttctgtagacggccctcacggtgaggtgcaagatggacaaggggttggcgacgttgcccaccagccagaccgccaagtcgcgcagctccggcgtgacccggccgctccggcgcgccaccgcgtagccgagcagcagctcggcgtagagcggaacgagcgccataacagcctcccctaccaccatattttttgcaatgaaaaatggttccccccaactaggtaatgctagtagtattttttccaaggaaaatcctgttcgtttccactgcaagaagtggatgaaattttggatatttgtggcacgctttttaaactgctaaactgtatgtttcataaaaaactttctatatgaaagttgctctaaaatatcagattaatctattttctaagtttgtaataattaaaactcaattaatcacacgttattatcaccttattttacgtaaaatacataatttttatcttcaggagattcaaacaccatctagacattgaaaatgacacggtgcttggtagcagtcgtcgtatgtttgacacgcaaatccccttccgtagctgcatcgatctgcttggtggtagtagtatgtttttgcatcggtctgcttggtatagtagtagacagtagtacctggtctgcttgatttttaatagctctttatataatttttaatagatcattttggaatgggatatgcatatcctattctggatcaaatacactttcgtcctcgcttcgtgtaaaagggttaacccggaagtgatatgtttgaaaggaagagcacttataagttgattttacccttactaaactaataaggtggtactaaacatatgcacacaccttcatgagctatactgaccttatcctaagggcaagtgttatggtagatgtgactaccacatctaaatttatccacatcatttactcataaattaagaggcaatctatacactatgtcacctctagtacacaaataccaatgtctcttatactctcacacccctcttaaaatttgtgtggaggttgcctcttcatttaggggtggtttaccatttctctcctcacttatctcctctacctcatcactcaatccaatatggcacatttaggggcagcatatgaaacattataatacttgccctaattggccaggctatcacactggaccgcaccagaaacttcatcaaaaaggtagagaggaacaagcgctagaagagctacccctactgccatattatttgatctctctctaggcgtggaaccctgccctttttttccccatttaaacgatgattttttgtgcgtccaaaggttggggaacgctgattttttgcacgatttttgcatggtaccgtatcaatgtagaagcgttgatttttttttctcacgggattttccatcggaagtgcgcgcgattttcgttcgctatgaattgaacgaaagttaaaatatatagtgcccacacttaacaaatttgagaatttgcatgcctgaatgcccaatgtgattaggtttcagatgattacttctaatcaaatgttaatcggaacataatcttgacacaccattgcaatattgcatcgctccttaaaacagatttcttttcatgaatgcacaaaaatactatgcgtcagtatattagaagaaaatagagttttagtttcacaacgcaataaatcagatagacccttgccgcatgcaaggtaaaggaccgcgaagggaggaaaaacaagctgaaaatgctgctcctataaagagggagagaggtggtggagtaactgctgccctatgttcccaacaggtccccaaatgaagcggcactagcaagagaccaaagacgattcttctaaaggatggactccagaaccaccgagaccggcgaaagggacgaatcaaaaacactggctttccgctccttccacagctgccaggataccaggaggaccagagtgtcaaagcccttgcgaagacactttggtagacaggccctagaagacggccaccagacctaaagagagcagccatgggaaggggcgagccaacgccaaccagaagacaggacgaggcgccagacttgacgtatgaacacacagtgtaggaggatatggttcgtcgtttcaagctcctgggcgcaaaaaggatgaaccgagtgactatcgatcacgcccttttgcaggagatcggcaagcagcaagataaaacagaaaacataattagatgaacgatagccgatcggccgatagagccgatgacgtatcgtcaggacccagccgatgcagttaaaccaaatcggttgtggcttttagatgaatagataaagtgcaaaccctaaatatgccctaacggttgtaataccatctctttggtttttgtcaatcattttaagacagtattataaaaaatagtcaatagaccagtacttagagcaaaaacaaataatgtattgactaatactctaatacagacttatataaagaaatcaatctatataaacgtaccaaataacaatcgatcaccagatataaagtttaagagagatcaatctaacttgatgcatttatataaatcaatctatctatataagtggcaaatattcataaacagatcatgaaacatgcattgtcatgtatattaggtaagatcggctgaaactccgatactatccttaattatgattaactccggattagtttctatgattctaagcacggctagggatgatgcatcacaaaatacgcagagaaacataaagtcaaaacaatcaaggagttaacaacttttcgggatggtagaaccttagctaatctaatctagtaagacgatttaagccaataccgacaaaaaccctaaaacgagaatcaactgatatgactaaattgagatactaagactatattaactaagatatgtgataaaaatgaccacaataaaatgattgatacattaaaatgatataatagccccgatagcgcaagccttcaagacaagttaccacttgtcgagagatcgcagccgataccccgacttgaagcaagaactcgttggaaagtaaaagaaaagagttatctcaattgaggcccaaaccaagataaatatcctaattaatagatacaattgccttagatgagatctatctctaaacggcaatgatagttatctcaattgaggcccaaaccgagcccaagttaggctgtatcggcttcccaccagatcggctcaaccagattccgactctgtttcaagtcgatgcgtagtctgttttggcaaaaatcaatctcctttgattccgtttcgatatccaactccaaatccgagtctatcttgccaaatttcactgttaacacatgctcccccaattccgatgtgttatataacacagtggaattatctctttcagtccgcaacttgctagtgttatcctttcgactattaagcacatgtttacaaataacaaccaccaccctaaaaaatttcacaccgttacttccattttcaccgctcaagccacgcaatcttcttcaagaagctccgacgatttctccagtgttccattgatctactacgaattactttgtaccgttcaattgttttctccttttttttaatgacaggtcattgtggaggttcaaaaggaataggatacaagaaactttggtaagtttgcggtttcatgtgcaaggcaagaaattgtgcaagtttgtggctttaatgtggtatgaatgtgttgtgcaaatatgtggcatttgaactgcatatgtgaatgatgtaaattttaagatgcatatgtgctaaaatggggaatatgtgatatttggggtgcctggcatatatttgtgatgtttctgtttttcagagggcgtggctagtaaatcctgaggctagctaatattctgaatttgttttttttttcgaatttcacctcatcactgatgggtcataacaaaatccatcacaggtgacctcatctgtgacagctttgatactataccccgtcaaagatgatatacctatgacaggccgaatataatgcacccgtcacagcctcaaagataagtcacctgtggggttgcaaccacggactgcggtgtggtcatcatcacctgtgacgggctcggaaatacatgcccatcagaggtgactgatacctctaacgggcatgaaatacatgcccatcagaggtgattgatacctctaacgggcaccatcaaaggtgactgagactcaacagtgaccattagtctctgactaggcccaaaccggcccttcaaaggtgatggttaggacccatcacaggtgacctaatccggtgtagtgaggcttaccctcgtttctgtactatgttctatccggccggaaagctaatcccatgactaatttggctccaaattagttacgccgtgcattcatgcagctcgtgttgtatcagtcgttgagccattccggcggctctctttatttacttgcggtgctgatcgctgaagcaacacagaccggcccatcagcgaaccacgcgatgttttgtagccagagtttttagataaaaggtatggcaaagtataacattgcaatgcttttttttttcatttttctgttctggtccttcccttctctgttactataaaagaagccaaatgtgatggagcgccagatgcaacaagagaaacaagaagcagtcaactgaagatcccatttttatcatcaatccacttttggaagctgagaattccgttaaaaattaaaatcctctagtggtatttaacaaaggataacctagcaaaacggagatggaatggcgacgatgttgggtgctcttttgtaatcaagatgaaacgatacaacatcttttcattgattgccatatatgtggttagatgtgtttcaaatgtgtcattttcattacctttctggttcaaaccgcctcataaggttgctaacttgtttggagtttagttcaaaggtttggattaatctaggctaaaatactaaatctctttatttggattgcagctatatgttgggcgatgtggatctctagaaatggcattgtctcaatggcataaaaatcaacttcgttaattaaatgtcattttcaggaaaatatattgaatgagacagtagtctgttttattaaaagagggagaaagcatcttgatgaaagaaggttgcaaactgttggagactaccgttgtgcacttctttgctaagggttggaacatgaggaaaataattgaggggtatagtttgctggcttttcttgtttgcagccgtgtatgtcctttggtcgatgcacttcgttgttgttttgtttcgggttagagccttagtgttccctttcagttgtgatcttgggtaaagttcaaacttgtactgaaggacctcctgtgtttgtgtacagccttgttggtgtagaggccggatttgagaagaaaataaagttagtacatatagataaaaaaaaacaatttgagaagaaaataaacgtgaacgtgggctgtgaggcccatctccctgaatttggcttcgaccagaaaagagagaggaggcctacaaaacccgacataaaagtgtaaaaagtatacataaggtccctcatcttgtttccaaattacaaaattatccagaaccgaaaaaatatgtgtcatccctcaacttacaaaactgaggcactttgtggcaaaaccagatatgtgtcatccctctccgcctaaaaaggagacgaccaccttaggacttgttcggttacatgatgattcaatcctggctaggagtgacaagaatagtaagaaatttattatagatacaacgagagatcgggatttattccggaccgcatgatatggacaataatagaccgagaatcaatccactagttaagagttgtggaactaatccggatgttttattataccagtaaattggttaccgatccggaataaatcctccggcatgaggaggaggcggcggcgccgcacgcagcacgccaacagcaagacgaacaacagcacggcgtagggcggagcaatatcctccgccacacgccgacgccgggcggccatttcccagctcaccctcgccgccatgttttgcaggcttagcttttgtttcttctacctcaaaaccgggacacgttcttcttcaaggagcttccaagttccaacaatgggacctgacgcttcacgacacacgaccaccgagaactctcggaactgaaaaagagcacaaccaagatgaacttaactcttaacgacctcaagaagaccagcaccgaacctggcaatgaagttgaagggcagcaccgagacaccaagatgaccggaaaagagcagagaaccaccaagacgaacttgaacttccactaagacacacttgacggcctgaagaagagaaacacgtaccacaaagatgaacttgacgacctgaagaaaaccagcaccgaactatctctatctgagcaagttggagagcagcacgagacaccgacacgaatttgacgacatgaagagagcgcagggaaccacctgacgatgaagaagagaagcaccgcgcgccaaggcgaacttgacgacctgaagaaggccagcaccaaaacggactctttcaagcaccaccgacgggagctgaggaagaacggaatggaggacggcggcgaatggaacagagcggacgatgaaaagaaaagcctcaaaatgtaaataaaaaaaattgatgcatcccagcggcagcacgccacctatgcagcaccgctctcgatggacgacgcgtgtattacgtacggatccgacggggtgctccgctcgggtgtggcaaattggcgcggcaacgcgtgcgccagctggccccctccccccaagtgatttttttccttttctttcttttcacgatttttttttcttttctttcctttcacgatttttttaatcttcaacacatggttttcaaatgttttgtgttgaaaatttttaaatcttgacttgaaaattttcaaatctcgagttaaaagttttcaattctcggattgaaagttttcaaatatcaagttgaaacttttcaaatatgagttgaaaattttcaaaatttatctttcatatttaaatttcaagttaataaattttaaagtttaagctgaaagttttcaaatcatgagttgaatattttaaatcttagttgaaagttttcaaatcttgatcaaaagttttaaattttcagttaagagtttcaaatttctaattgaaagttttcaattttgtgttagaagtttttaaattttgagtcaaaaattttcaaaataaaatgaggttgaaacttacctagctatcttgcgaaaaaaagagaaaaaatcgcgtgagaaaaaggaaaaatcacatgagaaaaaaaattgcacgcaaaaacgaaggacggagagggagataagcacgtgtgaaaaaaaatcacgcgaaagaaaggaaaaaaagaaatgtgctactgcagtgtagagctgtaggctagagtggggcctagtggatccaaatcacgtgcgagttagtttgctcgtgcgtctgtgtgagataggattcctcgctccgcttgacttgacgcagttgcgaatataatggccaaaaggtccagggcccgacatcccgtcccatggcacgaccttttggtccggccaggcacgacatggcctaattggtgtcaagcctatgccggcccggcctgacagttgggctgagcctgggggcgctaccttggcacagtgggctggcttcgcatggcacgacacacgagggaggcgaatagacttattcagatgtgtataaggcagtccaaagaggagggaggcaatctagacttattcaagccatatatagggcacaacccaaagaggaggaatgcaaaataaacctattctaaggacgagcacagtgtgttggtcgtgcctacgtgccggcccagcatggtccgattcttataggactgtgcctaggccgtaggttgtgcccgtgggcgggcacaacctgacccggtcattaagcgggttgtgcttgcccaacttatatcgggcctaggcctggtcgtgcacgggccgggtggctcatttggtcatctgtagttgcgaatcagcatcgctcctctcgatcggctccctctgacttgcttgttccattcgaacccatcccggcttgcacacatcgacctctccccacctcctctcgaacgatccagatggccaggcgaaccccgacgccaagggcggatctactatgggcacggaggggctcaagcccccacaagcatcgttagaactatgtaagccctcactgagtttcttataaaatgagggttaaaattatgtctagtttgttcagccccacgtgttacttcttctatcctccattgtcagtgcttacaactgctccttttgcatcatgggcatcttcccgtccccggtcgtgtgggcagcattacagcaacacgagtttgtcctggaactggtactcgcccaacatagtcgccggtgatgtacgagtactacactataccgcctgctgacgctggtcgtcgtggtgttattcttggtgctggcacacgcgctctctctctctctctctctctctctctctctctctctctctctctctctctctctctctctcatgaaagcggagtgtgcatccatcaccatttgcgaagatgacctttgattattattttgtgattagaaaaaaaggctcgtgcgttgaaacgggtgaaggctattttaatcgtattattgttattttttttatctaaaaagtatatgagatttctattttgatagtattgatatctaatttagaacctttgttgggattatggtcatatactgtacgttgctttcttagggcctgacaagaattctaaagcaattagcggtactcgttccaagttagctgtgagtgttttaaaaggatttcttatacgactcctggtgcattttcaaaagtgaacgaatttaataaccaactcaaatacggacaacgtacaaagtattggcggaaacattttcaatttttataataatagagaagagatgaacaattgattttgaagataattggttttgaagattttctgatgatgaattgacctgacgatgaacaatgagttttgttagtttgggtctggtcagaccgacgtgtgttgtgcagtcaaatcggccagcccgatggtctgatcggacggctctgtgtcggttctggtttcggattgtttttttatacttgtgattaatttatgtttatgaattctagatgaatattatgcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcaggatatcatggttggtgaagattccatatggtataccatgaagatattgtgtgcgtatggatgcggagtccaaatttggtatgattgtagtttataaagtttgtttattgtatgggaaggtttcctaggagattaggacttcttgtacaagttgggtttgtggttttagactgcttacttcgagtataaatagagagggggttgagacttcccggcatcgattttgtgcaagttgagtttagaaaaaagttagtattttgagtttagtcgagatttgtgagaggagtgttgttgttgcactttgtaaacatgagtagaagtaagttcaatctacttttgaaatatcttcaatttgtatatgcttgggttcggcggtcacaccgacagcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcaggatatcatggttggtgaagattccatatggtataccatgaagatattgtgtgcgtatggatgcggagtccaaatttggtatgattgtagtttataaagtttgtttattgtatgggaaggtttcctaggagattaggacttcttgtacaagttgggtttgtggttttagactgcttacttcgagtataaatagagagggggttgagacttcccggcatcgattttgtgcaagttgagtttagaaaaaagttagtattttgagtttagtcgagatttgtgagaggagtgttgttgttgcactttgtaaacatgagtagaagtaagttcaatctacttttgaaatatcttcaatttgtatatgcttgggttcggcggtcacaccgacagcattgcggcagtcagaccggtggctttaaggcggttagaatggcggcaacgacaagcgacatcagcgcgatgtgcgggtagaccgaagctacttcgccaatcagaccggaggtctccgtgcggtcaaaccggtgcatctactttggtcagaccgaccttcatcgtttcgagagtaacttttaattccgctaaaagttttgatttgtgagtacctcaaccattcactcccctttggtggcttagttcttgctggcgatcttacaaacctgtgatctcctgagtgtaaccaaggatccttgatcccggtgccctggagtgaaatttccctagcgaatacacaatcgcacgaaagtagaacgaagagcacacagatgaatttggcgcaagaacttgcattctacttttcaggttttctctccttttatgagtactaaaaagaagtggctttgaggccgacgattgcgcacccacgaacgaggaattccacagcgggtccgacggaagggcattccaccacggtgccatcaggggcagtcccaaatgggactccggtagaagggggaaccaccacgacgctggtggggcaggctacggtagagtgcggtggtggtggggaagtaagtcgctgtcgggaaccaccacgacgtcggcgggggcatgttgtgctggattgcatcggcggtggggaaggacctcgccgtcaggaaccaccacggcgcctgcggtgaagtgcgtcggtggtggggaaggaccttgccgtcaggaatgaccacgacgtcggcgagggcaggatgcggtgtagcgcagcggtggcggggacaagcgaggagtcggacggagcaaggacgtgcaacggcaagtagcgcggcggcagaatcatagcgtggggaaagtgcagtggtggagtcatagctccgtcgacggctggggatgacctcggcttcggcagcggcggaagggacgaccacggctccggcggtggcggaaagggtcagccacagctccagtggcagctggggaagacctcagctccggtgggggcagcggtggagtgtgggtatggcggcggctagagaagaactcactccgacggcagcaatacacgcgaggaggaggaggtgagaggaggagcgagtactgcaaaggtgcagtcttcgtgcgaacatcttcgtgcggtgttcgcacggaggcgtagtattcgtgcggtggagatggagagggttaaatcgcggtggacggtagggatcagatcagggcaatacagatgcagatggacggcagagattacacatgttggattggaagggtaaattcttcctttttatatcttagtatagaaaagggtaataattaactatttgtcacttaccagtaacaattaaggatttgccactaagctacgagtggcaaatccttaatagccacatcttaaaagtggcaaaaagttaaatgcctctaaaaaacaggtaaaatatgttctagagatgttgtttgttataaattgataaatgataaagaataaaatggaactaggatagtcactctcccataagaacagtagaggatttcaattgagagtatccaacaaggaaaaatggcgttatgctccgatggaaataaacaaaaacttaggaggaaaaatcaccccaatcacatgattgcacacttgaatggagatttgccagtacttctggcaaacataaacgaacaaattgttcaatcatggagaacgaaaaaccagaaagttacaagtgaaaactccatattcccacaaggacttgtttaaaaaaactagaaggggttacaaaaggcacagccgtatatatcttgttgcaaagaaatagtgaattgtgtacaacagtaagaagcctgaagatcgcatcaagaaccgacatggacctgcctgtaggatgttgcaaaaagatgagggtgcaaaaggagaggcgtatctgtaaggtatctggaaactgagggaaaaagtgcaaagctggaaggacctggatgtaagaaatcagagcccaggggcatatgtgcaacgaaaatgaagaacgcaaggacctggccataattcgatatctggaaactttgagggaaaaagtgcaaagcttgaaggacctggatgtaagaaatcagagcccaggggcatatgtgcaacgaaaataacgaacaaaataccgaacgcgcaaggacctggccagaattcgcaaaaaaatttggaccatttctcgatttgtgcgtgtcatccttgcgcaggggccatgctaatcttctctgtatcgttccaattttatcggatgtctccgaagagacaagctgactacagcgcgcgggtttataagctggttccatcgtctttcggtttccgatgtggtactaaacatcccccgcaacgccaccgcgcaaaccatcggatccccatccaacggactaaagtgggtagcagcgccacccgcgcggtacggcgcgcgtgggctgcaccttccgacgcagcccaaatcaggatacggcccattagtatatattctcctcctcccagcccacatcacatgcgtttcacactttcgcctgtaatcgctcaagtagtcaagtatgagctctgtctgcacgaactgattgtcactagtgtaccatcaaactactagacgtgacttgtgataatctcagacgcttatggagtgaaacatggtaaaaaaatgcgtttatgtgcttgatcactttgatcagccttgcctccatcgtctgaaacatgataagaagacctttgttacgaaagtgtgaaacgattctgttattccttcggctatgccgtaattcaactttcacaaaatgttttcccaaaaactcgctgacagtgtcgacaacatctactgcgaacaaaccacgaataatcaaatcatgtactcaacgagtcagtaaagaaaccgtttgaagcaagtggcaaattaacactagctgaagcacgataaggattcacagagctgttattcaaaagagtaagaatgacatcaacattcacataatccgtcactccctagaacattacactcgtggaacaaaagagaaactcaagacgaggcatttacacggacaaaatccaacggaggaaagaggtgaagctacccaccatccctcttgaggttattcacttggttcacttcccttggaacttcgacaaaaagttttgaaacgaggaaaaaccctccattgcctcttgcggaagagggagcgtgaagggaggaagaactctgtgtccagccttgagatccttcgtgccagtgatagatggacgagcaagtgcaggttcctgtttattgagcatctctatgatgtatgagaaagttccgaaggtcaggcagctctgaatcattgtttgtggtgcacctggaaccaaaagaagaaaaaggaccatcagttaatgaataggtacgaaactatgatctttttgttaacattttcctatataggaagaaccgataatccgatatcactgttaatagtaatgttatcatcatgcgaataaggagctattttgtcacaggacaaaagtgtgttctcaataatgataagaaacactcatgatctcacaagaaattgtcgattttgtagtgcttcattttaccagtgcaaaaatgaagacataaatggacaactctaaatgcaaaactgtgtgcacaccaatacagcaaaagacaagaaaaatgaaatatagaacaaaaataataacaactgtagtgaaaataaacaaatatttcaggtgcatccaaaccaaattagtttaggacgcattatcaacaagataggagataaagatacaaatgcctatatgaacaaactaagggaacatgaaaatgaaaaaattgtagagattgaatcatcaaacttgaaacggatgccagagattaataactcccaaaagggctgcatgcattcttaatgaacaatgtcaggaccgtttgagatcacctattccataactcagcataatgaaaattgctcttgttgatattaataccagtcctagccaggacatccaggaacaagttgtaaatttaaacagttcacactcacagctacattgtgtgtgtaacgttacctggaaaactcagggcaaggccagtgcaacagcctgcaattccagcattgagaactgcagatataaaaggattcacaagttaatgattgtacttgacatttgattgtagtacatcctaaggattgggacatggtttcctagagaaagaaatgagcacaatagatatcaagactgaccatcatctttcccacgtagttgtctcaaagtgcaggcaaccaaactttgaacaccagcaagaacagcaaatatctagagcaaaagacaaaataatggcatgagctgtgaacaatgaaacatctgctgcaaaatgaacatgtgtaatgtgaatcattaccttagcagaagatgcagcatcagcaaacgagcctttaaaccctttagtggtgaccaaaccttttcctgtcaagttatcagaaaaggcgagttggaaaaaaatattttgtgctttggcccaaaggacaacaggcaacaggatggctaacagagtacatgaaacaaggaggaacgttgaccttacaatgaaagtctatgatccacttccatataagttccattgaaagcattaacccaagaggtaaatggtaatgaatgtgattgtaggtcaaggcattaagagtttacttaaagtttatctaagccttctggctatccacaacattcttatatggagcatgcaaggaagccatgtcaatttatactagttaaaacagtattcaagtaatctttacctattataaaagttaaaggtgtttttgccagaattttggtacgtcatccgtgtttgaaacggttttaattttatatttcggttttaatctatatctctacaagaaattcccgtcttctgtataaaagaaagaaagaaaaagtccgactcaaaaaaggtaaataaagaaagaaaagaaagtccgacataacgagcgattaaaaaaaacttcttcgtcgtcagtaaaaaaacatctcttgtccgactcctgtagaaaaaggaaaaaaaaatctcccagtaaaaaaaagtccgtttggtttttttggcaccggtattttttttcccttttttctttgcacgcaaaagacttttttacgcgcacatgctaagtcttttggttttttgtcccttttttaatccgatctgttcaccgtgcgcctcttgggtgcttttagctttttttcgtcaatcttttttgtcgccagttttttctcccatgtgctttttgtttttctcatccggttttataatcccatctgttcgccgcacgccttctgtggtgaaccttagcgccgcgccgccgccatatcgatcgtgtgttttctcctccaatttgattgaaaaaatcgattccccactcctctctcatcattttatccatgattttccctacgattgggctttaattgccagatttaatctatgttctacacttgccgatgatgacggcaatcttccccagtcagttttatcccgagttttacgctctaattttggggaaaacggaaagagtagatcgagtggatcaaaaaccctcgaccaattttggttgaccaataaagattcggccggatttgatgggtagatttgctccggcaaacgtacgggcacgggattatcttcgggggcacaggattatcttcgagaggttgaagatggtagtcatattcgggaaatttaagatggtagggtcgaagagaagcagaccaaatggagggaggtagcggactagccgctgaaaaggaaggaaggctttcggccaaaaacccaagaaatattttcattaacttttttttaattataatctatagcaatcccaatgttaagatttttattaacattttcaattatagtgtatagtgatcccaatatttcaatttattacttagctcttaatgtatcactgaaaaaagtatttacccgttgcaacgtacgggcatcttttctagttaagataaaataatcaaattttccagcaaattaaggctggaaggacattttaaacattgtttttcttacacaagtcaatgtggcccaagattgtctaaacaagagagcacaaaagtggttttgtttggttagatgtattcagttatgttggctgagttgaacagatgatcgatttgacatgatgggtagcaagctggttttagtagagtgcatataacaggaccttctgatgcaccttaatccactttgatattcttaatccatggtaagaaacttaacaaggaaacatacatgctgggagcatcaccaactaaatatatgcatctaggaggaaagtagaaacagattggatagagtgtgtgcaaccgcaacttattttggacaattaaacagtcaaacaccagcatgcacatggcccaagcaattgaaccttttggttgcatcaagccatgataataagttagcactggcagttaagtaggaaataaatgtgtcatcaactcatcatttcatcgtgtagatcaccctttacttcatattcagttttagtcaacaaagctccagctttcccctaccccaaaaaagaatagcagtactgttgaaatgtcctccaactatgaaaaatggaaccttatcatttctccaaggatggttttaaaggtgcttccagtaaaacaacacagcatagagcatggaccaacctgacttgatttacaagaaaaaaaaatatgtcgacctttttcaaaatgagatgctgtggatgtcatgtgttgaaaaaggcttgtcatatggcaatataactcaagagaacaattttttggtgtaatctgcaaaggttttaacatataagggatgaagattaaacttgaagttcagggtggaaactgtactgtagcaggagttgaaggaacaaaactgatatgttcagttagatgagttttatggttgtggacataattaagtaatatgtacatcagcaaaatatgtacaataagagaatgcacaaggagaaccaccttcatttcaaacaaaacaacaacaaaaatatcttccggggtgttatttgtctggttttgtaagtatggggtaaaagcaaccggtgagaaatagacatcgagcaaaatcaagggccaaaaagatgggctctataaaaaagaacacatatgcatgcattccaccctgtacaccacttagtatcaatcaaatttaataaaaacacaatttcagcgctggtacattcctatatacagaccctaagctaaactaaacgtctcccactcgaaccaaatgttcctggaagcctctcaaaacccatataccgcgaaactaatccaactaaaggaatttctttcaaggatggtctgattggcacaattacatagtacatacagtatatctctactagactacgagcacaaccatgcaatattgcagataacaccactattataccaccagataccaaattgttccggccgcacgcccgcaaagcgcaatagtgcaatgcacagccaacttacagcaatcacaccgaattggagtattgaattgaaggaatctaatactactaaccactcccgtctcacaggtcgcaagaaccctaacctaaccggaacgggaacagggaagggtacaagggtgtcgttaccatatccgacgacggcgccgacgagggacccagcggcggactcccacgcgaaccgcaggaggcagaccccgggcgccgcggtggccgccgcgagcgggctcgggttccgcgacaccgcgaggcggctcaggatggggttcgcgcccggcaccgccctcctccccgcccccgcccccgccctctcgtccgacgactcagcgtcggtggtgtccccgccgtccgacgagaacccgtcctcctccccttcctccttcctcctcctcgcgtcgccgccgccgctcgccatcgccgcttctcctctctctctctctctctctctctctctctctctctctcgcgtgtacgcgcgcgcgtgtggccgtagcacacgcgcggcggcgtcacgggagggtgtacgtgtcacgtgtcggtgtgctgcagtggcagggagtggtaaatagcctcctcggttgatctaataagtcaaataataaccaaaatttaaactttttgaacttgattttaaagttatttaaatatatttttaacgtatattttttattattagcttttgagccactacaaacatatatataaaaaatttaccaatagattcttttaggccctgtttggttcagcataggattattataatctagattattaggagtatcgacgggtgatacccgtagaccggatatagagggtattggggtacgttggtacaaggatctacgtagtacgacatcaagcaaccaaaagacaagaattatactggttcaagccccttgataggtaatagccctaatccagttggtatgggattatatggtggaaaatacaggttacaaagggaacgatggaacttgtcagatctggcgagattgtagtcgagttggttcgacttactctcgatgacttggctcctcgtagacttcggcttcgtaggctgtgtgggttgtattggctctgagattcgatgtcctatgccctccccgggggtcccttttatatcgcagacctggaggtttccaagtagaactcggaggtatcagaccctatacgatacatcaacgacccagttctgtccgagtaggattcttcccatctgtagatttcgtgaaaggtttccttagaatatgcaggaaatatccgcgtgcgcgtgggtatgccatatcgatatgtaacgtatatcgaagggtaaagggtatgccgaacccgtaaccctgacaaggagtaactgaaacaaacaagtagattattatgctagattattataatctatagccagattagtataatccaataatctcctctatagccagattagtataattcgcaccgtcggtagtgtgtctatttaaaggaattttgggagcccattttgaagtccgccaaccctgttgaacacacaccgcctaccagcgctctttgccttctccaccgccgcaagaaaccctagttcactaactttggcccattttccggcgatctccaaacagcaatggatctcggcaaatcggcttccaccagcgcgacgttgaagaaccttcaggaggacggcgcccttcccggccgtggaagcatggagagagaagcaggaggtactaatcctcagcccatcttgggtcacatggttgcgatcgaagattacgttctctgcggttttctccctccgccttccgagtttcttctcctggtcttgaagttctatggtctttctcttcttcatttgaatcctaattccatcgcctttcttagtatctttgttcatctctgtgaggcctacattggggtagagccttattcttgatctcttccgcttctattatgagctgcgttggatggaacccaatagagtgtctggttgcgtcgggttccgacttcgtgatggcatgaagtcgcgttatgtccccttccagtgtcctttttcccgcagcaagtggcggaacaggtggttctatcttgagatcaaggactcgaaccctgtcttcgttgttcccgaggatcaaccggacaagattccagcctggactgccaagcctcccttgaccccctctcttcagtcgtttatcgacatcatcgatgatctccaagaacggggcttgtcgggatatgaagtcgttgcagacttcgtcggtaggcggatccagccgctccaggctcgggcccatccagcctataactattccgggccggaagacgcgacccaggtttctcctcggggtatctttctcgcattcatcttgacgtgcttgcgttcgcattccgcttgacttatcgaaggttggttctcgattaacaggtctgagcagcgaagtcgtggagcggcgcgtcggccaagtgatgatcagcggcccgaccacggcgagtgacatccccgtgcccctttgtgaaaagggggcgacggaacgcgatgaagccatcaacgtaagtgtattcgataagcatcttgcattcctcctttcgaaatcaccttatgacttgattaagcataggcccttcctttgactgacatcatcgggccgctcgcgaaccatcaggtggcgacatctctgaaggagaaggttgtcaaggaggcgtctgacgcggccaccactagcggtggcaatgtcccgaccaagccgaggaaattctcgtctatactcggacatcgtcgcaaggcagcgaccccctcggtaatttaatcttgtcattagatcatgcggcaaggagggtttttccttactctgtattgattgtctttcaggcctcggacgcgtctcctccacctccacgacgacaacgcattgtgatgatcggcgagaagtaagtagatagattcctgaatttccgtgcttctcattcgagcggtgtttgacccgtggttgttcgtagggaagcgcgggcgaaggctgcacgagctaagtctggaggagcttccagcacatcacctgccgcggcctcgacagatgtcgtgcccgcagccgggagccgggaagcgacgcctagcggccccgtcagcgatcctgcgggaggtcgtggtctgccagctgccgtcctcacctgggaggagctccaagtcgagatggggcgcctcctcgaagctggtgctcgcggcatcgaccgcgagattgcggaggcgaggtcggaggcggcgacggtgaacgcgcgtgctgatcgactggtgcgcaagttggctgaagcccatgaagacctcacgaaaatgagggagctggtggccggcaacgagcgacaacggaaggggctcgaggaccgcatgtcggaactcgggaacaacctgtccaagatccggggctcgttgcgggtcacctacactggactccactagctcgccggggagtgcggcatcgagtccacaatcccagtgaatcccgatgagttctctctgacctcctcccttgcggaactggcgacggcgatgggggagatcccctccaagcatgcagccaggatcgcggaggagacgtcgaacgggatctacaccggggcgtgtcatgtcctcgcgtgtgtaaggctgtcgcatcctgaactcgatctgcgcgagatcttggatcagggggcggcaagcaacacgcgtaaggaggtgatggaagaagtcggtgatctgggggagtctgttctccccctttttgaagagtaggacttcttgtatttgttagataatgtgtaaaaattgaactctgaccgccttcgtgcgtgcaattaccatccttgtttagttttgtatgttgatctcggaagcttttgtccattgtagagatgctgatgacgaggatgtccagcagcgcgggcagcccgagtcactggcgataattccggtactcgagcttgaaccacacatctcgcctgacaatgtggatcaaacccttggtgcggaggccgggatagcgacgactacctcaagtgagtagccccttcacctcttagtgacctcctgattaggtcatccatgttccaaaagaggtatccagcttgtcttagtggttgtcacgtttagcagatctcgaggatgcccttgaaagccaagatcgtcgtatccaatactggaagacgaagtttgaagtggcggaactcgagagaaccatgctggccgtgaagaaagagcaggctgtggaaacgctccgaggtcgcgaggtgtggtttaactcgtacttgaagagttgctgcacctccatggccagagtatgcagggaacttcgagtagtccgcggtgatcccgaggagtcggcggccgggtacatctcgtggctgaacggggcttgtgcccaactcgatggcatcggcaagcgtatcgacgaggccttgaaacatgagtgtcgtcgagcgagctgatacgccggaggacacgtgctggcttgcctacgagatcaccgcccgcgcctggacctcgaatttctccgcgaaggttttgctcgttctcagagaactctggcggagatagaccatctggtgaggtcgatgtcgccattggccgagaagatcttccagtttatgaactggcgttggccttcttggtagtactcgtaccctgcgacaaatatcttagggaaagatgtaatgcagcgagagatttatgtaaaaactgtaagaagtactttgtgaataaagaaatctatctttaacaaatgtttcttactctagatgtcgtgtgtaacagtgtgttctcagttaacgactttagtcagccgtttgagtcgtacactctccctagcccccagccttgtcgtcgggggaattttctcggaggataaggctcttggacccttgacctgccttggttgaataagctctgatcctagcccccagtcgtaaagttggaaaattgatttccgatttcacggcttggttaatacgcacggcgagaactcttacacgaccagatcttacatggtctttcgtctctacaggatctgacaaggccttatcggctctgggcgtccccagccgaagatcccttaggttcctcgcaggccttgtcgagacggcataaagggacataagggcaggtttcaacgctaggtgtcatcagagtaagggatcatcaggcgaaaacacattgattgtgatatgggcctagatataggctttattgatactataagggtacttacaggtacggtggtattgactcatacatagaatttacatagttggtcaatgttccaagaatttgctaattcgcgaccgtcgccgtctgcgatttggaatgcgcctggccgcaagacttgtgtgatcatgtaaggtccttcccattttggtgagagtttgtttcgccctgcttgggtttgaactcgtctgaggacatagtcgtcgatcgaaagtatgcgtgctcggatacgcttctcgtgataacggcggagggcctgttgatagctggctgctcgaacggcaactcgttcacgatgctcctcgagaagatttacatcgatgtctcgctgctcctcctggttctcgtcggagtacttctatactcgtgtactctggtgtcgtagctcgccggggagcatggcctcagagccgtacacgaggaagaagggtgtttccttattggacgttgtcggtgtggtgcgtacggcccatagtactgacgggagttcttcaacccactttttgtcgtgtgacatgagcctgtcgtagacgcgggttttcatcccttgtagtactatgtcgtttgcgctctcgacttgtccgttgctttgagggtgagagaccgaggcgaagcatattttgacccccagggcgatgcagtaatcctggaaatcagcgctgatgaactgggagccgttgtcggttatgatgcggtgcggtagtccgtatctgcagaatatccctttgatgaatttgatggcgttgtcggccttgatttcccccgtgggtactgcttcgatccattttgtgaatttgtcgatcgccacgaataggaatttgtagccgccctgtcctcgtgggaatggcccgagtatatctagcccccagcatgagaactgccaagtcagagggatagtctggagcgcttgtgcgggtatctttgtgtgtttactgtggaattgacaggcttcgcatcgctggaccatgtcgcatgcatctttaagggcggttggccagaaaaagccttgtcgaaaagctttgccgaccaatgtccgaccagcggcgtgtgacccacatatgccttcatgtatgtcgaggaggaggtgtctgccgtcgtcggtagagacgcatttgagaagtaccccgtttggcgcttttttgtatagatcgttgccgatcatacagtagatctttgctttacgggttattttctcggcctctgtatcgtcctcgggcaactcctcgctgctaatgaatttgattagtgggatgcgccagtcgtctgtggtttcgatgtcggcaacggcgtgttctgcctcggtgacctccgagccaatgtcgggggtgttcgggctatcttcgtcgctaaccttttccaccgatggcttcgtcaggatatcgagaaaagtaccgggctcgagcggttctcgtctggacgcgcgtcgtgctaggtcgtctggctcgacattgtccttgcggtagatgtgtcggacctcgatcccatcgaaccttttctctagcttcctgacttctgcgagatacttggataactcggggttagagcatttataatctttgtgcacctggttcgcgactagctcggagtcccctttgacgattagtcgcttggccccaagtgcagttgcggctcgtatcccggcgagtaatccttcgtattctgcagtgttattggttgccctgaagttgaggtggattgcgtgtttgaattgatctccgaagggagacgtcaagataaatcctgcccctgctccttggctgttgagtgcgccatcgaacgccattgtccatgtttcgttgtcgccttggttatctgatttgttatctggcatagtccaatcggcgacgaagtcggcgagtacctgggacttgatggctgtttgtggtacaaagtggacatcaaactggctcagctcgactacccatttcgcaatgcggccgacaacgtctttgtttctcacaacttcgccaagggggcaagaggagacaactgtgacactgtgggcttgaaagtagtggcgcagcttccttgatgtcataatgactgcataaagcagcttttggatctgtgggtatcttgtctttgcatcatggagagcttcgctgatgtaataaactggtcgctgtacttctctctctcgacaacaatgacagtgctaacggaatatggcgtggcggcaatatagaggaataattcttcattaggttggggagcaacaagtacaggggggtttgataggtagcgcttgagtgcaatgaatgcctcttcggcttcccgtgtccatacaaatttgtcttgtttcttcagcaaggcgaagaaaggttatcctcgttctcccatcctggcgacaaacctgcttagcgctgccatgcatccggttagcttttgtacctccttgagtcttgtgggcgacttcatgttctcaattgctttgatcttctcgggatttgcttctattcctctgccagagacaaggaatccgagtagcttgcccgacggtactccgaacgtgcacttctcaggattgagcatgaggcgatatcgtcgaaggttgtcgaacgtttcccatagatcgtcaatcaatgagtcgcctgtcttggttttgacaacgatgtcgtcgacgtaagccttgacattgttgccaagctggtcgctaagtgcgccctggatcgtgcgctggaaagtattcccggcggttatcagtccgaacggcatcttaacatagcaaaatactccgaacggcgtgatgaatgctgtcttctcttcgtcctcttttgccatgctgatttggtggtagccagagtaagcgttgaggaagctcaatagctcgcaaccggctgttgaatccaccagttgatctattcgagggagaggaaagtgatccttggggcacgccttgttgaggtcggtgaagtcgacacacattctccattttccgttggccttccgcaccatgactggattggctagccactttggatgaagtacttctctgatgaagccagctttgagaagtttgtcaagctcttctcgtatggcttgttttcggtctggtgcaaatctccgcagtctttgctttactagcttggcatcgggtcgtaccatgagtttgtgctcaatcaccttcctggggacccccggcatgtcggacggctgccaagcgaacacgtcggcattatcgcggaggaaggtgatgagcgcgagtttctatttctcgtttagtgtcgccccgatcttaacggttttgtcggggttggcactggagagtggaacgaccttgatggcgccgtccggcttcggcgtcttgtttgtcttgctcactttcttgggtggctcagtcgtggcggatgggctgggcgtttgctcgaccatgtcgaggctccgcttgtcacactgcaccgctagctttgcgttcccccgaatagtgattgttcccttcggtcccggcatcttgagcacttgatacacgtagtgaaatgcggccatgaacttcacaagtgcagttctcccgatgatggcgttgcaagctgtatcgaattcaacgacatcgaaggtaatctgctctgttcggaaattgttggcttggccgaaagtcacgggcaacgtaatcttgcccaaaggtctggacgatgattggggagtaattccatggaagggttgatcagttggtgtcaactcgctttgcggaattcccgttgcgtccaaagtgctggcgaagagaagattgattgagctgcccccgtcgatgagaactcgcgctaccttgatgttccgaatggtgggttcgaccatgattggatatcgtcctgggataacggcggtcttggggtggtcttcttccgagaactctatcttctgctcagaccacttcatcttgggtgcagccccctgccatgtggagcagacttcacgttccactttcttgtattctcgtttggaggagtacgttgtagaactgccgaagatgtgtgagacgtggaggtcggagtctggatacgctgaatccgattcattaggagccgtctcttcgttcttctcgacaacacgtactcgcttgcctttttcaaatgccatgtgcttctcgagcgactttttaaaaacaaggcaatcttctagagaatgtctgtccgtcttgtgtatggggcaccatgatttctttgtgtcgctgccttgtgggtctgggcgcttgggagggttcgcgtattctgctgcgaggacttccgcttgagctttccttttcccatttttgcgatttttcttcttgcttgactcagatgcgtctgtggctggtttcttcactccccccggtcttcggcatgtcgttcttgcgccttagcgcatcatccgcgtgggcgcatcgctcgacgatctcgaataatctccgagtggttgtgatgcgtcttgtcgccaactcctaggtagtgtagcgatctctgacaccggatttgaaggcacgaattacagaagcgtcggtgatttcaggaattgtgtttctgcactcgttgaaacgtcgaacatattccctcaatgattcacccgagttttgtgtcaacgcgtgtaggtcgtcttcgatcgcgtggcgcttgtatgttccttggaaattggcgacgaattgttgccacaggtctgcccacgaagagattgagtagggaggaatatgcatcagccatgaacgtgcagaacccttcaatgcggttggtaaatagttcgctaacgcgttgtcgtctgctccggcagcataaagtactgtggagtagacttgaaggaactcctctgggtcggtgctcccatcatacttttctattgctccgggtcggaatctctcaggccatcggacatcacgtagggaacgaccgaaagccctacacccagcgttgggggcggtgggttgtcggcggtcgtgtgtctttcgtggatgtctgtctgacgatgaggaggacgctgatgatgacgatgacgatgggtcacttggttccgacgtacgattatgaggatgacggcctggatctcgggaatcctgtcgtcgtctcccgctgttgtctcggcaccgatctccatcatcatcgtcgttacggcgcgggcatgaccagtattgtctggcccccgtcgttcgcgatcgttgcgatcgtggtggttgtcgtggtcccggtcctcgtttgagcggtctcctcgatttccgttatcatggcgccgtgaggagacatgacgccgagagcgatccacgttgtctcgtgtgagtcgtgcttctcggcggccgttgatttgatctcgaagatcgccagtgccgcgaggtggaggggtagctcgttgaggggattccctctgttacggatcttcaccattggcatcgccagttggtggctgctcctggtgtgctgcggtagcggcttcttcaaacgcattgctgaggttagtcacagattcccgtagtcgttctgtccaacactcgaggtcatcgttcagaacgggatcgtaaggagtttccctcagtatagcttgaacggccctgatgtgttgggctggtgtagtcgattgatttgccgcttctgcgttggcgtgcgctgacgtgccaacgtcatcgatagccaatacctcccgcggtgcgctcgttatcgatgacccatagtcctcgagaagatgtaagaccgatggtttgtgaggatcgatatcgattaccccaacgaatcgatctgaggttggagttgctccttgttccttgccgttatccctgatgggggcatatgacttaggagatggagctttcatggcgccgaggaagactttgcagctcgagaggtcgtgattctttgtcttgtgaataggacaatagacatcccgagttggagaagtgcgctgaattccacgttctttgcaggcgcgaatttcagcacagacgttgaggaaaacccagcaatcttgcagagtgtgtttcttggttttgtggataggacaccaagaccttgtggcttcggaagtcatctttgtcggctcgcggttcatgtcggaaagacaaggtttgaccgtatcagaatccttctcgagcttggatgttgtcgatgttccgttcttcgtttcaacgggaggatttttcgacatggagtcgccttggttcgtagccactgcgttctcgtttccggtcattgggggaccggttgagatcagcgtcgtggtgtaaaccgggaagacgatttcgccaacttgagtccataccagcattgttgaagcagggagtacttggctgaggctggtgttgacgttgttgtcgacgaagctggatgacatagtagtagaaccttgagtaccaagtgtccctacctggcgcgccactatcgacgggtgatacccgtagaccgggtatagagggtattggggtacgttggtacaaggatctacgtagtacgacatcaagcaaccaaaagacaagaattatactagttcaggccccttgataggtaatagccctaatccagttggtatgggattatatggtggaaaacacaggttacaaagggaacgatggaacttatcagatccggcgagattgtagtcgagttggttcgacttactctcgatgacttggctcttcgtagactccggcttcgtaggctgtgtgggttgtgttggctctgagattcaatgtcctatgccctccccgggggtcccttttatatcgcagatctagaggtctctaagtagaactcggaggtatcagaccctatacgatacgtcaacgacccagttctgtccgagtaggattcttcccatctgtagatttcgtgaaaggtttccttacaggaaatatccgcgtgcgcgtgagtatgctatatcgatatgtaacgtatatcgaagggtaaagggtatgccgaacctgtaaccctgacaaggagtaactgaaacaaacaagtagattattatgctagattattataatctatagccagattagtataatccaataatctcctctagaggaggtttttttcagattattgagtggctgaagacccactacccttagatgcatctaataatccaaagaaacaaacaactcacaacttattctatgtcagcttattataatctagcttagagtaatctgatttaataatctagattacaataatcttaaactgaaacaaacagtatcttggcatatcagggaatacggatgatccatggggtaaaattttctggtaaatccaagtgaggggggtggctgtgactgcaggtgggcccgggactgggtcggcggggattctctgcggccgggtggagtacggcgctattcggtggcggctcttcggttaaaaatgttttttattactttttaattaaaaaccgtttttggcgagtgttgcactgttgccttgcccttttgtgttgttgaaaagatgtgaaccgttcttcttccgagcaagttggacatgtttctcgatggataacacaagtgggggttatcatctactatttgatttggaactagttactagctgggttggtgttctctaggagaaaaacatactgtggtgctttttttaattagcaaatcacacatagggataaggagaatgtatgatatatactcgagttaattttgaagagaaacccaaaaaataagttagacgtatgtttcaaagataatttcaaatgtcaccgattgatattggaatatatttaaggagcatgtagctataccataagatgtacttcccccgtttcacaatg

SEQ ID NO: 1309 - DNA, 33234 bp, Oryza sativa
  unsure (1)..(33234): unsure at all n locations
cttacattgtgaaacggaggaagtaattgtgatttgcggctgataaccataagaaccaatactcggctatctttcgacgccttaagtcctcaataatttatatgttggaaatgtaatgtaagctcatatggatttgttttatttaataaataaatcatgacgacgtgaagatcaactatcacaatcatatcatgtaagtatattctacacatggagtacatggacatatcaaacataattgacaaaattctccctctccagatgcatgatgtagaagttgatggtttcggagacctactctcccgaacatcggtgcagggctgcatgcagcatgctgatgagcagattgcaaatcctaaaatatttttcacatactccttttttgtgtgtagatagcgcctgtttgtgctcttgaaaagatgtgaactgttccaagcatgttggacatgtttctcgatggataaaacaagtgggattcttgtgtgtttgatctggactagttgggatggtgttctcgataaaaaaaaaacgtaacattttcatgatcaaaccacatagggttaaggaggaagtacatgatttagtggaattaatttatatccagtagaaaacatcagagtattcatgtatatttcaaacataatttgtaatcgataaatgttggaatatctcggaaaaacatgtcacaaatttaataccatgggatgctagttctgatctatgacagagcaaccaatacttagctatgtgtttgaagccttgagagtccatattgatttggcgaattttgctacgaaaatcatgatttcgcagctttacttgcaggatatgcaccgttaaagtcacgatatcttttggcaaattttgcctattgatttgtactttacatatattggctttaattgtggaccgataagccctagaaaactaacgaagcaaccatcaaatatttatgtataatatttttacatatctgttagcggtttgaatgctaatactgaaaaatagactactgtgaaaaaacaaatctactccaaaatcaacttttaaaattcgaaatttagttgtggataataaacgagtgaacgagtttgctaaaagtttattgtgtaggaaaaagaggatgtgagggatgatcaatagctagaaaattgatgaatagtagtgctgaaaaatactggtccgtaaatagggagtttatatgtaagatttcaaacatattggtgacatggacaagataggacgataagaatcgaatatatatctcataaagctgatacccttcttaaaaaaaaactcataaagctgatgcgatgtagaatcctaacggcaagaatgacataatttcatctacgaaaactcacagatgtcctaatcatacttgcaatatggctaaaaagccaataaagccgtgagagaaatttcccaagctagctacagtactagctagctttagcaaatatatatactatgatggtatgatatctcctaaaagcgtgctttatattattgatagtgaaatatgtatcacatttgttgaataacatttttataagtccttaaccaactgatcatcgaaagaattgcgtcacgctgttactacagaagcataatgacaacatatcaaacaactatcaaatgagctattaattagcatcgtgtcggcaagataaagtccctagggtacaaccaaaatgataggtccccaaagtacgaatcggatgatatgtcagtttgtttattttgtctaaccatatatccatccgcctaatgccaccggatcttttaggctctttcaaatagatgatttgaaaaaaaaaatagaacaatataaaaaaagattttagtagaaatataagtatgaatcagaggattgcaagacacataaatattcgtttgattaggttgtatgaaaaacacagaaataaaataagagaaataaactcaaagaaaattttataaaatattggagctcttgataactttcctttataaaatctttataagattgtctatttcatttaaatttgaaaggtatgataggatttaatcttttatttcaaatgtttttgtagaaaattttcttatagaattataatcctttaaattctaaaatgattaaacttaagccatatataatcacactgtacactgattttcagactttttaactggaaatttgatgatgtaaattcttcatagattcaatcatgattatcttaatctaatcacatcgataccgcgtgatgtgttttgattctttaaaaacgaaaggcgacatgtgaaagaaattatagcatcatatgttatctatatttcctaataagccaaaacgacttaagaaataaaaattaatttgtaggtaaaacttttatatatttgctcgtgccaacttaaaagtcaatgttaaaaaatacgttgaaaatatctaaaagttaactttgaaatcaagttaaaaaaatattaaaatttagcttttttttcttcgactattaggtcaaaccgatgggactctcggtggcgacgcaaaccttttgagaggtgagacgaggccctgtcacgtaaaactccaaaacctcagggtcccatctgcacaagtaccctcccatccagcaggccccaccacaaaatcctttttctttttttcattttttctgtgcttttttcttcctccttttttcacagtggcttgcatctgtcaccctcccgagctccccactcgtctccacctccccgcgatcccctcctccactcccccccgcgcgctcccatcaagaggagagagagtgagaggaggtagctctgccaccggagcggctgcggggagcggcggcagtgctcctccttccggggagatcggggtcgctggttggatccaagaaacggtagctttcgggggttggttcttgtttttgggggaatctttcggttggggagtgagttggctgatctgtgtgtgtgtgtgtgcaggggagggggatttgctggcggggaggagccgagtagggagatgagccgggggcggtcgccggagccgctggatttcttcatctggacagtcgaggtacgctcacctgtggactccctcccgtcttcttcttcttcttcttcttctttttctgattttctccaccgactaatttgtgttttggatgctgatttcgcggaaatttaggggctctctcgtcgccgcatttcagctaggtggggctttagttcgggggaattttttggtaggggattgggggggaacatttgatatgattggtctttcagtttgcagttgttcagtcagttcttagctttagtagattgcttgttcggatttgagggtggactcgtgggggccaaatttggaggtacattttttatatgctgttaattgccagactttttcgtaggcagttcataagcggttactgcggttagtataaatcttttatgtgattttgtaataaagttccctgtacttcctgcatatcttatgcttttgttcgaggtttcacttgttttgcacttgtcattcagtaaatcattgatcgtttagctttataaagcttgtgatgggttctattgtgttgatgccattgtgctggggtgcaaggaaaaccatcagaccatacaagatacatgtgtttcatgcatttgtttgcgagcttttcgttggcctagtgaatgctgttacattaagttcagttaactggggcgctcttttgctttgtattacaatcgcgaatataatatacttttttggcacaatatgggataatacatccattgtatgatactgatttgtgttgcaatgggcataaatgcaaccttttagacatctatatactgtctgactgcatatattacctcttatcttgagctagaacgcctaaacaaaggataactagtttgattgtaaatattgcagtgcaatagttcggattttatcttgttagaaattgggcctatgtgcaattcagttcaagccctgctaaatttgtagcaacctgaacctccaacatagcccctgctaagacaaagtttgattaaggactaacctagaaggctagcccaagtttaattcatgatgaggagcagcccagaccagattttaactcttgtcgaactcaagatatgtttagtattacttggttgagtattgctctgttggctgaaattgcgctcaactttaaacaagagagagatttacaagcagctaactcatgtggtgagctggttctccataaatatctttgtcactaaccatctaaagtattaatccctctgttcctaaatattagcatttcaagtttgtttagcaaatactaaggttgaggtaaaagattccctttcagtcacatcagtgtcagatttgaattgcttggattacctttctaagcacctgattggttgaaaaatggctagattcccatgcattggaatcagtatcctagaaatgcttatatcgtgtacaataattgaaacttagagatgcttatatttgggaacggagggagtattatttatcatttaaagttgaggacagctgtgctcaatcatgaacaatgtatcttcacatgcatatgtaggtacatgcactgtacagcctatccaaagttttccaagattcatccaaatgcattataataaataaaagacgggctgattggtttgaattgaaatggatctgtttcgaggcacattgacggtggtgaataatacttgaattttcatgtgcatcaattgaaatgttcctttcattacaatggaatacttcctccgtttcatattataagactttctagcattgcctacattcatatatatgttaatgaatctagacatatatgtgtgcctagattcattaacatctatatgaatgtgggcaatgctagaaagtcttataacctgaaacggaggtagtacaacttttcataagggttgcatgtgttatctaacacaagcaggtttagcataatgtttaaaccatatctaccatgccttttaattttcatgtgcctatgctttctcttttcgctctttgttctttttgtcattcatatctatgtgggttttggttcctgtaaaattgaaaagggcatcttagtttcatttaatcattttaaggatctcatcacgcggtgatatttactctgaaatagtgttttcatttgatccttatgttttggcaatctgtttttgttctaactgactaacttgatatttacctattcgcagttttgaacatatagcagttagtgtcatgtgcatgatcgaaagggcatgttacctcaaggtgcttaatatttacctaagattatcaattctctttcaggatgttggattatggcttgaagagataaaccttggcagctacaggcaagtttttgaggaaaacggtgtcaatggagagtatcttgaaagcctgtcgatgtttactacagaacagattctgcggtttatcaggaggtgccatatgaaatggggagatttcattacattgtgcaaagagttgaggcgcatcaaaggtttgtatatttctgtgccttagcctttagtacgaaggaataaccataacacatttctactactctaaaagcattttgctgctacatattttaccttttgtttctcatttgattttatgatgtgccaagcagtcgtcataatcaaattctcttttcctttcactaatgccatgctttatgtcaaattcgaaaccaatcaaaatactagttgattgaagtggttgaaggtcactgttttaacttttacccctcaaaagtttttgatggtgctatgcaaattgattccttttattttgttttgatgtaaatatgaagcacaaatagataaaaaaccatgatccaattatcaacatatattgcattattcaaaagtcaactttgactaagcatcaatattacctcaaaacatgctgtgtgcctggttaattatgaatacatatcttcggaatgttggctgaatggatgattatgccgaatagtattattgtgcaagcactttaggaataatggggatgaggatactagcaaaaggtgattgtgattggatctggtccgcgtcaatagtactttgaattatgctgcatgttttgctaattatgaatggatatctttggaatgttggttgattatgtcgaacaacatcgttgcacaagcacttggggataattgggatactggcaaattagcaaaaggtgattgtgattggatctggtcccatccttaccatcacttcgatctacttttggattctagcatggcactgatgggtattgtagaccaatatgtaagactgaatctagaaatacacccttgttacaccattgaacttgtctgatggattaatgaacttgccatacaagtctgcaaactttcggcattctttgaagagttctttctttctcttttggttcttgtagacagtttaagatgccatgattgcacacagatattgatatgtacttctaactgctcaattggttggtgttttggcactgaatgtttatttacctgacgcctgcaaaatctaatctccagtggcctgcctgaaaggggagcaagaagtccgcaggccatggtgggcgccgtcatgcctatcggtggtgttcgtgagggcggccaagcggaaccggcagtcccgagtcgtctccctgaagctggagccctagtacccatccaccgcctcaaatctttgcgcattcgccgttctaccccgccttccagctcctcttggtggaggcggcactgcaaccgcacaccgttggtgtgctagttcccagtgatatgaaaggtcttttgctgtgaagagcagaagtatgctgctctactatgttcaaccggtcctcttatccttttttttcttgatctgttttaatcatgatatatagggtttggaatagtaaccttggtgtagacaaacaagatacatatattgtgcagatggttccccttaaaagtttctgctgcttgcaagtcagtctgagcttgttctagtaggtatttttatcttgtgaaagattgatccccctagagatcttgatcaatctgcagaaaatgcagatgttttatttggtgttggtaaaaaaaaaaacactactacttccaacatttcttttatttgatgacattgtagaattagaatctgtctggtcaatcactcaaaaactttgcatcattgatacttttcaatttacatgaacaagggagaaccgcatcactaaaacttccattaggaatacttctgtaaaatttatcatttgtataaattttactgatgtctttgttatgaaaaagatatccctggtggttatatgtatctagacctggcccttgggcgtgtacattgtatctgtacaatgtagcaggagtacacgtgtatccagaaccttctgccgtatccaagcaagaggtgtgcagtgactgacaggtgggccgcattaaaagcaggcccacttgtcagccgtaatcctcctcttgctagccttctggattctggaaccttctcccacggggtggaccccacatgtcatcgtctcaaaacagttacgctggactttaccgcaggtgcacctagcatctccgcgacgagccaatccagaaccttctccccccaaaaaccctcggccactcgtccgccctctcactgacagtggggcccacgcggtggggccacaaggtcagtgacccgtagtaaccccccatcttcttgctccgcaaggcgcacgccatttatacgcctccgtcctccgtcgcgccgcccccacaaaaaccctaccgccgcccccaaaaccctcgcctcgccgtcgccgccgccgccgccgttgctgtctcccctcggcgaatccacggtagctctcccgctccccctcctcggtggtaggagtagcggaggagatgctcggggcctcgaggcgttccgtctgcaccgccgcggcggcggcggcggccgggtcacgccgccgcgccgccgccggcgtcgcctccgccgtttccggggattcctccgtctcgtcttcctcggcgcccccacgctcggtacgtgccatctccggccttgactttctctacggctgcggctgtttcgggctggttgcgggttcagagggaaaatgtgggggctggtcgtgatcgcaaattagcggaaattgagtggtgcttaatctgtatagtactcttgttcgcccattacgtggtatcaatttgagttaattttgcggtgtgtgttaattcaagctaattcgttggtttaagttcatcttgttgattgtgatatttaatagtcgattgggggaatcattagatttttactgtctgattgattgtttgaattgagtcgagcctttgagcttctgtatgtgatactcacaacccacatgtatcgtccgattctcaggtgattaatggggagcctggtgtccctcagcttcagaagaggttgctctctgtgcttgctgcgcccaagcttaccgggaccgacaatgctgcctccctcaagctgagggagggttcccttgttggcaggcgatatgaatcgagtgctgcagcagttgattcttctgatacgccacctgtggagaagcatgagtaccaggcagaggtaactactggagcaatggctaatgttttatttttcttaatcaatctcgtgttaccaacggtgtcatgatattgtccaatgtgcatggcaggtcaataggctcatggacttgattgttcacagcttgtatagcaacaaggaggtgtttcttcgagagcttgtcaggtgggtgtcattcaagaacataagttgttcactaattgaagtttgtactaatcatcatcttggtttactcttgtgcgtttagtttgatctctatggtttaattttttttaatttcttcatcgtgtatctgtttgcagcaatgcaagtgatgcacttgataagttgcggtatcttagtgtcactgatcctgatcttataaaggatggtgctggtcttgacattcgcatccaaacagataaggagaatggaataataccaatcacgtaagtattagttacttgatcaattatgtggctcctttcttgcaaactcatgcctgcatttgctcctttttatctttagtgatactgggattggtatgacgaggcaagaacttgttgattctcttggaactatagcgagcagtggaactgccaaattccttaaggcactaaaggtgtgttccatttgcactttgctgatgttaccttcatgtccttatttttctttgtttcttatcctgtcatattactaatcttaagtattattatataataggagagccaagaggctggtgttgacagcaacttgattggtcaatttggtgttggattctattctgcgtttcttgtttctgataaggtaagatgctatcgtgattgtctttaattagaaggttaatagctggctgttaatgacctagtgtttatttcccattgtccttggctgacatgttaatatttcatgaatattatttattttgtctaataggttgcagtgtcaactaagagcccaaaatctgacaagcaatatgtttgggaaggcgaggcagaatctagttcttacaccattagagaggagacagacccagagaagctccttcctaggggaactcgccttactctgtaccttaaggtctatttgcttattttgatatcatccaactcattttatacatgacctgtttctaactacaattcttggtattgtttcagcgtgaggacaagggtttcgcacaccctgagaagattcagaaacttgtgaagaattactcacagtttgtttccttccctatttatacttggcaagagaaaggttacacaaaagaggtgaatgctcttcctttgttaattattttttattggaccaatgcatcaatttaattgtggcatattttgctcttttaggttgaggtcgatgaacctgttaaagctaaagaaggcgacgatgagactaacacagaggtaactgtgatatgcttttctgccaagataaatctgttatacttaatacttgtgcataattgtattaccatgatattaacaggttaagaaaaagacaaaaacagttgttgagaagtactgggattgggagcttacaaatgaaacacaacctatatgggtgagatttgatctgttcagtgtgctaatatgtttttattaatgaatgcacccatcacttattgaaaatatgaaggttccaaaaaaaaactgaagctttttttttcattctctgtttatgggagcttcggaaccctagagaggtatcaactgaggagtacaatgagttttacaagaagacattcaatgagtacatggatcccttagcatcctcacactttactacagaggtatgtctgattgcatttgattagttatcagttgattctttctttttgtcaattgaaccagaatcaaggttgatataggtagcagtgcagttattttgatgatatgttcattgtgcatgactattctatgaagacaagttttttttcatgcttatacatttgacaaatttaaccaaacttgcgatatcacagtattctgtaactgctgtgaccaaattaatatcttcatactattctttcacaaagagtcaaagacacacgagtgctattcatcaggcaaacatatttatatacaggaacagataatagttcatccttcgttaacactaactcagctggtaaagttatgtaatacatgtctattgctgcatatgcgactcttcatttcaattatggtggttctattcaaatatttttttggatatccacaagcatgcgaatgtttggttttgtaacattgtattgcattattcagtgaaaatgatattgtgatcagtgcggcaaagatgccaaactggttcatctttttggttagaattgcaccgatctccatgtgatagttcatttatcttcatggattggcaccaatatagcacatctgtctatctcacggtaaaactgtgcctgattgcacttcacaggctcacttggctgtgtttgattttattcatgcagggggaagtagaattcagatctattctctatgtgcctgctacaaagaaggaggatataactgataggaagaccaaaaatatcaggctttatgttaagcgcgtgtttatatcagacgactttgatggggaactggtatgcttaatacacagcagctcttcatgattctttgtcaagttttagataaccatggaaatctgacaataaaaaaatgttattgatcagttcccaagatacctgagctttgtgaggggtgttgttgactcaaatgaccttccattaaatgtttctcgtgagatcctgcaagaaagccgaattgtaagtgttaatgaatggttttctgtctatgtcttgtacatttctatcatgatcttctaacattgatttatctttcctttttttttccttcttgtttgttacaggtgcgtataatgagaaagaggttggtgcgaaaggcctttgatatgatacttggcatctcttgtagcgaaaacagagatgtaagttgtttactttccttttgtgcatgatgcctctgttctctcccttatccttcagtagttcagttctcacctgaaatttactgtaggactatgaaaggttctgggaaaactatggcaagttcttaaagctgggttgcatggaagacaaggaaaatcacaagagaattgctcctttgctccgattcttttcttctcaaagcaatgaagaattaattagcttggatgaatacgtggaaaatatgaaacctgagcaaaaggacatttactacattgctgcggacagtttgagtagtgcaaaacatgctcctttcctggagaagctcaatgaaaaagagtacgaggtatgtactgtgaatagcttaccatgtttgcagacacatgatcatatttcttaattatattttgctattggattctgggctttattgaatgcattcattgcccatgcaaactttgccctgaaaggcaaatatagtttactggccttcagggcctgttgaatttcatagttgagatgccttatattttcccaaatattggaacaaacatgcttgtttttgctactatctcactgacatctagccatctagaaggcttaagccggagaacccaatggcaaaaacagtgttgcagtactgctgaatggcaaaaacaaagtttctgtatttgtttacatgtcttactgattaatgcttttacccagaaatgagttgattcacttcatcacttgtttcctttttgtgacggttctaacttgtgtatattttgtaggttctatttttagtgacccaatggatgaagtgtctgtcacaaatctgaacttcctacaaaaggggggggggaatagcgttcgtgatttagcaggaagactggactttgtatgcatacacaatctttgaaacctncttctactgctgaatgagatgagtttgaaaatagttgttgtgctcgcatgagaattatattgtccttcattatggcaagacttgtttatatttcacccttttaatataatgaatagagccctgtatgtcttgtttggatggtgggggtaggcaatgtcttaaccttgcagaattgggacaattacctcatttcagtcgtgtaaatcttttttcctgatttctgattttcatctataatgtaacttaggtgataagaatgaggaaaaagagaaggagatcaagcaggaatacagccaaacatgtgactggatcaagaaacgcttgggtgaaaaggttgctcgagttgatatatcaaaccgtctcagctcatcaccatgtgttctagttgcagctaagtttggttggtctgcgaacatggaaaggttagtctctatcatgttgacctttctagcacataattcttgtaacttaaagttcttaatagtattgttgtgttaacaggttgatgagagcgcaatctatgggtgacatgtcatctctggatttcatgcgttctaggaaagtttttgaaatcaacccatagcatgagatcatcaagggcttgaatgtaagtgttcggtctgctgtttgcacttcgcgcttgtaatttcctgatagtccttatgggttcctttttcctcctcaatgcaggctgcctgcagagccaaccctgatgacccagaagctctaaaggctgtagatatcctgtttgaaacttctatgatctctagtggctttacagtaagtacacctgattgccttcttttccatcaaataaccctggtccatttgatatgataggatattccgccttaccgttgtgcatgttttctatactgaatgtcgtaatctgtttaaatttcatcaatttgtgtcatctcatttgtggtatcatattgcagcctgacaaccctgccgagctaagtgggaagatatatgagatgatgagcacagctatggccagcaagtgggcctcgcacgctcaacccgctgagatgaacctgcagcgagactcacctgtcagctctgagccgattgaagccgaggtgattgagccggagttggtggacgatagccagaagaaataagggaatcgtcgagttttccctcaagttctataaaccttaggttctttttcggatccatttcatacgattatgccgtcctcccagaatattgtagcttaattttgttgccgaaacgctgagatttttttttttcagtttggttgagcggccagtgcaatgagctgtgtgttaaaccaataggattgtgttatgttaggaataatggtttctttgctaggaacaattactttgaaacaatcctttgctctccaatttttccattgctcacttatctcctgcgcaagtaaaacatgatcaagtattagtataaaattcaagcaatattcgtcctgctctaaatttcttattggtatatattgcttgaatttctattaagtaatgcaaggaatcgcctcttaaaatgatttatggtcagatttgttttttctctactttgtctcttagtgtattgtcatattgctcttctagcattgacattggtcatcaaagaaagacacttgtagactgtagtaaagatattccaatccagtatgtactgtccattttaaacgtagtcattagacttttgatcgttttgttttttttttctaactttgatcatttgtcttatttgaaatttgtttatgattagtatttttattaaaattaaatgataaaacatgaatagcactttagcgtgacttatttttattttttaaaaaaatttcaaatattagtatttttattaaaattaaataataaaatataaatataaatagtactttaagcgtgacttatatttttctttaattctaaaaaaatttaaataagacgggaaattaaaattggatatgaaaacttatggccgagcttaaaatgaaacggagggagtatctgcataggacctatagatgttctacagatgtttattgtcatataaccagcaaaacattcattaaattgagtgatcatctacattcatcatgtattaaaaaacatctttatttaagaagccaaactcacctgagttggcctggtttgataggcttgctcaatttgttgcccaaatcaaccgtatcaaaataattttagtgcgatgtttctcttgatataaatacaagtctatagtcttagaagacaatagtcagaaaaagaaaaagacagtcgccccaagtgtctacgactggtcctgctattaaaacagaacaagcacaaaacatccctaaaaaatggtcttctaagcgatgcctccaaggaggaaatgacgctagcgcgccgccaaggggagaatcaggatgtggttttcacctaaagaaaccaatgagagataagagaaaatgtggcaatgccccaaggggaaagtggcgcctcatctgtgacggcctatagtttaggcccgattgagatgagagtcatccgtgacgggctataatttaggtccgattgaggtgaaagtcatccgtgacggcctatagtttaggcccgttagagatgagagtcatccgtgacgagctatagtgttggcccgattgagatgtgtgtcatctgtgacggccggatgcccgattgagatattttaccatattagtgacctttgctctgtgacgtgggccctacccgatagagatgaggcttgtcgcccgttacagatgaccgaacccatgctagtggctcaatctttctctaaacttgaaattgtaccggcgtgaacgtagccgccaactcccgcgccaatggttacatatccgtttcagcagaaaccactagctaatcccctttaatgcacagctaccgcgtcgacgcctcattgctggccagccttcagggtaggatctcaacctccggcgcactccaattcgatccacatagttgggttggagagggatagggtgtgagagaagtagggctggatgtcgagctggctcggctcggctcggcttggtctggctcgttaggataacgagctagctcggcttggctcgttatcctaacgagctagaaacccagctcggctcagctcgtttgaaagctcgagccagctcgttaggctcgtgagctttgggggcagccgacgaccatggaggcacggaagcaactcaacctcgccggcaccttgatagcttgccggcgaccacggggaggagcttgacggcagaggaaacgagcttgagctcgccgacgaccacgtggaggagcttgacagcggaggaaacgagcttgagctcgccggcgaccacagggaggaacttggtggcagaggggatgagctcgagctcgccggcgaccacggggaggaacttggcggtggagggacgagctcgagctcgccggcgaccacggggaggagggcgatggaggagacgagctcgagcttgccggcggcgttaggcacagggggagggacggagagcggcggcggcgcgtgggacgagctcgagctcgagctcgccgatggagtcaggcgtgggggcaaggagaggcgaagagcggcgggccgacggcgtcgggcgctggggttgggtagcggcatcggtcactggggtggaggcccagagcggtggtgctggggtgggggagacgaggagctcagccgccaccaccagggaagggggaagggaagctagggttttggtttttggtctattgggccttctaaataaatgggcctatgggctttgtggcctagcagcctggctcgttaaggctcacgagcagctcgcgagccagctcgagctggctcgttatctctaacgagctaaacttccagctcggctcgttaggaaaatcaaacgagccgagcttgtcacgagccgagcgagctaacgagccacgagcttctcgtgaacccctagagagaagaatggatcccctctcccccgcattcactcgtccaacgtgtccatcttgttgcggcaagctgccgccgcaaaaggactgactcctgaaaataagcttgtcgcagccttcaaagcctacatcatggcgctaccgtcgttgccgcctcaaccaggctgtccgtgttcgaacgggctgcctggccgtgtcgccgtcgccttcgtccttccaccgcgacagcctcctcaccgctgtgccctcccaccatggcaggctcgccggcataccgtttccacgccgtgctcacctgcctcccgccgtcgagatcacccacgcctgctgtcgctcgccacgactcctccctctggccgactactgccgtcgcccacaccggcctcttgccgctagttgtgctggccggctgctgccatcacctatgtagacccctgccaccaaccgtgctagccaccacagccatcgcccgttcttcccgccggcctatcgtattaccgaaatttgatagtgttggttttgtttggacttatgcttttatcaatttttgatagagttttaagattgaacttttagaaatagaaaaatttaataaggtagcaatgattaaagtgtgtttagtttgttgtctgactaaaacttggtaaggttaaaagtatcaacaaactaaggttaaaatgtgtttgatgtttgggttctatattgccacgctcgagatttgattcaaacacgcggttaatccacattattttcaaacggaccattcgaacatcggattatcgtacgagcaatgaaaaaaaaatttcaagccctttgcagaattctcaaaaaaaaaaaaccctttgcagaaaaaaaagaaaaagaaaaacccatccaatccaacgaacagtagtacatcctcggagacggagtcgtgacggtcaaatctgcaaaagcgaaagccgcccactgcaacaagtccgcaaccaccaatgccccacccgtgggcccagccatccatccattccgcgttttccccgcccaccggtcaaaccggtcaccctccccactacagccggtcaccccactctcccccacttgataataataattactccgtaattaaataatttcgttttggagctcgacctggactccattactcgcagaaaagtcaaatccaatcaaatcaaaatccaacccaactgcgccgaggaggacggaccaactccggctactccccgccgccgccgccgccgccgccgtcggcaggaggaggaggagctaggtcgccgccccgccccacatcgaggtgagcttcttctgccaaagctctctccgacgaggtctccgcccgacggatggggttggaatggatccggctcgtcggcgagcgagcgagcgagattcgtgattcgatgagcgattgatgccgcctacttttgcaggattagggtttgctttgtgtttgcccgacgcgaggaggatggggacctcatcgggagccaacttccaccagcagcaaccgcccccgccgacgtcctccgccgcggccgcggcaggagcagcggcggtggcgcaggggatgctgccgccgcggaggcccacggggctgcagacctcgctgtcgctagcctcctcggagcaggtcggctcgccggagatgcaggagccgggttcgaattccgaccaggggcacgactccgccaccgagagcgctagctccagggagacgtggcccgccgagcccaaccacggtagtgcggccgccgtcgtggccgcctccaccgccgctagcggcggcggtggtgttgttggtggaattggtgttggtgtgaggatcgtggacaaggagaaggaggtggggaatggtatccccaagctgcaggtgatccgcgggtcatcccgccttgatcggatgtcgctgcgggaggttgcccgggagagggtcgatctagttgctgagaaaatgaaggtgatgccggaggagcacttggaggacatgaagaacgagctcaggtcgattctggagggcacgggtggttctcaccatatcgaggagttcctgtatctccagaagtttgtgcagagtaggggcgatctcacccagaccatgctctcgatggcgcatcatgtgcagctcgagatcctcgtcgcgatcaagactggaatccaggcgttcttgcaccccagcgttaccattcctcagaaccgcctggtggaggtcttcttgtacaagaggtgccggaacatcgcttgccagagtgccctccctgcggaggagtgtagatgcaatgtttgttctaacaggaatgggttctgtaacctctgcatgtgtgtgatctgcaacaagtttgatttcgaggtcaacacatgccgctggattgggtgtgatttctgctctcactggactcacacggactgcgcgattcgtgatggccagattgggatgggtcaatccattaagagtggtactggtcatgctgaaatgctttttaggtgccaggcttgccagaaaacatcggagctgttaggttgggttaaggatgtcttccaacaatgtgctcctggttgggacagggatgctttgttacgtgagcttgagtttgtctgcaagatattccgtttaagtgaagactcaaaagggaggaagttgttcaggaaatgtgcagatctgattgaaaggttacggaatagccccgcggatgctatcaatcctcggatgatactgcaggtgctccaaggtatgaatattatccttaactgagacttgcattagcacttgatttgctggtatcctattagcatgtatctgcttcttcatttactaaattctccatataagccttcttaattctgtatattgattagtggtactgtacacatgtattattgtaggcttctattaccaccctcttaattcagttgaaagcttatacattcctgtgatataggtggtcagcaaaatgtatttagctattcaaattatacagcaatatgtgtccacccttgtttgcagatctattgctctacattacaagagcatgtattctgagggtctgattgttatttgcttcctgattttgttttcacacttacatgtgcttgtttatcaaaataaactaccttggtctggttattgttgctaccttgctggggctaatttcttataatcttatttgtgtcttttgtgtgattaatccctttgtaaacgattcagaacaacgtattcatatgtatgctagcactcagaatgagtgttgacaccatgtaggctggcctagttctatttaatattattttcccctcgagcctgttatggccatgactcacgaaattgtttactgcaaatatccaggcaaacagcccactgtaaaatcctgaactatgttctgtattgtttagaatgcacgtatgcttcagatttgtgtctgtactaagtcaacctgcactccaagttgattgtaaagctatttattatgccattgatgtggggctggaatttggagcacatttatcttgtggttgaatgatgacagaaagaactagttgttgcatttagaattcttcaagttcattgccatgggatgttgggaaactgtgggtattagttgcttgttgaactcctatgtgaaatgcgtgttttggccaagcactttatggatcaatacatgccttttgctcttgctccacacctagaatcctatattgcacagttcttgttacttggtattctaaatttttatgtgcatcactgattttggtttcttagatttgattcattaacactgaactatgcttacgttttgacagagctcgagttggattcccccaagagcacagaaaatgaagaaatagggcgcttgatcactcctcaggaggcctgtaatcgtattgcagaggttgtccatgaagccgttaaaaagatggagcttgttgctgaagagaaaatgcgactctacaaaaaggctcgcattgctgtggaggcctgtgaccgggagcttgacgagaaggccagagagcttcaggagctgaaggccgagaggctgcgcaagaagcagcaggtggatgagctagagagcattgtccggttgaagcaggccgaggccgagatgttccagctgaaggcaaacgaggcccgtcaggaggctgacaggctccagagcatcgcgcttgccaaatctgagagggccgagcaggactacgccagcctatacctgaagcgccgcctggaggaagctgaagcagagaagcagttcctcttcgagaaaataaagtaccaggagacccagaggcccatgcaggcgagcggcagcggcgccggcgattcatcgcagacgcccatgctctccaagattcacgacctcctcaagaacgtccgcagcataccgccgaagacggaggggcatcaatgaaaacaaagagcagcagagctgcatacgattcaggttggtgaatcttaggtgtccttgtgctgatgtactcctacgctgatttccttcggtgtaaattgttagcaaaagtcgttgtaacaatattattggagctaacggtgtgctatcgtaggatccaatatatacttagcttcggtgtttgcagttgagcatggatgagaaatagctgaagcaccctgtactctgtaatagccaaaaaaagaacttctatcatgtatgaccatttctgacattgttagatcgaataatttgtataatttgtgttgtaacttctgtacgtaaccctgtcatttactatttggttaaatgtgaaattgtgaatcttcatgaggagacatacttctggaaaagcctgcgtgatccaagagaagtgtcagtctgtaccacactgcactggcaacttccatggctgggctgtgtttagttcacactaaagtttggttgaaattggtacgatgtgatagaaaagttatgtgtgtatgaaagatttgatgcgatggaaagttggaagtttaaaaaaaaactttggaactaaacagggcatggtccttagggggtgtttgggaactagggactaaactttagtccctctcacaaaagcataagtcagggactaaagtttagcctctctctcccaaacactctcttaaatggctggtacaaggagagtagcatccaccatacatacaatcctggaaatgtgaatgaagctaaacttgtgagatttgtctcttcttcttggtgggcatgaatgtgatcatgtgatgatgacccacatggcttttgtgcaaatgtgaaacctagaattgtgttctgcccccatattcctacccttgtgacacctaatattccactatctcagccatgctcctctgcctctcattactccctttttgacaacactcaccagttttctgctgatgattgatagtatattgacaagttctatattgttttgaaattcagggactgaaattgatcttttttaggggacaaattgaaaacaaacaaattcagggactgaaattgatttttttttcaagagttaacaaaacaaatggaaccatatcaacagatcaaatatagatttgccattctacaaattaatcagctgtttctggatgaatcattttgtggcacatgtcaagcaagcactactagatctatgcgtcatttccactttggcatgcccaaaatttttctgatgtatacggacatacatttgaaatattaaatgtagtataataacaaaacaaattacataatccactggtaaactgcgaagtgaatttattaagactaattaatctatcattagcaaatatttactgtagcattatattatcaaatcatgacgtaattaggctcaaaagattcatctcgcaatttacatgtaaattatgcaattgatttttttcgtccatatttaatattttatacatgtatccaaatatttgatgtgacggaatttttagaagtttaaaggtgactaaacacagccagtccaaagatgtagggcatatggcaatgacacgtcgcccacgcatcaatgtgacattaatcacattatcgccttgttttgagcgtgccctagtgctcctactcctattgccctttcaatctctcttctgcaaacgcacgcattcgctagctgcatttaacacaaacctaggagagttagtagctcaaagctagcatcatgcagtgcagggcacgtcttggcaaagcatgcgagcacgcgacacctcttactcgtgagtaaatttactctttttttttgcgaaattcaatgtgatgacacgttggatcagccattaaattctaatcataatcgcaggatcagcgcgaaatctgaaggcgacatgatcgcacgaaggttctcgtgcaggggatttcctgtgcacctgtttcagttgcttactttagaagataaatttcggccgaatagggcttcggtaaatcgacattggatgcaatttttaacttgtttttgccttttgaggtttatgttcttgttaatttgtccttgatgaggcactattttttttctataataaattattcaccggattattttctatgcttcgaaaactacgttctcttaaaaaactttcttctactttattgctattagatcacttgacttgagctatttatttagtttatttcttataaattatataacattcctataatcaagcagataatttatgcaacaatacaatcaaaaatctaaatcaaacaaaggcagcatttcttatatgtcgatgcgattgataaaaaccctactcttatactacattcgttccaaaataatttcatttttagaacgaaggaagtaccttttattattttatttttttgaaaataaggttttatgtttcgagtactaggcactaataataagcatgctgcttgtagttaaaattcatgcaacttgaatagcaaatccagacatctaaaaaaagctattccttctagagataaagcataatatacaaacatatgtggcctcatcctttcgcttatatttatacctatcagctaaaaattaaattttcaaccttaagcttgaagctgattttaggttttttcatcaaagtataaaaattttatttacaaattacttttcgtttgcaaatatatcgttttacttattccacgaaaaaaccaagctatggggccagatgtagtttgttgggagggccatggtgtgaagccattttccaccaaattaaagctggtcttggcgtgcacctgtaaaatatactattgctcacttgttgggaaagaacactttctagtgatgatggcaataataactagatgaattaaaaaaaaagaggatgcaagaaagctacaggcactgcccacagatcccacattcccactactgcatgcttagttgattactctctccattccattttaagtttttatatacaacgtttaaccgtcttatttaaaaaaattataaaataattaaaaataagacacgtctaaaataatatttatattttattatctaataaaaatactaatcataattttttaaataaaataaatggttaaacattgaacacaaaaatttatggctgtaattaaaaatgataaaatggaggggggggggagtactattttttccactataaaatggcccatcgatggcgccatcttatcgctcatgtcgacgacaacgcaactgaacaacctcgccggtgagcagctaaagctaagctgaggttagccatggcggcggcgatggggttggagaggaaggcgaaggtggcggaggtggcgctgcggtgcgcggtgtgcgccctggcggcgctggcggcggcgctggtgggcacgggaagccagacgaggaccttcttctcgctggagaagaaggccaggttcacggacatgaaggcactcgtcctcctcgtcgccgcccacggccccgccgccgtgtacagcctgctccagctggcgcggtgcgccgcggccgcggcgtggaaaggcggcaccaatgccggcccgccggtggtggcgtggtcggtgttctcgtgcgaccaggcggtggcgtacgcgctgatgccggcgacggcggcggcgctgcagtcgtcggtggtgggaaagcgcgggcagccggagctgcagtggatgcctgtctgcggcctctacggagcgttctgccgccgcgtcggggagggcctcgccgctctccgtagccgcgggcctcgccgccgtgctcctcgccgccgtctccgcgttcaacctgttccgcctctacggcggcggcggcggcggccgcaagagcagcgccggcgccgtctccggcaatggcgcgaacacgtggtaagcaaggctagtttagctgcttcgatggagtttaatttctttgtagtttcagaattaaattaagcgagactggctcactgacacgtaattaagttcgttaaatcgttggtaataactgttatgggcttatggctgtggatgataataattaagtcagatttgccgacgaccaaatcgcctgtttaatactccctccctccatcctaaatataaataattttggttggacgtgacatatcctattacaataaatctagacatgaaagctgtccagattcactgtactgaaaagtatcatatctaaccaaaattttttatatggagtactggttaatgacgtattaaggttggtgtctttttttttaaaagactattaaggttggtgtcggcgtgaatcaatcgatggacaccgtgtgagtgcggcaggcacgtccgcatgcgtgagtccactcaaatcgccttctgttaatgggtctcaaatctggtaccacttcacgtatacttcctccgtccaaaaaaaaaaagacaaaccttgatttccgtgtccaacgtttgaccatctgtcttattttaaaaaaatatgaaaaaaattaaaaagataagtcacgcataaagtattaatcatgttttatcatctaacaacaatgaaaatactaattataaaaaaattttatataacacagacagttaaacgttggcacgtaaacccaacgttttgactttttttggacacaaggagtagctcctaatctaatatactcaaaatttaacaaatgtttatatttgagtatgtaactttcgcatactacaacaaatagttatatttcaagaaaaacctatagatcctcaccatcacggtaaattaagaaagacacttagggcaaccacaatgtatgaaaaaggtgaccttaaggcaatgattgcacttgtaaagtgagccatatacattgtggaaagtagcattagcttaggatgcagcttatgcttaagttctcccataagcaaaaagaaaatattttctctctcattcacttcatgaacaagagatgaaacaattatttttccattctatgtgggccatcttgtggctaaattctaaccatagcattatgggtatggctataacaatggctcactattcataaggcccaccttaaggttacactacaccacaaacattgaggatgcccttgtagatagtggtggacctagaaaactttccaagcacaggaaaactcaaatatacctaatatttgctataatatttttaactttaattctttcaaataaaataaaattttaacagtgtatttgacagtgagcccggatggtggatggtggctccacgctgcttatagagcaaaccaatgtagatggacgaagcactaaactacggcaaaggtagagaaaaaggaccattcgagtagctaattaattatatgttggatcgtagtaagatattttcatgtaataccatggtctctacatgtttagtaggtttagagatcaattagtttttaaaagacgagatgtactataattgcacttgaacttaagtctgtcggttagaccatgtggccaatgccgatcagattgtagaccgcccatttgtgacctggtcggatttttaggttgttgatcaaaccgcccctacatggatagctatactggcctcactacagaagctctaacattattttttttaaaaaaaatggcttaatcttaccatgggctattttgaattgatgacaaaatatgtcctactattgatagcttgaatagtaatattggctattcgatttgaagccaaataattagtaatgcctaaaatcaatttgacttcacattggtagtaatcctctgccaatccaaacattcgtactacaactctatcctacttaaaagaaatgaaatgatagtacataccaatacttatcaagaatttgatactatcaaatatttagtatgttaacgaaccaaacccaccctataacttcatcccaatgccaacttgtcctcctgcatttttagcaaacttgaaagctaaaacactcgtaaatttaagagcgatggaccgttactggccatgtaaaaactgttactctattcgtcacaaaatataacaattttaaactacaaagttgtcttaagctataacaatttctcaagcaaatgagggaaaaaagtacatcgaaggtccctcaacttgtcatcgagttacaaaatcgtccccgaaacacaaaaccagatatccggcatctctcaactaatcaaaaccggtaacattaggcccttcgatggttttgaccccggttttgtccgacgtggcggttgagtcagcgtgggacccacgtgggccccatgtgtcagtataccacgtcatcatctctctctctcccccttctctccggctctcccttctcctcctctctctctctcactcttcttttctctgggcgagctggatggcagctgggaggaggccgccggggcgaggcatgaggcggcggttggcggctgcgacgtgggagaaggccgtcgagcagggagcagcagaggccgagcacattggcgcacacgcgcagctttagcgcgtcgcgtgggctcgacgacgacccggtgctgggtgtcggcgtcggcctcagcgggcagttggagccacaggcgctcgccaccacggccacggtgaggaggctcaccgccagaacaagcaccaccagaacaagcaccgccttcgccgccattgctatcgatcgagctttgctaggctgctagcttgtacttgtagctagctcgagcttgccgctgctactgctgcttgctgtgtgctgggcctgggagtgtgcatggcaaggtgtattgtgtatttatagtggccatggagaagaagatgagaggaagcgacggcgcgggagcaccagaccaggagggcctcccttcacgccgccccaccgccaccgccactgccaccgcaaccggcaggtggggaggaggccgacggggcgaagcggggaggctggcgattctgcaaagtcgcggatgatgccgccgtgatgaggtgctcctcatctctgacagcaacggggagctcgcccatgccatgggagtcgatctcgacctctccgacaagcccgccgggctcgacgtccggtctcaccgctacacgttcctggcaaaggacgacgcccgctgggtctagccgacggccgccactgccaacgccaagctcctctccgtcggccgctgcttctctccccactcgtcttcgccagctagcgtcgccgccgccaacgagggacaatgccgccaggtttaggaggacgtgcgggcgaccgctggagtcgcctcccgtcgagcagagcggaaagcgagatgacgcaaggcgagggcgaggaagaggccgtcgctggtggcgccgccgccgcgtccgtctccacctttgttcctctcccctccaattgttagcccagccccactccttccccgccgcccgtcgcaccggccctcctctccgctgcgctcccccccgccggccgccagacgcccccgccgcatgcgctgggccagggcctcctcccatgccggccgccggccgtgcccgtcgcgctggccctcctcccctgttggccgccggacgcacccgccgcacccgccccaccgtaccttcctcttcggccagccgccggcactcctcccctaccggccgtgatcctgcagaggagaagtgagagagagagagagaaagtgaggaagggagaggagggggaagagagagtgtgtttacatggcgtcctaacatgtggggcccacgtgggtcccgcattgactcagccgccgcgtaggatataaccggggtaaaaaaaaaaaccactaagagacttaaaatgaacggttttgtgagttgagggacgtcagatacttagatacttggttttgtggttcggggatgattttgtaactcgatgagaagttgagcgaccttgtactttttccagcaaaggaggtagtaccgtcgcaggcgggaggcggcatgccaaatttgggccggctcaagaggttgcgtcacggcccagtacatcaaggcccatccaaggaaacttctagaacgtttgccttctacgtcacgcccccgccacccccatccccggtcggtcgcgtgcacgcctacctatcctatggaccccgcccaccgcaccaccacccaccccacgaatctcgaggcataacgggtggttcacatcgctccggactatggaccaggtccagccatatcccaccctcccccggggaaacagtccagactcccacaaagaacggttcgattttgtataaaacccctcgcaattttttttctcccccacaaaactcccgcatcgccccacactgctcctgctgcctctctctctctcccctccggcttctccgccgccgcgaacgcctctcgactccggcgagttcatcaccggcgttcacgaggatggtgagtttggttaggggggcagagccccttctcaggcctgaaatgtttttaccctcggattgtttaggatttcgcgattcaattcgcgctattttttttttagttttagttttattatttcgtgtgatctgagaggctgagatgtgtggatgcgtatgtgtggttccggggtggagcgattttggtcgatccgtggggaattgatcggtgggggttgcgttttgaaatgaggggatttgggccgcggtttggatatggatctgcgtgcgtgtctgcgacatctgacctcgaattttagccagggttttgttgatttctcccgcttcgttggggtttcgtatcatccacattatggaattatggaatagagatgatttaggggggaagacaggagcggtgatgtctgtccttcgattttttttcctgcttttggttgattgctgttgtagattttgctggataggcacgattcagggggtggatctgtggtttcgtcgatatgtttctgagcttagtgtggtagattttatttttgcggagttcagttgtgtgggttgaactcatgcagttgtgcagccaatgaatacgatctggtaggaaattatttcgattaagcttttgaaaagaaataaaaattgcactgctgaaccgattataatgaattgaaaagaaataggaattgctgtggcatttatacaattaagctatgatgtgctcatctccaaaaaaatgaattataagaaacggatgcaatatttcagtaccatatatcggccatgacatgcttattcctgcaattttagatgagaaattcatataagccttgaaaagttgaaatcttagcaggaaatgttgtttggtgttagaaatgagaaatgcggagcagtctgttttaagaaaatagggataattctggatataattgggtcctttgttgccaccggtcacttgtcttgagttgtgggctcgtacttattactgaattctgtatttctgatgagtgctacaatgatatatataatataataatcagtgttctccttgggtttagttattttttctatggtgagaattgtagttgttgaactacttatttatatatatttgtttctaattaagacaattgtggtcttcaacagctcctttgggtcattgagtagttatgttagagggaaatgataaaatttattttgttttattagtaagcattttcaggggtagcttaccagatactctgaagttttatcattacttcattagtaatgatagaagtgatactaagtttgatctgacatcattcagctgttgtcgtttcctcctacgggataatgtcactacctttttatgttatttccttatggttagcagaatgcaaatacgttctgtccttatgttatatttgtccacttcaagcaatttctttttactgtatcctaaactatttcattgcattcagactacctcaaggcgtcttgctgacaggaagagcgcaaagttccagaagaatatcacgaagaggggttcagtgcctgagactactgtgaagaaggggaatgactaccctgttggacccatggtgcttgggttcttcatttttgtcgtcattggatcatgtaagctttggcccttcactttcctattcctgtctgtttgatatttcagtatcccttgtggtgtggttcgcaggaatgcacatgcacaaaatagtatatatgcatcttcagctttatgaaatcaatctgactagctttatgactgctgagttagcattttgcactgaaggcctcctgtaacatttacttaccactaggttgactttgtacctccttaggaaaggttctcttttccactgtccatgttagctgtctgacttgttgaacaagatatttcttatcactcataagtttgtggttgaggttttccaaacatggttggccaaggtgtcttttcgccgctagatggctggatatttttcatttgatagtgcattgtaaacatgttggttgttgaaccatatatagtgacatatttctgaactttcttgtagtgttaaccaccataaaatctggagtattatccatgatgaatagaaagtacattcattcagggatgttgtttgtttttatatgttaaatatgtggcctgtgcttaaggaaatgtaaactgtgactactatcacatttacaatgtgttagaactgtcaattcaacaaattaatttcctgagtaatgcctatttcctttcctgccatggtccaaatgttaaattgttaataccctctgcaatttttcaagcccccatctaaaatataatggaaaattgagctttttgcttaagttcctcctaagatacatcaattattctcagctttcacttcccatatttcccaatacagtatatccaaagaacatatgtattgattgttgatacagttcattttgtacaaagtccttttctggcctacatgctataacagttgaaattaggaaatgtaaagctgcttctctcttgtgacttttcacttacatgtttccctattctgtgtttcagtagaattctgtcatacttttgcttcatacacgtgcctgttctgtctatccgtgtacaatatgcaacacaaacttcatttatcaactctgtgttccttacaaagttgtcaaaaaacggatggaaatgacagtctctaacatttggttgtcttgcagccttgttccagataatcaggacggcaactagtggcgggatggcttaaattggagctaaattcagttatttatgctgtgtctgagagagaggctgtacctgtactttgtagtgaagtttgttcctggatgatatcgtgtagagggtccatgttgtgtccgtttgcattttactaaatctaaactagatgttggtacctgaatcttacagactttaaacttaaatggatataattgaactttgatctggagactaataattagcattgttctttgttattttctgtagtattctgttttcctgcagttacgcaagcctatgcagtgattttcagttgatcactacgagttcctcttctgcatttcaatatgcaccttgagcaaatgcatatgtaatacgaaaaactagctattagacaaaacatcatgatggtttatgccatcaaaccttctctgtttgatagggtatgcaaatgtgttggctcaagttttgataagttaatagttaacaaaaattggtatgcaaacgtgttgttaacaaaattatccagaatatttatatatgatccagataaactgttagggcatgtacaaaggtagagacgggtatgagctctacgctatttagagtctaatgtcatacaacagttgaagacaatatggtctctactattaatgtatcaaaaacaattttcttactcatctttcctttctttgttatgcataataaccatatttctcattcctcctttctctttcttacatatcatcaaatttacttgcgcgataatagagagaccagtaataaagaccatcgtacatgcccataggctgttaaaatctggaaatgtgaatgtgtctgtcttttgggcatgaaagataagctggtttgtattctaagcatatgtcatgatactccaaggctgtaattcctgggcatggctctatcacaatcatcttcacaggggcgcaaaaatctctggaattttccaatggatctcgaatctctttctgatctgtgatgcttctgcgtagttcttgtgaacaatctcatcaggttcacccaaaaactaatggtccatgcagtccttgtgaagttagagatattattgccttgcattgaaatcagaataggaattctattcttgtgaatgcaagttagcttacgccatgtctagatcccacctcaaatttttttttccctgtcagatcgaacgtttgaacacctgtatgaagtattaaatataggctaaaaaacaactaattgtatagattgcgactaatttgcgagacgaatcttttaagcctaattactctatgattcgataatgtggtgctacagtaaatatttgc

SEQ ID NO: 1310 - DNA, 18587 bp, Oryza sativa
ccgtttaattgattattgctccctccttccacaaaagttatactctacctattacttttgttaccaagattaaggagaaattaactcatgttgcaggtaacaaaaaagtgtatgcacgtttcaaccaatgagtattaagatgactcctcggattctgatcaaacatttaatttacctctccatttaagtcttagatgtatatagacttcaaatataaataacttatttggaaaaactaaaatataaaatatgtccaactcttttggatggagggagtaattattacaaacttaaaaagatggttttatttaagtttttaaagaaacctctatataaaatgtattttaaaaaacacattgtttagaagtatagaaaacatcatcacccctaaactcattaccgaacgagcctaattgcttgcttggtattttaacacggaccctatgaaccaattaaatccttatgttgactagattgctaaatcacgtttcagaggagtaggttggaaaatgagttttgttctcaggacattatactccagatttgattgagctcctgcgttcgtacctgaagctccccaacttctctatctcgttttccgtgcgcacgcttttcaaactgctaaatgatgctttttttaaaagtttttatacgaaagttgcttaaaaaaatcaaattaatctatttttttaaaaaattagctaatacttaattaatcatgtactaatggactactccgttttccgtacgtagaggatggattcccaacccattctattgaacgcagccatattgacttgtcatagagagttcattttgtacacaaagtccttttctcgcttacatgcaagaacatatcttagtttgcactgtttgagtactacaaatctttcaaggacaataataataacacatcagcatcagtgaatggtccacactccacacaaccattttgtttaatcaagagcacacccttaaatttttcaaagatattttatggatggtgagatctcagcaagaaatggacaagaccaatcatggctcttttatgtctccaaatagatggggtttcttgccctggctactcttcaacttcaagtggacaaccataagtaaaaatgctccacaataatcagtaaaaacattcaaaaatacagaaaagcaacaggaacgacattcagataaatacagaaaagcacccgttatagttcaaaaggaatcattaatcaggtcaaatggacaatcaaatagagaactaagccctacaaccaaaatacatagtactacctgcgtctcaaaataagtgcagccgtcgatatctgtgtccaacgtttgaccgtccgtcttatttaaaaaaattataaatatattttttaaaaatagtcacatataaattactattcatgctttatcatctaaaaaaactaattatataaaattttcaaataagatgaatggtcaaatgttgaacataaacagtgcaaaactgtaattattttaggacggaacgagtagttcgttttgatctattgctagatggattctagtacagatattagcagttattacctattccactagacatggatactcattaaatccatggtgatgttaggcagcttagactattcatcaaaataatccaattgcttaaggtatataaattaaagtcatcttgcccccaaattagcacttaaccacaactacccaaaatggccaaatccaacaaattaacaaacgaaaatcatttccatcatcatcaacaaacagagttgtacaaataattcaacatgcatctaaagaaaagaggaaccttcaacaagcatgtggttattccatttctcccatacaacaaaacaacaaaacaaatacattcactgaccattcctgttctcccatgtgctttgagttcaaaggccaaaactatacacatcatgagcatgtggcaagcaatccaagtaccaccctagcacataggaaactcctatatccctacgacaagtaaaactcgtcattttccaatttaataatctacatagaaatgattttgtgaaggtgtgtgacattttgtttgagcgacactcaaaagtactatctcttaatgccaaataaaaagttatacaacctccgtccaaaaagaatacatttctggctgcatgcacggatgcacctggattgtccaggtacgcacaaatacattccttttggacggaggtagtagttttatgttttaatgacaaacaaaacagtactccaactgtaatacaacaacacaagaacatggcttgtgatatgtgtccgatcaacacttacattataaaccatactctatcacaacaaataaaaactatagttttcctaatacaaggacttcaaattttcttttcgaaaatgttattcaatcattaatgactaataacaactataccccgaaattaagcccaaaacaaaaatcaatcacaattgctacgacatttctcctacggtccaagaatgaaaaaactatgaacctgcgagtgcgtgcaatatgccatctaactgatattgccaaacaaatacttcctctattccgtgttgtaaggtgttttagctttgagtcaacttgttttaagtttgatcaagcttataaaaaccggtcatatttctaacataaaattaagatacattcgatgttcgatttaacgaagcaaacttggtattgtagatgttatgttttcctattaatttgatcaaatataacaagtttaagttaggagttaggacaaacttaaaacaccctctaggagtaaattttttttttttgagggaacactaggagtaaaatctgatgtgacactaccatgacatttgaaggtgtatcgctagccaaaaaaactctcacaagatatcatcacctattccttttgttattgcaatccacatcttttcctctcatggaccatgtggttgctagcaattttgtctagtataaatcaacgccacaccacttgcctagtcatcaacacatcaaaaatattcatctttaattttttttgaattcatttcttcacgtaaacatcctactccatctctctcattacactcctttcaaaaacctccaaaacaaaaagaaaaaaaaagaagaagaagaagaaaaaaaccctccaaaacaaaagaaaaaaaagagaaaaaaagaagaagaaaaaaacatccagatatatatagccatactgcatactgttgtagctaattaagctatagcttggtaatccgcagccatggcgccggacgtcgaggcgcggctgctcgccgcctcctccaagccggccaccgccgccgccgcctcgctgccgcgccgcaacaagtaccccttcttctgcgccgtcctcgcctccatgacgtccgtcctcatgggctacagtacgcacgcacaccatcgatcacaccgtcggctagcctcgccgcgcgcgcgccgccgacgccgccattgacgttcgttgtttggttcttgcagacgtggcggtgacgagcggggcgcagatcttcatggcggaggacctgggcgtgagcgacgcgcagatcgaggtgctttcgggggccatcaacatctactcgctcgtcggcgcgctgctcgccgggtggacctccgaccgcctggggcggcggctcaccatcgtgctcaccaacggcttcttcctcgccggcccgctcgtcatgtcgctcgccggcgggtacgccgcgctcatggccgggaggttcgtcgccggcatcggcgtcggctatgccctcgtcatcgcccccgtctacgccgccgagatctcccccgcctcctcccgcggcctcctctcctccctccccgaggtcacccccattcatatcccaaacttcttttaatttactaaatttcgatcgaatttgggcaaaatagctttgaattttgtgatggtttttgtgtttttttgtttgttgaacatatttatcaatgggagagtgatttaattactaaatttcgatcgaatttgggcaaattagttttgaattttatgatgattttgtgttgtttttttttgatttttgaagatatttatcaatgggggagtgatttagttactaaatttcgatcgaatttgggcaaattagttttgaattttatgattgttttgtgttgtttttgttttttgaagatatttatcaatgggggagtgatgctgagctacgtgtcgaacttcgccttctcggggttgccggtgcacctgtcgtggcggctgatgttcgccgccggcgtggtgccgacggtgttcctggcggcgggcgtgctcaccatgccggagtcgccgcggtggctggcgatgaaggggcggcgcggcgaggcgagggtggtgctcgaccgcacgtccgacacgccggccgaggccgagcagcggctgcaggagatcgaggacgtcgtcgccgccgccggctccgttgccggcaacggcaacggcggcggcggcgcgtggaaggaggtggcgaccaagcccggcgtgcggcgggtgctcgccatcgtgctgacgctgcagttcttccagcaagcgtcgggcatcgactccgtggtgctgtacggcccgcgcgtgctcgccgcggcgggtgtggcgtcgaacaccctcctcctggggctcaacgtggtgttcggcgtcgccaaggcgagctccatcctcgtcgccatggcgctcaccgaccgcgtggggcggcgcccgctgctgctcgccagcacgggcggcatgacggcgtccctcctcgctctcggctcggtgttcgccgcgttcggcggcgcgagggacgacgcggcggtggcggcgggcgccgccgtcgccgtggtggtggcgttcgtgtgcgcgttctccgtcgggatcgggccgctggcgtgggtgtacagctcggagatcctgccgctgcggctgcgcgggcagggcgccggcgtcggcaccgccatgaaccgcgtcgtcagcggcgtggtcaccatgacgttcatctcgctctacggcgccatcaccatggcgggggcgttctacctctacgccgccatcgccgccgcctccttcgtgttcatctacgcctgcctgccggagaccagggggcggagcctcgaggacatggaggagctcttccacaccaagtgatgatctcatcttccatcaatgaatcaattcacatatatatgcatttgggttgttgcaacattttgaatggaaagtttgattctttcttggtaagattatcaaaggtttttcatgttcatttggctgattaattggtatactataaatttattattactgttgaaattgacatgtaaagatcggtgggacagtggatacatactggctgaatatggggaaaagagaaaagtttagaacggagggattttgtattatagaaagaaaactaaaacatgtgtgtttaattttgtaaaaatcctgtaaattttcttgacgagcctttatcggttggttttgctatttatcaggcgagccatatctcaagttccaagttccaatctctactactagtctagtgggtacagaaggactattttaatgggaggttaatgggaggcctaatttgggcatgatttgctatttgctctgctaaatttcggctttggtccatatagcctgtttatccacctacattcagcctaaaacaagtatactagaccattgaagctagatacgacaaaggcctaattttggctcgttaatcctctcaagtgggccaaatttcatttagcacgttaaatatcagaagcaggcctaatatgggaaaaagtacaccgaaggtccctcaacttgtcatcgggataaaaaacatcctcgaaccgcaaaaccagatatgcgaggtcccttgactatacaaaaccggtcacccaaggtccttcggtggttttgattccagttttggtctacgtgggccccacatgtcatgtgtccacgtcagcctcctctccctctttcccctcttctcacccttcctcatctctctctccccctcccttcgtcatcttcgtcaatgtcgcggcgaacccgcggctcggcgaggccgcgctccggcgggtcggcacgtcggctgcggtggtggaccagctggtggagatgctcagctggaacggcgccgccgaggccgccgccagggcgtccgccgcgctcgtcgtgtccaagctcgccagcaagaagcggaacacgctccgcgtcgccggcttccccggctccatcgagtcggtgttgttgctgctctacatcgccgacgaggagtgcaacctcctaggcctactcatcatcaagaagctggcgcgcgaccacgacaactgcagcaagattggctacgcgatgtatttgataggtggatgcacatgctgtcaaggaaaaaaccaagttccatcacaattgagttctcccgtgggaattattaaaagactccatcatgcctcttctctatcagtgatttggaatatctacagatagaaaagatgcatcatcagcttgtctcgagagtttgaaggttttaagcagctaattgttctgaatctgaaatatttctcctcaacaggcagtgacataaataatctgatctcctcatgccctcggctgaacacattgcgtttgaaacattttaagggtatcaatcgtctccgaattcaagctcaagcactacaggtttaagaggttaaagggtcctttgaagactttcatctgcatgcacctaacctgtccaatgtgtatgttacacttgacaaaacaaaagttgcagataggagtaaaaactatatgatgcaagcttcgttagactaactggaatagaagcacttgttatgaaaagatgtatggttgcgttgcctcagacgtttgaaggtttcaagcggctatctatcttgaatctgaaatatatatactcaacagacgcctcctcgacaagatcattgacttctccgccatcggcggcggcgccagcggcgccggatcagccgtgatcacgccgtcgtgcgccaaggccgtgaagcggtcgctgcaagtgatcaagatgctcgcggagacgacggggagcaccgggaagctgctccggcgggaggtcgccgagatcgtgttcacggtgagcaacatcgtccgcgccgtgctccagcacgaagccgggcacctcgagctgcagcggctcggcgccgaggtgcgccgcggccgcgtggggcgtagcctgccgccaccgccacgccttcgctttcactccactccgcatcgttcacacgccgcctccgccggcctcatcctcccgtccccgctgtccgccacggagagatcgagtgccgccgcatcctccagcaagtgccgcttcgatggtggctacgtcacccgctagccgcccgtgcagctgcggcccctccggctgcgcccacccacgcgccgttctgccgccccgcggctgcgcgcgccgggcgccgcccgtggagaagatagagagagaggggagaggtgaagaggagatgagaagaagagactgacacatggggcccacgtgggtctcacgctgactcagccatcgatggccgtggtcaaagcgccacgtaggacaaaaaccgggatgaagggacctcggatgaccggttttgtatagttaagggacatcgcatatctagttttgtggtttgagtatgtttttttatctcgctgacaagttgagggaccttcggtgtactttttcccctaatatggtaagcctcattaaaaggcccataaatagacactgaaggattcggcctgctcaaattagtaagcaggccaaatttcagcccattgtgaaatgtgaacaacgtcgtccgaaggccgaatttggctcaataagttcactttatgtctcttaatttgtcaccgagttaaaaatttatccctccaccgcaatatagggggggggggggggctaatgggcgatcggtcgcagggcgatcgcccagcgatcggtcccgccgccccccactgccttcttccttttcttcctccccttcttttcctattatagtacaccacaaaaatttttttaaaaaacaaaaagatagaaaaatttatgtataaacaaatttgaattcaaattcaaatttgaaatcggctatgtaaacttttgacttataaactttggatatataaactttaggtgtataaactttagatgtatagaaatactatatatgaaaaatatttgaattcaaattcaaatttgaatcggatatataaacttttgacttataaacttttggtctcaaactttagatgtgtaaacttgaggtgtataaactttagatacataaatttattaaaataggaaagtaatgcggtgctaaaaacgaaaaccagaggggggggggggtggagaatcgatcgctcgcccgcccagtagcatttccgaatatatgaccgtccctggacttgtaaaaccatatctactttcatcccaagataatatggttgccagtttcgttcaacccgtgctaaatcagcgtgggacttcctctcacctcgctcgcctctcttccctgtcctcaccaaccggggatgccagggcgcgcgccgcgtggatataggggtagcaccatgccaccatggcgagcttcctggtggcgtgggggctcgccacacggcagcctctcttcgtcaccgtgccactcggtttgcgtcgagttcgatctcgcacgggaagacggagttacaaggcgtcggcgccgcccaagaagaacggcgcgggagacgacgtggacgggtaggaactcgatcgacgcgcgcacgataagatcaagatcgaggcgcagtgtcgttcttgttctcgtagacgccgatgaggaagacgaccgtaccagaggtgcagaagtcgccggtgggcggtggggtcgaaccggtcttgctcccggttgccgatgccgtcaatataatgtacgtagaggttggtctgcacctgcaggtacggttcgccggtgacgttgcccaggaaaactcgaagtcgatcgaactcgtgtgtgcttgtccctgccggatgacagctgcgagccaaattcaatcacgactaaaatttagttttagctccggtttttaatattgcaaccgcagtaattattaattaatcgaataatcaggtgattagtgaagagcggctatctttaaagaaaattgtcttactgcacgagttcacctgctgctgttctttgtaaattggtctttggtagctttcccccgacagacatggctagctcgaggaggagcttaaggaggtcgctctcatacaagtgtcttgagctactaaaaattttagcgtaaaatttagatatcaagaggtactttcgtaaattttttcctacttcatttatattatcttttataattttcaatttatcaatttattttatgttaacataacaataaacactaactagtaaaaacactaaattcgaataataggaagtactaaatacaaaaaaaaaagatcctattacaagaaaattttcttggcagccaaaaaccgccaaggtaataatttttgtcagccaccgaccaagcaataaacaccaaggctagagaggcagggatatccagatttcttagctactaatcatgaggaaaagttttctcagtggtcaaatcaccaaaaaaaaactacagagattgcgaactttccaaagcgccaagaaatatggccttgacggtctataattgtactatatttatatgataaatttttaggacaatatttgtcgacaaatatatagatagtcccgatggggggagaggaaccattatattccaagaaacacccacataatcaacggggaaatttgaaggagaattcaaaatacgaagtaaatgctgagaattcaaacctttagtctgaacaatggcattctgcaggaggtggaagtgaatgcgaagaattcaaaatacgaagtgaatgctgagatgctttccttggcggtttgcgttcgaactaccaagaaaaatatagatttgtttgtcggttaggacaactcacaaggaaatcttccgaaccttggtggttctatatagccgccaacaaaatatgtatctacttggtggctagttttagccgttaagagttaagacaaagggtaaagttggcggttattgtttgaccgccattgaaatcagctggctgctaagaaaatctgtacgttttcttgtagagttgtagtacctactatactagtgagctcaatgattatcttagcttacttggtagttttcgttaagttaaaagttcaacttctcttggttcattataacaatgtgatcgagtcaagcttcttgtttttcatcactaatagcatatgtggcgccacgtgagatagctggtttgataaattatgtcagcttgatcattgcagcatttttgttacaggatgccatgctgttgcttattccggtaaacaacaagacctgttcaagctgtgctctgctggccatctatggcaagctcatgatctgtgtcaagtacgaatgtacaatccgcaaataattatcgagctggccctaaaacaatgtccagtttgtgcttcttttttgaacggcaacaacgtatactcaacacacccttttgtttttatttcaaaacttcaacgcttctctgagcatttccaaacatttacaatcggcaaaaaaatcgtcattcgaatcctaaaatgtgccgttgatgcaactacaaggaaaaccagctgagcttacacttaagtaatccaccaatggtagtaatgaacactgcaaaccaccggtgctgtagctgggcaaatattcctcaactctctctttttttaaaataatggaattctattttaaacttaatcaactttagcagcatttgcacgccatcaattttaatttccactatgatgcttatgatcactacgtaagtattaagtaacatgcatagtataaatataaaggaaccatgcaaacgatactaatatccatcaaagcagctagctagctagtgtaaaattataagtttgtaatcctgcttagttgcattctctgcctgtatagctttttactgtagtccaccattgcgatggaagtgccggagatcgcagtcgaagtggcgccggagatcatcatcgccgtcgaaatgccggaggcgatcaacaccaccattgtgcggctccccatgtacatgcaggaggcgaacaagggcctgttcaagccaagggtggtctctatcgggccataccactacggtcaggggagcaccctcgacatggaaactcacaaggaccgatttcaccatgctttcttccagcggttaggcaaccatgtcaaccatcaagacttgatcgctcagtgcactgaaggtgcaatgcagtgctacaacggcaatgttgacttcaggctctacaccctggagaagctcatgcacgacgggtgcttcattcttgagctcctcatccagtgggaagagggagagcatgcccatgtcgatgatcacatgcgattgatgtccaacagcatatactacgacctcctcatagtcgataaccaggtacctttcttcgttctcgctaggctgtttgaagaattcaggaggtacaacggtgaacatcctatcgtcctagtaaataccccgttggttaacctcatcagcaatttcttcaactatgatggccagttttcctgggttcattcaaacctgctgaatgaggatctccctaatgcaaaccatcgccatttgcttgagattcaatacaaccttgtcatccgcagaaacaataatagaaataacaatgatgagcagatgcattattatagttgcctgtgtggtttgtgcagcagaaacatttgccataaatcacctatgccgctaggaatccctggggcaaacgagctgcaagactacggcgttaaattccatcagaaagagaatcaccggatcaccgacatattcgacgtgacattctcgcataaaacgatgagcatccctcagttcaagatcaacttcggctccaagatcctactggcaaatctcttcgcctacgaccaaatcgctggccaacaagggagaaataataacggcgtcgtcgtaggtcccgtaacgagctacgtcgcgctcatgaacgcgctgatcaacacgaagaaagacgtgatggttctacagcgggagggcatcctggacaacctgctgtcgaacgaggaagaggtggcctccttcttcaacaggctcggcagatgcgccttggtggatgtcagcaaccaccgttacactggcatgttcgaagatgtcaacaggtactggaggtacggatgttgctgcaagcattttgtcacctttcgcatgaagcattgcaggaacccgtggacttgcctctcgctgatgggtgctattttgctcttgtttatctcattgatctccatgatctacaccatcctccaatactacaaccgtcggcagtaggattggcacttcgtgtgtctatgatcgcagcaatgcatccatggtgggagaatttactatttgccactctatcaaaataccagtgctcaaatgtcactctctcaaattttcattcccaaacgccaatgcgatccctacctgttgtgttatttattgccgttaattaaatgtctagctagtttgatcaagagacgacacgtacagaggagaactctcaaaattcagtagccatggaggaagaatcagctgattaatttgatcgagattgctacttggttcatcgcatgttcctattttaatttgtaatccatgtgtgagaatgtatttttaattcctgtttttacagccatgtatacatgttctatctgcttgtataaaagttgctcagttatggatcattaataaaagagattttctactttccatgcctaaaattttgtaaattattagtcacctagaattgcacattgcgaaatctaagttgcagcaatgtgcaattttattgatatacatatatgtttttactttattttttaatctaagtttgatttttgttcatgctattttgtaaattttcatgagttataagtttatttcatgtaatgttgtaattttttatgtgttaaagtatttattgttaagccattggggagagataagtaataaataataggggagttatgagaaaaattaaattatcatccagggaaaaaaataatgaaactctttaaattttcaagcgcctgaaaatttggcacccccatctgcatatatatgcctggtcggctgcgatcttttaagatcattctcgaattaatgagaattggtggattatctatttatttattgactgtaaggaagaattaaatactatctgccctatgaaaaataagtgatctaaaatcatatttttaaaagtctgggggtatataatctgataaataaataaaaaagtaagaacagtgacttaattattatgctaggctgattttaattattccctctgtccaaaatataggaacctgcgttcgaatagtttttttagtttttagacttttttattttttaattttattaatagacattttccaaaagtatttttaaatatgaactttttggccataccagcctatctggcgtggtcaaatagctttgtcacgccacgcgcagctagcatgtcggctggggtggccaaaaggttaagtttttgaaaataatttttgaaaatgtatgttaataaaattaaaaaatgaaaagtctaaaaaataaaaaaatttctgttcgaataagacatatcctagtaatatgaatcagacaaactatctagctagattcataatagaaaataatcagaaaagtaagaatggtgacttaattattacagtaggcttattttaattactccctatgtccaaaatataagaacctacgatcaaatgggatatatctagtaatatgaatttagacagactgtctgtccagattcataatagaaatgttccatctgattttaaatttttatattttgagatggatatagtaagctactcgcggcatgccaattttgtaaagggagtatcaaattcgacatatatggcacaaatgttccatgatcaatgcctgcaaattttgcttacgttggtttatcaaaataattgaccaatatgtgacgtcacatagatatagcgtcttaattctgtcagctaataatcgttcaccaatgtgtgagaggatacatgttcttatttatttttatttttctcactatggttgcttatttcggacaaaacaacaaaaacttagtattcaaaaacgttatatatatacatgctgacatgttgtgctctgcagcaccattcctggcaaacaaatttactatacgtatcaagtacgaacgtacggtcagcaaattattgtcgaatgtattaatttgactattgcagcacctggttttgcctcttaattttatcaaaagcaacaatgtactcgacgccgtgttgtcgttgttactcaacgcttgttgtttcgattattgcacaggacacaccacaacaacatttcttattcttctttcaattacacgtaagtgtgtaagacatatacatgtatacaaaccctgttaaggcgtgcacacatccatggagcgatccctaacacacgttgaaaaaagacaacaacaaaggaacaaatccttgatctcactaaataactattaaaagtatatccacatgcagtagtgaacacaatatgattaatttttaggaggtgccaatgcaaacataatatatatgtggtgggcaaactatatataagaaaaatataaaaaagataaatatatgaaagtatctgtttagaaaaaaagaatagaaaaataatggtttttttttacttctttatctttttcttccatcttgcaaacattctatttacaaaactgaagtgtgtaaagaatatacagtgggtttatccaacagtaggaggggctcaagcccaccttgctccttctttgggatcgtcacttcccatctacacgtgtgtaatattttggatatcagaattgaaatcaaagtaggtaaagttataacatatggttaattgcagaccccatgcatgcaacttatatgcttcactagcaaacattttaatcatatacaaatttacaattagcaaaatgaaaaacctcattcaattcaagtcctatcatgtacggttggggcaacttggccgcttatcgataagaggaaggatcagttgaccatacgcttgagtatgtactttctccaatggtatatactacctccatattttaatgtatgacgctgttgattttttatccaacgtttaatcattcgtcttattcaaaaaatttatataattattatttattttaatgtgacttgatttatcattaaatattctttaagtatgatataagtacttttatatttacacaaaaattttaaataaaaagaatggtcaaacgttgatcgaaaagtcaacagcgtcatacattaaaatacggagggagtattaatcaatacccgaacacatccagtggcgagcttcagggtctacagctgggaaaatatatattccttaacaaatttaatttgactgacttttgtagcactatcacgccataaattctattttcctctatgacacacacgattatgtaagtaacatgcagctctagccgtgtagcaccatgcagtgaacattaatccatcaaccaagcacatgttgcctgtttggctagctacctgggtacgtaagtttttagttatccaccattgcgatgaatcgagaccaagatctgaatgatgctgtcactacaacagaaataatttttccgggcgatgacccctgtacattgtagacaggccataattatgtaaatcgttccacgggagatggctcaaggacgcatacgaaataggcaagcgataataagtgcatcatcacaagctagagggaccaattaacggggctgtacgtgaaaatatattttcacaaagcgggcacatggaaggcacgtgggccccatgctttttctcgcaccatttttcttctctccatctttctctccccctttttctctctctcttctcacgcggtcatgccataactccttcgatctctcccactccctatcctcatgtctgcacccttcccttatcttctccggtgaccgaggtggaggcggcaatgacgaagactacgacaatggcaggcctcgagagtggtggatccaacaccgccaccatcgggaggggcggatctattgtcctcggcctcggtaggggcgatgatgatggggagcggtgacagtgaagctcgagggtggtggatcgagcaccacatccatcgggaggggtggatccatcaccctcggccctgggagaggtgacgacagcggcgagcaatgatggtgatcctcgaagtcggtggattcgaaaccgccgccctcgggaggggcggatccaccgcccttggacccgggaggggcgaagatgactgcatcgacgaagtcaagggggatgggaagctagagtttcggccgaattttgttttttgattttatttgccaaaaatatttttagttggctggcttaagcacccacatgcgaaaatccaattttcgcagacacctgggtacacctaggccacccgcacgcgtgcgaaaattgattttgaccgtatgaaaaaattgtttttgtagtagtgtatccaagcgcatcctgtggaggagattgctgtccaagtgaaggagcacatcaataccatcgtcaaggttcttcaaaggctaattttaaaaagtatgtactgggatgtaccacctttttcattataaaatttggtatctccaggtattaggtgccaattttttttataaaattaagatatcttaatatgctttctcaatgatcataaaatttctcctccaaatacatgcggaggcaataattagatctcttcgatctgagtctagggtgatctgcatcggcccctatcaccgcagtaatgagggtacccttggcatcgaagattacaaggagcgctttctccagggcttcttccagcggtttggcaatgtgaattttgttcactacactgaaaatattgctgcatattatattagcccatgcgtggatataaatggccaaacaggccgcccggcccggcacgaccctggcacggcctaataaaactcgaaccgtgccgggccgcctcgaaggcacgacagcccattggactccaccatggattaagtctatttatcatctctcaactctttgggatgtgttttatatggctgaaaataagcatattttgtatttctcttgtctatggcctttcttatatggttgattaagtctatctttgatccctctactatttttcttcgaccatgccgtgccaggccagcccaccgtgccaaggcatcggcccaggcacggcccaactatcgggttgtgccgtgcttgggccgggccaaatagtcatgcctttggccgggccatcgggcgttatgaccatctatacgtgtgggcgacacggggtctcaatattgaaagtttgatgctaatttacactttttatattggttatttatatattttgcgagaaataattgttttataattaacttttggccctttcgtcgttggcgaaaagccaaaatcaggtcctttcacataggacaatagccaaaatctaatgtaagtatgtaacgtaggaaattagaagtgcatattatatctctgaactttaagtaaagtctaaaattcaaccaattaaaagcttctagtccgtatactgcatgcaacatcaaacttctgttgaagtgcccggccatcgaaccatcagagtgataaacaaagtgcaaacggtttgactggcgacccaattagctagattttggcatcacctaacacgtttcttatatttcgaaacagacgtaatagtagtttataaggttcatgcgttgactggtcacaataacgtatcctttccaactctagtaaataacgtatcctttccaactctagtaaactactccatattaggttacttcatccgtctcaaaaaataaatttatttttcacctatctcacatatgccaataaaaaaaaatccctactttaccaaatcctaataaaactactttttactttatctatttttaatataattacctatactttcatagactctgatgtaatgattactctaaaaataaacttattttgaaacaaatggaagcagctaaaaataaacatattaaacagaggtagttggatttagggtgtgcatgtgtgttgactgttgactgcaagagcaaatctcccccattttaatttaattagagggaggatagagacaacaatggatatatataaggtaggtagggtggttaggtgacgaaagagctacctcagctttagagacttgagatcctaacttaatatcaacaagaagctagtaattaacaagatgaaaggggaagcaacaaaaacaaacttgactgttatcaacctagtttcccgtcacgttagcacgggcactaatagagtcggaaaagacgatgaaatgaagaggttggaatgtgaccgatcgcgaggtagggagagagtggg

SEQ ID NO: 1311 - DNA, 25152 bp, Oryza sativa
aaagtactagcgtatgtgatgttacatgatagctgcttgattctgccatctcataaatcatatgtaatgtccagttcatcccgtgggaaacacacgtgtttttgttaactttttattggagactaggccctgttgttgcttatttcagaataacaaaacctgttcaaacaattggcaaatatttgtcgaggccctaagatgtctgtcagcatctacttagctgtgcttcttataggatcgaatatggtatttcccaccttaaaagctagccaataactaccagacttagcagctaccatgtaggcacgaaacccacaggaaaatacgttttaccgtcagagattattaacctgtagaaaaatgaccatggagaaattccattttccttgtagttttccctacagaaaaacaatgagatgagggattccccacttatgtattactccaggtcctctgtgcccttccacaactaatatgggactattcaacacttcttttctgagaatcaacaaacatattcgataccctaccgaatttcgccgttgttattttgaaaaaataataatcaaatgctagttaactgttcttattgaagttgcatggcacattagatggtttaattatagtatagctaaatgctagctacaataattgacatgcacatatataatcatctacaaccaatgtagtagctcatctatacaatagttataaatatatatacttacgccattagtacatggcacacctcattgttgtctcacaaagtgtgtgttacagccgaggcctgtgttgtagccaggtacaaatttgttgcccgtttctcttctcttcaacttatcacaaatatgatatgcaattcttatagtccgcttttacatacttgctctaacaacaaacattttgatcaactacaaatgtaaaatcagcaaagaaaacatttaaatcctaaaatgtgaaataggtataggttggccacataaagtgagagactgggagttactctaaggaaaatctgttaagcctatgtttggttggagggaattgttaggagagaataaaagtttgagaggtgggaactgttaagtttactatctattggttagtaggcataggagttttagaaggtatttagaagtgaagtttaagagcaaatgtataactttttaataattaggtaggaggagagaataaaagtttgagagctatttagaagtgaagtttaagagcagattctaccttttcaattaggtaggggtggtagttagcagggaatttccatgacgaattaatctaagccatacattattacttataattcaactcccacccgaatttttcataattctcgtttgtattaccagacaagggatgacggggagtaaaactaaaactccgatgaccaatcactccaccaactccctcgtctaagagcatgccgaagagaagtctaaaaattcatcccaaaattatgatattgggattccaaatcatattttaagatcgataaaattgatttttctctccgacaaatatatcaaaactgactcttaataacaaaaagtgagctcattctaccaacaaaaacaaaaatccatctcccctctcatgggcgcacgccacatgtttttcttcccccctcccataggggaacacagtaggattgggagcgaacatatcccttagtagaagtagagggcgaaaattccagagttggggattccaagttctgctttctatatatgggtacttttggatttgatattttccaccagagatcaaataatttggtattgaggttgatgtcctcttactaaaagttgccaaacgcacgctaagattaagtacttccccaatgggtagtagtaatattaacaccgtgaactaccaatgctgcagttgaacaaacattccttacttttttagcagcatgcacttgcacgccatcaattttaatttccactgtgatgcgtaagtaacatgcagcaacacttagcagcactgtatatataaagcacaacacagtggtactaatccatcaaattaaagcagtgcgaaaagttatagctatagcttgtctatctatccctaaaagacacaattgtctgcctgtacgtctagctagctctagttactagactatggcaatggagatgatgaccaacaccaccatcgtgcggctgcccgcgtacatgcgggaggcgaacaaaggcctctttgagcctagggtgatctccattggcccctatcaccgcagcaacgagagcacccacgacatggaagcttacaaggagcgcttcctccggcagtgttttgccccgcctctaggtcatatgaatcttgaacaatgcattcaagacattgctcgtaattctcttgcagaagctctcgagaattatagtggcaatgttggcgactacaccgcggagatgctcaccctggacgggtgcttcatcattgagctcctcatccggtggaacatgggaagactcaaccatgacagttacgtgcggtcgatgcggaacagcatatactacgacctcctcctggtcgataaccagatacctttcttcattctctctaggctttttcacaagttgaagggggatgaagagctcgacaacgccgatgttgagaatgagttgctcacacttgctaagaaattcttcaaccacgagggtcaattctcttgggctaagtctccaggcctgttagatctttctaatgcaagtgaggttcgtcatttgcttgaccttcagtacaagcttatcatcagcaccaatgacacgacgattagtattgaccagacggacaatagttacctgcgaggaatccctggggcaaatgagctcgaagactatggtgttaaattctaccaggatgaggatgaacacaccaaaatgtttgacgtgaaatttgagggtacaaacatgatgatccctcgctttgaaatcaactttggctccaagatactattggcaaacctcttcgcttatgaccaatcaagggacaacgtacgacctcatcaaggggaccaaactgaggaccaaccggacaacacagttggactcgtgacgagctatgtggtgctcatgaacgctctcatcaacaccaaacgtgacgtcatggttctccagcgtgagggcatcctcgacaacctgctgtcaagtgaggaagaggtagcatccttcttcaacaatctcggcaggtgtgccttggtggatgtgacaaagcatcactacactaccatgttcaacaatgtgaacaggtactgtaggaacccattcagtcttggaaggcacttagtgatcttacgcaggaagcatttcagcaacccgtggactttcttctctctggtgggtgcacttatgctcctaggcttttcattcacctccatgctcttcaccatcctcaagtataaacatcgctagacactagcgttacacctcacgtgttcagtgttctcacgttattttatgatctcgcaccaaatgaatatgtgaccgtgctatctatttatgttattactataatattttgtataatgtcaccaaaaaatatcgttccatcaggagacagaaggatctaaaaaatcagtggccaaccactcgtacacatgagtggatataggaagaatccaatcgagatgactacttggttaatctgttctctcatgtaattttttttttcatttcatacattccctgatcatgttacttcttttagtttgtaatccttgtgtgtggattttatttcctgccttaattcctgtcatgtttgtacttctacttgtgtaaaagttgttccccatctttatcatgaataaaatctgtgttactgtcgtgtactgttttgcaagagcacttatctccctaaatattttttgaggggttcactgcactacacaaatcctatatacttatatagttcatccccactaagtgtagttaatgttatttctctcttatctcattaagccacatcatcccaattatttctagcctttgaatgataaatttatggtctaaattgtctcttctttcttctcttataaaacatgtaatcccaattatttttgggcccaaaattgtatcaaattattttagttttgataatcaaattacattttatttgtacatattatgcaaattaattttccgcagcaacgcggtggggtattcatctagttacaaatacaaacaagctcagttaacattctccttattttttctccatgtatatataagtcatgtttcattgaatttttgtgaggtggtggatggcgtggtaaagtacattacaaaatattaccagaaatataatgtatctgttttttttttgtcttttacggtaacttttacaagtggtatatatagtacatacaacagtatagttaataaatccaaccactcattaacagggtaatttgggcctttaatccgacaacgatattaggctattctagggttagggtgtgtttgcaagaggaagttgggaacctatctcacacggaaaatgaaacgatccattagcgcgtgataattaagtattagctattttttttaaaaaaatagattaatttaaattttttaagcaactttcatatagaaactttttgcaaaaaacgcaccgtttagtagtttgaaaaatgtacgtgtagaaaacgagggagttgggttgggaagcaagaggtccgaacacacctagcagtttgacatgctccttccatccactcggcctcttgggactagctccgctaccgccacttcactgccagctatagcagttgcgaaatttggcccatacgaactcctaaattcggcctaaacatgtgcaaatttcacccgaaaatgttgctgcgtggatatatattatgacagcgtgcggcgccgctggcctcctcctccatcgctgctcgccgcggccaggcttgggagcagcggatatgccgccgacggcgctcccgggcctagggcggccagatcacgtggcggcggtccccaggtggctcggcgatggcgtgcggctgcgtcgacggcttgcagcggcggccccggggtggcttggcgacggcgtgccacagcgtcgacggcttgcgcagcgccagccttctccgccgcggcaggcctagtacggctcggtggcagcggtgcagcgacgacggcggaggcgtcagctgcgtcattcgtgagcctgagttcttgagcaccgaggtaatggtcagcctgctcccctttgatcgggtctcatccttcgcgagcctaagttcttgagcatagaggaatgaacagcagcagtacttggtttggctgggttgagagcagatcttggaattgcatgatttgtagagggatggggagcaacagtctcatccattttgctatgcctgagtgcctgactcaactttctatgcctaatccaacaatcttgctatgtagaagtcttactgttttgctatgggttacattatgattttattgtgcctaactcatgaattttgctatgcctataccttagttaatttcatgaataatatgctattgcaagcactaattgagatgtggtcagatccaaggcgcaaaggtatagacttggaatgttgttgaaatcatgatactgttccaaaatcttactactttatgtttaagatccatgtattatatatgtagtcgtgcttacatggtattgcctactataagatccatatattatgtatgtttaagatccatgctgcatttgatttcgtttagttctacacgttctttctcttctcttcaattctcaacttatgctttgtaggtgttgatccgaccatgttggttgtctactccaataggtgatggtaagagcagatgagaatggtgaaggtaaagctggcctaggtgagacctatgcaattcattcttcaataatccgaaacttcttgtgttgttttttcttaatcctggtcacatgaacatatagcatttttatccattaaaggggaaatttaagtctagtagttagcagtcattttgtcatgcgatttaaagtcagttttgtggttttgtttgaagaagagtacttagcagttacttgctaaaatcgactctgttatgcatagtattaaagtagaattggtatatggatggtttttgttcaacgttagtacaaaactagtaaagctcaggggataagagagctgttgacgcaggaaagttgtgtgttgcgcaattaacaggtgtcggtttaaatttaaatttatgttctataaactggggcttaattcctaaattttgttgtctcacagatgcctaagaggactacatttgaggttgttgcagagtatggttggctgagttggacattgattttttgctgagttacatgtgggtggaactagtgtggacttagtgaatctagtttgctcttgtggtcaggggcgcagctgtggggggtgccggagggggccaacaccccctatccgaaccatccccacaccccctcctctcattcctgttgttgtatggctgtacttacaatgttacttctaaaaaaacattagcaagaaacatgattacaaatttagtttatgatttctcatcttttttcaaagtaaaatagaagatacttatttgtgtgattattcagtagtttagattgaaaggatttagcaatagagcctagttccaaaatgtaaaggactagtttacgcattgatttttattgatggtgactatttggtctcctttgctatcttttgagattagcggggtatggagtggttgttcgttcttatagcttatcctcaccccacacccccctaatatcaaatcctggcttcaccactgcttgtggttgtatttggtaagttaacctaggaacttattttgatatctaggatttagtgaagatgtactaaacttattattttgctatggtctatacagagatcacctgtatatgtgaatgagctttgattgtatgagactaggctttacctgtatgcggctgggatgataaatggacttgtgctatattgaataataattgggcttatatatattatgatatatgggttctttacatctcgagcttatatgggcttttgtaatgggcttatatggtcattcctctatcttatcggacctacaattatgcttagcccataaacatattgctccatacatggaccttaacagcccataagaaatttcatgatgattcaggttgtcacaattaacatgccatgtcagctccatgtggcattgtactacaattttatgatgtttcttgtcctacatggaaactgcatagtcatccaggctttgtgatttgtgacgttttccggcttcataatgacgaacatgagcgtcataactcaatgacgaaagaaggatcgtcactagtttaatgatgaaaagatatgattttgtcacagaacatgattagagacacatgataggtgacgattgacttttgatcacgcgatcgtcatagaatttgaaatgtgacatattttgtagtttttgtgacataaatgaaacgctatcataagatcttttgtagtgtacacacatgctaaatcatcattttcaaatatttcaatccaaatcatttcatcatttctccaatatctaatatatagcccgtactaaagcgcggggcatggcagctcgggatcttggggttcctggcccaactaccctagggagaaagcctgctggggaaacttccacgggataaactgtgcctttggaagcccgcgaggaggggaaaacctgggccaatcaacgtcgtttccatgggaaacaatcctggcctcacagggtcggaaatattttctccgtcgcttcctcggttggttcctccacctcctgccctctcataaagtcgcaaggccatcaccgcctctcctctggcgagacgccactactgccgccatgccttcccctctggtgagatgcatgctacctccgcgcttctccctctcctgagacgccactgccaagtctcccttcttgataccccctcgcgatttcaactactgtcctcttctgttccaaattgtttgtgaattttctgaacttttattgaattctgtatgtattttccatatgcacacttaaatatcccgaaaaaaatgttgatattctgaattttctatgaactttcagatttctttgtcacctgattttttcctgctaattagttattctaatttttgttttactatactacaaggcatttctatcatgcgagaaatcagtgggtttcctgggaagctaggtcgtgcgagcaatccaaatgacgcagtggattttccctggaagcggaggggcttcatatgtcacagggaaaatccctgtgggggagctatttccctcggtttttttatttccccttagctcccaaaggagtcctaaagagacgatgcgaatatgtgatgtgaactacccaacgtcaaatacaaaatactggagagagtaaaaatagtgaaagaggttgtcgggtgatgtttcttgagcctctaggtttagtaaactaggtcaaatcacgcgcgttgttgtcagagtttcatatgataatagtagaaaaaataatgtgtaaaatagctagacgatatgagcttatataatttgcttatctaatcaattatttcaaatgctataaatcattaggtttatgataatttaaataatatgtaaattgatgatccaaatataaaaataaggtggtatgagtttaggagagaaggaaaaatgaacaagacaatttggcccatggattaataataacaattgatgtggtgtggtttaatgacagaagaaacattaagtaagtaaggaagaactatttggatatatatatatatatatatatatatatatatatatatatatatatattaaatttgtttggtgctccatggtgcccgggcaccatggttgaaattgagtatatacccaattcaaatgagtatgaaactttttcaaatatttaggtattaacattaactactttactaactagttcaaagcaagtttgaactgaatttgaacttgtttttgttagattttgattctaggtatatagcatccaaatatataattagttagttatgtaatcatggattgtgaaataaagttaaatttgagttatttgttgataggtataggtatgaatcgaattcttataactaggtatatactcacaatttgaaaattttaaaaaatttaagtgattttgtgcatttgataccatggtgccccatatgagtgtcatatatatatatatatgatatatgatataataaaaaaataatggatatgtatatagtaaaatactatgtaagttatgggggataatgattcaacatttttacattttaaagctctgaaacatagtaaagtattcataatatagcatgtaagaatgaggtttaatatgatggtgtgatatttttgtattttgagttttagaatgtagtgcgctgtaataactatataaaaataatatatgttaggggatcaatgaccacactctgttttttctttaaaggaaaagaccgcactctgttttcactctttgaatcagtttgttttacacacaaaaaaacacacacacctggttttgcttcttttcaattgaaagtaacatcgtatgtgacgccctgtcgttattttcaaggccatgtttagttgttttggaaaaaaaaattgacgtatacggacacacatttgaaatattaaacgtagactaataacaaaacaaattatagattccgcatgtaaactgcgagatgaatctattaagcctaattaatccatcattagcaaatgtttattgtagtaccacattatcaaatcatggcgtaattaggctcaaaagattcgtctcgcaatttatatgtaaactgtgcaattggctttttttttccacatttaatgctccatgcatgtgtctaaacatttgatgtgacggaaaagttggaagtttgaatggaactaaacacagcccaattcaatcactttctatgcttactgtagacaagttacattaagcatttttaatcaaagcaaaactggcaaattctcattcaaatcctaaaatacaaagttgtgcaagttgactgcaccaagtgggaggcaaggagttgctctatgagggaaatccgttgaccttaagatcaagtatttcctcaacagtagtaataaatacaaaaaactacaggtcctgcagctgggtaaacatttccttaactgatttaaacttaaactaaatttagcaacacttgcacgccatcaattttaatttctgctgtgatgtgtatgactacgtaagtaacatgccgctagccatatatcacgtatcaccatgtatatgtgataactatatatataaggcaccatgcactagtattaatccatcaagttatacaagaaatacacagtcgtttataaaaaaatacaagaaatacacaagttctacgattgtcttgtctgccgctattgctatggagatcaacaacttggtgcagctcccgacatacatgcgggaggccaataggggtttgttcgagcctagagtggtctccatcggcccctatcaccatggcaacaagagcaccagcaatatggaagttcacaagaaccgattctgccgtagcttcttgcagcggctgggcaatgtgagccatcaagatgcaattgaccactgtatcgaaggagctttccggtgctacagcggcaatgttggcttgtacaccgcggacatgctcacgcgtgacgggtgcttcatcgtcgagctcctcctccagtggagagagggagaccatgcccatgtcgacaatcacatgcagttgatgtcgaacagcatatactacgacctcctcctggtcgataaccaaataccgttcttcgttctcgacaggcttttcaatgaattcaggaggcacatgggtgcaaatcctgtcttcaacaatgactcccagttggttgacctagtaaccgaattcttcaacaacaggcagggtcagttttcctgggctaatttggaccagttgaggctgccagatgcgacgaatcagcagattcgtcatttgcttgatcttcagtacaagcttgtcatcaacaacaacatggggattgaaccaaataatcgtaattgtccatttagcctgtgcatcaacatctgtcccaatacgattgtgccacgaggaatcccagcggcaagcgagctacaagacaacggtgtgagattccgagtgaggggattgagtgagcaggtcaaaatgtttgacgcgacatttcagggtaagatcattaggatccctcgttttcagataaatttcggctccaagatcctactggcaaacctcttcgcttacgatcaaatcaagggagaaccagctgacaacggtgctgctgtcggacctgtgacaagctacgtggtgctcatgaacgcgctcatcaacaccagagaagacgtcgcggttctccagaggaagggcatcctggacaacctgctgtcgaacgaggacgaggtggcctccttcttcaacgagctcggcaggtgtgcgttggtggatgtgagcaatcaccggtacactagcatgttcgaagatgtcaacaggtactggaggaatgggttttgctgcaagtacttcgcgatctgctgcatgaggcattgcaaaaacccgttgacttgcctctcgttactggctgcattcctactcttgagcttttcttgtacctccatggtcttcgccattctcaagtactatacacgtggctagcatatgcattaccacctcagaccattaatttcattcctcctgaatcagatgcatgggagtgccagtgctagcgtacgtattgtgtagtgtaattactgttagataatgttacccggccacaataatagcattcaaaaatcagttgccgtaatcctatccatgaacaaattaaagaatccgatcaagatattgctacttggttcagcatattctctatgtgcatgtaaagtttgttttatttcacatatttcctggtcatgttcctgtttttaatttgtaatccttgtttgcgagtatatttttatttctgagtttcatgtcatgcgcgcatgaatgtgcaagcattgttatgtacgaactgcttctgtaaaagttgttactatatatgtatgaatttgtgcttttgtgaactatggtagtattttgcaagggcacttagctcgcgctaattaaactttttacgactcactttaccagaactaataaaacaaaattgctcacttaacatttctcaatgaacaattccaacaaaatctttttatttcttgtttaattattttgaattttaaagtattcccctatccgatctacattttcagaccaaaataggcttatttgggaccgaatggatgtggcctcctaagccaagttaacaagcactattgggaggctactgcaaatcaggcactcgattttaaaaattgtacgttgtttcggtatttgtagaaaaatatttcaccactaacttaacacatgtttcagactattaaaataatgaaacacggttaaatcatgcatcggaacactttgttctgaaacacaaaacataaataaactattaaaagtttttatgtgaacttatgcttttgtaagagttctctgtttcactctcatagactattttgcaagggcacttattagctccctaattaaacattttagggctcactttaacagaaaccaaaacaaaattgcccacttaacggctgaacctctgattaaataaagatagacatttgcttctcttcaatctattgaacaagttaagcgctcccttcgtcccgttctactcgctaagatttaaatatatcatatactatgatatttgtagcaacaaaattataatcatataataataaattaatttataataaactgtttatggatcaaatatttaaagagttaaatattaaaatacgtgcgcgtcgagtgaacggagggagtactttacgcaaactgttggtctcaattgagccgcacgttcgacccaatttacccaaattgttgggccgaaataaagcagacttgtggaccggattgaagcgtcgtacattgcttacgtacaggccgaatttgctcttaccattaggctgaacttacgaaaaatttcagggtgaatttattcatcacatattcaaatgaacaaaagtatatagtatataaaaaagggtgtagttttgaacggagggagtatatttttgggctgtgcagacgccgtgctcggcacactgctgcgcatgaatgatagaaaaaaaggtggttggtgaaaaaaaactattcatgcatcttcctgcagctgactccaagaaaacgatttccttcatactccactacagcatgctcaccaagaccagttgttttacattaagaccataaacaaccttgacgactgctgaaacattttcttcacttgttttcaagcctctcgtgggagaatcggcataacaattcaaatggtcaagcagacgtattagaggggtttggacgactatcgatcctacctacgattatacaaacctgttacatgaatcttcgatgcaacctctctctcctttgtatatttctttcttgactacgttgaggggctagattcctgaatcagaactaagaaatattaatgtaattacgcacgagatcgctaattagcgatcgatagcctgagacgatcaatttttttttcgccatatagtttttttcttttcgagtaagtttatatatctaaagtttacacacctaaaaattataggtcaaaagtttatatacccgattcaaattcgaattcggattcaaatattttatatatagaatatttctatacataaagtttatacgtgcattattttcctcttttagtaagtttatacacctaaagttacacatataaagtttatccacgtaaagtttgtagagcgaatgtttataagtcaaaagtttatatacccgattcaaattcaaattcggattcaaatattttatatatagaatatttctatacataaaatatttctatacataaagtttatgcgtgcaaagtttacagtataaagtctatgcacatgaatgagagtattagattttttaaaattttttttactaactttgttttttttttaaatttatgatgaaaagagagaagggactggagtatagtggagaggggcgggttgatcgtagggagcgatcacccgcccattgggggcgcccaattacgcagcagctgagtggtcgaccaagtcatcaatcggtcctgcattttatattacctctattttctaatatataataccattgattttttataaacgtgtaatcatttggctcccgataaaaaaaagtttaaccatttatcttattcaattttttttcaaacataaaaaaatttaagctgtgcttaaagaacatttgataataaattaagtcacaataaaataaataataattacatatttttaaataagacaaatggttaaacgtatcttaaaaaatcaataacatcatattgaaaaatggagaagtactatggtgcagacccagtatcgcgcgccccctcatttgatgttgctctctccccgcgttggctctcctttatataccttgacaagcctagaggcgagaggctagtggatctggacatgcactttaccgtcctttatttgctatataaatttattggattttttgaaacaaatatgaacttgttggaaaatcacatagacttccacaaagtgcactgctggctagtacaaggatatatgtgtacttgtgaccaataatataacaatgggcctgttaggtgtgactagataacagccagcagctacagtagcaccatataatttttaccatagtcgcagcagcagcgccgcacaaccactgcaattggacagccgaacacacccaatgtaacccatggagacaagtacagccatgtcactcaattactgtaacagtaaaacaacatgcacctcaccttcatccgaagagatcagaaatagcacctaataagctcatcaacgacacatgtgacatatattcttgttcaactctatgttctacatccgctccagcatggttgatgcccctttgattcaaaagaaaattcatagtaattttagaggatttcacttttatatgattttttttctacatagccctttgaatgaaaggaatgaacctcatggaatcctatgaaattccaatggaatgcctctttccacgtaagttttggagaaaatttaacaagaggtagaacctcatggaaagaatcctttgagtctttatctcttttcaaatttctgtgtttttcttgcggcccgatcaaacaatcattcatatgttttttctatgtgttctaatcatttgttttatacttgtatttctatcggaatcccatattttttctattctttttttttcattcctgtgatttaaaatagccacaagtcttgggccaagaacatgtcgccatcaaggtactacgtacctgactcatcacatactcaggccctgtttatttcgcgaaaagaaaatttttgggtgacgtttcaccggatgtcggaaggagttttcggacacgaatgaaaaaactaattaaggctaattaatctgtcattaacatatatgggatactatattacttatggctaatcatggactaattaggctcaaaaaatttgtctcgagatttccatgcaaactatgcaattagttttttcttttgatctatatttaatgcttaatgcatgtgtcaaagattcgatgtgatgtttttgggaaaaaaattgggaaccgggcagtgttccgtgcactggaagcatggtcccacacacagtaatctaacgacgtggtgtgaggcggacctcattgcgttaactgacgtgagaagtggccgttgcgagacaccttttccgtctggaggcagcgcatccaatgcgctttccctttcttcctcctctcgctgctgctctcccagtgcttcggcggtcgtcgatgcgacccaggcctgtggcggagaatcgattcccctcgcctgcagcccccatgctcccccatcgattctcgctcgcgtgtcatcttgcggcaacggtcaggtaaatgtgccggaaacgggcggaagtggagaagccacactgctctcgagttgtctacgtcatcctcgagggcggtaaaagccggccggcgtgctcgatgtgtgcatcacgcatcggcgctcgtcaggccgcccagctttggcagactggccatgtttgtgctcatactctcggcctctcgggtgacacagcgctggcgtgaagagtcgcatcaaggcgtccaagctggcggagttgaggagccacctctatttgaggccgagtgtgtgcatggtcggatagagatgagagcgaagaagcggaagcgagagcgggagctcttgcggatcgcattggagggggcgattgttgaatcccctcaagccgtgccgatctctgtccgtggcgccgatctggagtccggcgagggttcctccgactctgtcacctccgacgctggcagcgctaaggctgcagctgacgacgtggttcatatcgcgcatgccctttgtaaggtttgcgccaagtctcctaaagccgtcaacgagtttgttcgaagagtgagccctgccaccgtcggccgttcaattgattgggacctcgtccgcgacaacgactcatcgaaggtattgtggcttgtctacattttttctttccgattcaatttgggttgacttgcatgtagtagatgtccgataggcgtcaccgctggaccgatatggaggttcgtgtgtttcttgagagttgcttggaggagatggcagcttacaacatcacctccaactcccccaagccctaggcatgggagaatctggcgaaaaaaatgtacagcaagtgtaggaagagggtgaacaaggctcaattggagtacatttgggggcagtgtaagaagcggttccacatgtgggtgtggttagaatcgcaggctaccgggctgggtcgtgatccccttacttcagccattgtcgctaatgattcatggtgggaaagcaagaatgcggtatgtacactacatgaccgctggagcaggtcgccggagggtgcaggtccgctgggttggcggcaaggcttcctcctcagtccccttcctagagagggggcggcacggtgggtctcgcctggctccggcgagcgacgcagtggaggtgatgccgacggcggtagcggtcgcgcccggtggcagtcggcaaggcaggcgcctatggcgtcggttggccggggggtggtggcaacggtggaggttgccggttagtggggcgctccggtgatgggcatggttgctgtgtggcggcaagttctccatcaccggtggtctcaatgggcggcggtgataggggctagcacaccgttccttcctttgtcatcgacggcgtcgcggacttggtgggtagctgtgctggatggagatggagctaatcctctatcccctccttcgtcactggcagactcggtgggcgacagcggcagacttggtgggcgacagcggcgcaaaggtggcagcgggttgggagtccaagaacggaggaggattctgaagtcaacggcagccctatgggcggcggaggcttaggaatccggcgaagcaaacacaattgctttcaactagcgtctggtcggctagttttgaccggaggacgatggatgagggtgggcttcctggcggccgtggcatcggttcacttgaagcggatgaagatgacatctatggagattcgcagagacaacacactaggggtggtggcgtctagatgatttccacttgttgtttttggccgtttcagttgaggatgtcaggatgcagggatgtaccgaggttgtaggttttcttgtttttttggtttgttatctcctctttgttgaggtgtgagtttaagtactcttgtatccttttggctgtgtatatcccttgtggatatagaggccggattaatgaaaatccattatctaaaaaaaatggtatgaactgcaatttattatatgcatatagttatattttcagtttgtcaggacaaaaatcagtttctctccttgtgtttgtcgaaacaaatgaccagctgtagtaatggaagcattgtgctcatatatgctttatagttagaactgtgcatacatgttgtagccagttgtgccattcccttttatttagagcagttggtaagttaaaaaatgtttaattcatcaatggtcgagcataactatgaattcagttgatgggcactgattgcaaaaagttatcagtaattgatattgtacatgtgacagttgaggaacatgttcaatttataattgagtgcatttcacattgcaccatgtattatgtgtttgcactagttggcagtagtttgaaccatgcattatgtattagatgttcaatttaaaaggtccacagcaatcttttaacttacaacatagatgtttgcactagttggcactttggactagggttgatcacatgaaatgaagttgtcagagataacatagttgacatcatcaattctactgccatagtaataagaacaatatatttagaaacaagtagatgttatgtttctaaagagatgtatagtttagaaacaagtagaagttttgtttctaacaagtagatgtttagaaagtaaaaacttatgtaagatttatagtttgtagttactacattgacttaaccctagttcattgtacaacgtacctttgtcaaaatctgtggcccattgtaaaatgtactctttattataaaaatttgtagcaatatacacttggactgctagcattttggtagtaatgcacttggacttcatagctgctatggtttaaacattcatcgatgaatgtttgccctagattaatacacctgcacacgctagttatgtttatatggatcggaaacttaatgttgtgacctgtctccagcaatctcatgctgttcatgtgaaatgttttcaatcaacaaacaagtgcagtttcatgtatggcatcaaatcacataaatcatgacagtttaatttcaaaagggaccatgacttttttttagaacatatggctgtaagatattcatggagatttttgtcaaatgtgacttactacctgatccctttttcttcttcagaatctagataaattatgttggtacgatttcactgatcaccattaattgataatgttgacaaggtttatgtccagatgactatttcagcatagcttgtcacttcatatcccctttatctgttttaaacaacttacctttttgttttgggtgtagagtgttggaattgaaaattgatttgacttgaacttgtacaataagtggttttggttcactcatgtttgcatgatttttccccttcagtacaagttgccttaatagtccatatggtagtaatgcacctggactgctagcattgtaaaacagaaagtagtaatgcacttggactcttctggttcccagtaaaaacacactgttgaagtattcatgcatgggattatgggtgtgttgtttctgaacaaacagagttgattgcatactctgttcttcctttataccttcctgtaaacagaacgttatgccctgtccagtgccattttttgttccactgaccaatctgtactctgcaaattggccctgttttgtcatgcataatctgcctatgttcactagtacaagtagtgcatttgtgtgactgcttccttgctgaaatttgctactcaaaatctgggtaacttcactctgaaactatgcatattgtgttgagataaatatgtattgtgtctgaaattgcagcagcaggtgttgtatttcacagctgcactatatatttgctgtcatcatccagaaaataattcattttgtttgtaacaaggctttgcttgcatcagtacatatcatctgtgcattatgtaacttcttggtgtccacttctgtcaccggtcaagaaaggtgtgatcagcttcaaaaatgatcctctcaagcacattgaccttcaccacgtggtattcagcaggcgcaccgttgtcggaaaccactcggccatcgtggcggctgcaccagccacaccgcaaggagcagttcagtggtagaccattgacgtgacgcagctcgcagcagcttaggccattcacagtgcgccaccaagttttagcgttcttcgcatgccacatagaccaagaactgtataagctacatgcttcacagtgcaagccacagctcaagttgcatccaacggggcctaccatgtctcctttactccactctctcttctctctctctttaccttttcaccttttcatctcaacgctctctctctcttctggcatggatgaccagcttttctgacctttttctgaccgagtgcgaggaggttctcgtggccaaacttggtcacgcgaagcaatggaaagaacggtccccactgccctctctcctccacgtaagcgatttgtctagctggtcaaacattgccacacgccacgtgtgtgcactgtgaatgcccttatagaccaccaatgccatctccaccaccactggctgcagataagggtaagggaaagaggggagaaagaaacagacagtgttgtctcagggagttcttccaagaagtcctgaagcgactccgctaggcgggcactggagaggcttgcggacctccgagagctgtccatgcagagccgtgcaatggaggcagaggcagctaaggctacagggcttgaggcttgcttggagttggtggaaaatgatgggcaccctactggaggcccggtgtcgtcttttccgtgacccattccactaccgttgtttcgttcacctcaaggacgccgccgctcgcctggaatatagtatcaccactcgtggaaatggagctgattcctcttctggtggcacacagtagtttgtacactacacttcaatttgagtcctgttgtgtgttgtttttacaaataaacctattttgatgtttataacctcatgtgtgctaacatttggtacgatgtgctgagtttatgcaacagttgcggctttggctttattactccatttgtgcaaatttatatatcattgcatagcaggctttattactccatttgtgcaaatttatatttcattacattgctatgttgtttgccgacatatagtagtatggttacatttttcattgcaattaattttttttgatgcattcgataatgacaatgtcttgtcatcttttcgggttgtgctggtggatcgagctggacgggaggtcacacaagcagcgacgaggacgatgccatcattgagatagtagctactagttttgatattaatgagagagcaccaaggagaatactggtgtaaaccggaatcagttggacagtggaaacgttggtgaatcaaagccaatgtcgggaaatgttcagactcactgcaaaacaaatacacaatttacatgatctcctggtcacgtcgtgcagactccgaggaatagccagggtatgttcactagaaaagtttaggattttcttgtacactatgggtggaaatcgtccatgcagaggcgcgaacaatcggtgggtttgctacaactcaacagtgtcgattcacttccaccaagttttgttggctatgaacgacctggcttggaaaatatcgaaaccagtggatcccaacttcattgaatatcacccttcaattctgaatcaaaatcctttcaaaccattttaccagtcagtgggtgttgttgatggcacgcatgtttcagttcttactaattcagctagcgctatccaacacaggaaccggcaccacataacaacaaaaaatgttctagtgatatatgatcacgaggggagaattattttctgcgatactggatggccagatcagtttacgaccaaaggattctgaacgagacagtgcagtattaccccgatgattttccatgggtaccgtttggtgacttcaatttttccatacaatatttgtgtggcatatgtcattacatttgaagcctgacgtgtgaactaaaatttattttatcacattaaccagacaggtacctacttgtagactctggatttcctagtaggatgggatttcttgcaccgtacccacatgtacggtaccacagagatcaacttgctgtcaacggagcgctgccacccataggacgtgaagagacttctaaccatcgacactcgtcgttgcgaggtgtcgttgaaagacaatttggcatcgtcaaaaaaatgtggaaaataataaaagaaatagaggaggagatccccacacgcatcatacatgctccttttcctattcacaatttcaggttggatagttatgatgagaactaccgtcaaactaatcctctgtacaacggctatcccgtgccgctgcagaacgattcgctcgatcaaatgtactattcaacaaatagcgaggcagctatgagcatgttgcgtgactgcattgcttatgaggtctactatcactatcactagatgctgtgatccagccatgttagccataatgcgtgtggcatatgttgtttattaaattctttgagtctgtatagtttaaccagtactgatttatatacgatttacattaatatgtatggatttcgccagcactgattgaagagagtctgtacggttttacttattatgcatgtatttcgcattttataacttagttatcttattagttgggagttgtattactctgcgcaatttttttccatattattagcaaaattacagtacgacctcaattttgtgcggtgattttcatagtaccaccggaagagagggtacaaatttatgccatcactttcacgataaatttgattcactcattattgtatgaattgtttgataattcatttcttcttaatggtcaccctagtaatatttctggcaacgaaaataatcatcttcttctcaatatattcctagaactcatcaaatcttatgaaaaataatttcttaacaaatacctcctactaatgaaatggtttaagattttacatcgcacaattacgaaactgaatctatataaaatcgatgaaattaaatgaattttcaattttattacttatttcttctcattattttacgacccgagtgtgatgccttgtgtgcgtgtagcatttcctggcttgcatttataccctggtgcaacccaaggctgcttggtgcttgccgcgccgtctcgcctgcgcccgccggaaagtgtcggtagcccaacggcgccgtcggcgccatcccgcccatctgcttctacagtgcacagtttcctaactcccaaaatcgattcccatctgccacatacgaacagagcggcctcacatggctttgccttgcgttgggaagtggatgcgagcgcagaagtcttggcaaggctaaacttgtttaataatacagtcgacttgtaattagttatttatagtattatattagttcacccgtataatagttagctctttactattaatactagaaaaaataccattacattgcaatgggtgcgaacagtggcgaacctagaacaaaaattacccggggtacactacataatagttatctaattattcacaagtatactaatcaaaatagcataaattagttagaatttaacaattttacccggtgtcctgtgacaccggtaagttgtatgtgtgcacgccactgggtgcgaaggctattttaatcatattactgttagattttttttctaaaaaaatatatatatatgggatttttattttgatagtattgatatctaatttggaattcttattaggatgaggattataaagcaattgggagtccgactttcgtcccaagttagtatgtgagatttttaaaagaatttcttatacgattccttatgtatttccaaaagtgaacgaacttaaaaacagactcaaatatatggacgaagtatcaaagtattggcggaaatatgcatctttaatttttataattaatagtagaatgaaaatattttcaacttttataatataagtagagatagagataatacaagtagagatagagatagagaaatatatataaattcttttcttgtagattctgttgagatgttcatatggccacgattttatctcccacagtccatctatctagtgtctcatcatgtgcggcctattgcctggttctgtcgctgccgaaataaaaaaaccagcatgaacaacaaactgaatcggacgtggataaaatcatgccaaagtaaaaaaatcacgtgctctacgggatcgaactgaactgctcgccgacagacgaaaatctgaaaaaacctttatttttatctattatttttataatagataaaaataaagataggacatacttatctctctcacagagtttcttggttcttctcctctctctcttctcttctctcctccaccttagcatttagtcaacttacagcctactgttacgttgccgccggctgcatttgatcgatggtcaaaagatcctcatatccgttgccagcggctgcgtttcaatggacaaagattgtttggctaaattttttttacgtatacggacacatatttaaagtattaaacgtagcctaataacaaaataaattatagattccgcctgtaaactgcgagacgaatctattaagcctaattaatccgtcattagcaaatgtttacggtagcaccacattatcaaatcatagcgtaattaggctcaaaatattcgtctcgcaatttacatgcaaactgtgcaatttatttttttctacatttaatgctctatacatgtgtccaaatatttgatatgatggaatttttggaagtttaacgggaactaaacatggctaaaagagagaagatcgatttctctcattcttcacccgcaccacacgattcttgaattattaaacgcactgctacatgattgattttcttggacgcctcccccttttgtttccatgcggtccataagtggaaccgcacaggaaaatgggagggaccggcgccagaccatcgcccgcacaggaaaatcaattttcgtgtgcag

SEQ ID NO: 1312 - DNA, 26822 bp, Oryza sativa
tctctcccacctcactctctcactctctcccttggcgccccttgcccctacgcacgcccactccttttctctcccactcctctcctctctctcccggccggcccgcggtgacagcaagtggcggcgggtgatacagcggcggtgctcggcccctccctccctctccctcggctgcgagcgggaagaagggcggcgacaacagcagcgcgcccctcccctccctcaccttgcagatccggtggaggggaggcatgggggcaatggatccggcggcgtgcggcccctcccctccctccccttgtagatccggtggaggggaggcaggggcccgacggatctggcaaagccaggcgagaggcggcaggagggatgcggcccacacccctcaacggcggtaggcggtcggacagaggttcggcggcggccggatctgaaggtgcggcggcatcagcggccggtgtggaggtgcgacagcagtgtgggccatcgatgcatgtgagttgatgcccctcccctccctctcccttggctcccctctcctcccctccccttgcagatccagcggaggggaggggcatcttcggccgacgactacggatttggtgctggcgacaggagcggccggcggatccatagttgtcgaccgcgggggcgacggcggcgggcctcggctagggcagcggcggcggcggattagggttagggttttgtttttcttttttttgtttcgattttttattttctcgtccagacggcttaagtgcccgcacgtgaaaatccgattttcgcgcgtgggtgaggcactcagtacacgaaaatcgcgattttcccagacccctgggtgcgtgcaggccgtccacccgcccgcaaaaatcgaattagccgcatgcaataatcggttgtgtagtagtgacggtgtattttttagaaaaaaaatctattgaaaagttattttaaaattcatattaataaatttttaactttaaaataattaatacttaattaatcatacactaatgactcaccttgttttacgtatttctcaatttttttctctctctcaaatacttttcctccagtgatcagacaattacatcaactaggaaggaagcccgcacagatgcgcggacaatttattttttgtttattaaagaactactgaaaaaagtcatatatcatcataactaaccatagattacctcgtaaccttaccgtaaaagaaggaaatatttttaccgtgaaatattcaaaggtgggtatgcacacgtttataagcccgcttaggattgccttttacactattagttaaaagaatattttcaagaaaattggcgagggtggcatgaagcagcgccatggcagcgtggcttcttcgtcaacctcgcaaagagtagtcactacatatatgtataatttgagaaaaaactttatggctacaaagaaagaaacaaaaaactgctagatggggtggaccatatatgcactcttcttttttgtttttgacatctcttgtgtatgtacgtgcatagagagggattaggtggttttaggagcgagggcttacctgaataaatctaatttaatggttaaaaataatggattccccggtttaagtgaaaatcgatagcttgatgttttatttttgccttataaattttcttacattttctctaatttattagagcatcacatggcatcttctaagtgtttgtaggagtataggaacactgttactcatactcacaatctacttgtagtcaactattatttgttgtgattttgtggcatcctctacttagtgtcatctttatctttggtgcttgatgacatacgtgcttactggatgtcaaataattattaggtgcattgtgcatgcatatatcataagcaatataacttgacgattagtgacactggtttgtatatagaacttactacataggatttatcaaggacatatgattgatatattatactattcttgattcacaaagtatattatatactacatatttaattttagtacataagtaataagtttatggtaaagttctaaagtgcttatcggattggctactctgttatttatcgtgaccatgtttaccgaattgctaaatggtgtgtgttttacaaaataattttattatataagttttatagaaacaaataaattcattttcaagtttgtaatatctaatactcgattaatcttgtcctaatgacttgtgtctttatgcgtacccagggtaagctacatcaataagctatatcaaatgaaggctaagtaggagaacgaaggctaagtaggagaaaaaagttattgatatggtgtgaaatgaatatatttgaccttcaattttctaataatatatgaatagagtaaacacataatacatgaaaatatatttatgacaaattcagtaacatccttttgccatatcaaggagtgagtaatttttgaaaattctgcacacagttgaagtgtttttattttggaaaatgtaagtctaatttaactatcacataatctatacttttaatttatttatattttttatggatgttttgatgacatgctaataatgtgtttaaattattattttggtttcccatctaatctaaatgagaaaaagaaaagaaaaaataaggatgtaggacccgacgtgtgtatgtaccgtacataggtacatgtttttttcttaaggaggaaacatgcgtacgtactgtacgtaggtatgtacttttcttaaggaggaatacctaggtagctatgtgcatatatattggttggtagtgacattacgacgtggtcctttttacagataaatttaattattaatttttaagatagatctaatggttgaatataatgggtctaccagattaaatgaaaaccgatggtaagatgttttttttcttacaatttctatgatttattagtgcactacgtggcggtctaggaacgcttatagggtactatatggcggattataagcgtttgtaggaagtttatcctcttgattacttttttctctttatgaaaatatttgcaacaataatttttaagcgtttgtaggaaggttatcctcttgattatttttctcccttttctctttatgaaaatatttgcaacaataatttttaaataaccacaaccttccaaattaaatatttatttgtaacaatattttttagatcgtaataatttttaactttgaaatcgtatgttcattctttatctatttggaccattgtgttatttatgataaaaatcacaattagaatttatgacattttctgtctacttcactcgtaaaaatgtatattcttctaagttctattcattcaatcacatatgaaaattatataaacttgtgagtacatattatttcatcatgtaccacttcacttgtatgcataaataaaatagaaagtgactatatatattgttagctagatcgactttttaaagtctcacctgtaagaacaatacccgtgcagctgaaaacatatatttttaaatcatactttttcttctatatttatggagtaataaattttattttctactatagaaaatactattttaaaaaaccatctttttttttctaccggcgtaaatatattttttagggtcttatagcttttcttttttactcgcatatgtacgtatctttttctaggaacagtaccttttttatagattttatcgtacgtacgtacgtttctttaaatgaacagtacatataggtattatttttcaagtctgcatacgtacgtgagatttttccttttttacattgtgcgtaagtataacatataaatcgatgataatagaatttagattgtccgtataaacggtttcacttaaaatgcgcatgatatcaagaggaagcaaatagatctaatctaatggtctgaaataatgggtccaccaatttaaatgaaaatcgacggtgagattgtaaaatgtcacgtggcaacataggagcgtttgtaggtggcttaggagcgttagtaggaagtttattttttttggttaagtaaatccgatggtagaaaatatgggtccactgtatattagtgaaaatcgatggctagatgttttggttttttctaatttgctagagtgagacatggtgagatgagagcatttgtagaatgccatatttttaatggtttaagagtgtttttaggatgtttaatagacttttaatatataatagattatcaaacaactaactattatatatcagccccatacgtcgtgatgtatttaggaacacaatataacttttataatttaattaaagtacaacggaatcacaaattggatatataatttaaaaataatttagaagatagttcaagcaacattgacaggatattttatattattattatagatcttagtttaactatatatatttatatttgtgctgtagtttttttagaaaacagatcatcgatttttatgatgtattattttattgtcttttctatgtacgtgcgtactgttttttcttttctttccagtgaacagtacgtaaactatttgttttgtttttttaggtaagtacgcatgggagaaggacgtggtttgcatcctatcaacttgtacgtacatggcaacaatagtagtgcttaaatcattaaaaaagagaaagttattattttttaataatagatctaattcaatggtgtaaaatggcgggtccactaatttattcgacagcctaatccacattttcccttctcttgctcaatcggcctccacccacaggcgacctctagaaggaatacccgaaaggcaaacaaaccggtaagtagatggggctcaagagtgatcgagtggaaaagctcaagaggcatggcttctgcatcaatttgctcagacgttgtagatagtgttgcgcaaggtcaggaaaatgccctgctttaatttggtaccagattaatttggatttctgaattgtactaaggtagtttaagcttttctttagctttttggtggcatgtaaacgagataattcatttgcacataaataattaaatattaactattataaacttttaaaatgactttatttgatttttaaaagattttttttgaaaaatgtgttaacggaaaatgagaaagctggcctaattaaataagatattttcgtttgattttcccttgcagtaacgcggtcaagggaaaactctcacttggctggtgtgtctagcccatttcaaactttttagtccatattacatcggatgtttggatgctaatttagagtattaaatatagactaataacaaaacaaatttcataaatgagagctaatctgcgagacgaatttttaagcctaattaatctataattatgaaaaatttactatagcatcatattgtcaaatcatggcgtaattagacttaaaagattcgtctcgtgaattagtccaaggttatggaatgagttttgtaattaggatatgtttaatactccaaattagtgtcaactgatgtgacaggaacttaaataagtccctcttttccaaacaggccagctaccaactggaaggaaggtatggatggaatggaatgtggtcaaggacgaggactttgttgcgctgaagtatggacctgactgctgactgaggagagtgatgaccggtaaattcttagactgtcaagttgttgtatttcctccgttgatttttctattagttaaatttctttaagtttgattaagtctatagcaaaatataataacattttcaatacaaaacaaacattgtatcaaaatatatatattcgactccctatggaagcgaattttccaggatttaacggcattgtactttcagtggtaggcggcgtacccgtcaacagcgaggcgcctgtagtgacttcgtcaatctctaggatttgccggcctagtcttcgaaaatactcataggggtagggtttgcatgcgtgtgttcacaggggtgagtacgcgtgcgttgtactgtataattctaaaaaaattcaatattaaatttaatgaaactaatttggcgcatatatgttgctattttttttataaacttagtcaaatctaataaactttgattaagaaaaaaaatcaaacaacttataataaaaaaatgaacgagtacttgacttaattagctatgtgttggatgtctcaacggtgagctcgtagcgatacgtgcctttaaatagttacgatgagatgtgtactcggcacgtcctctcttccgttgttccttttgcccaacatactttggaatataaatcacacatacacgggctaagctgaagaagttatatagttgtccaaaaaataatcaatggcgatctcactgatcacctccctgctcttctccctaccccaacaatggcagcccgtcgtcctcacagggctccttcctgtcatcgtttccctcgtgctgctggcgaggaaagggcgcctcaagatgccaccgggcccggagcaggttcccctcctgggaaacctgcaccagctagctggcccgcagccgcaccgggccctgcgggacctggcccgggtccacggcccggtgatgcggctgcggctcgggaaggcgtcggccgtggtgttgacttcggcggaggcggcgtgggaggcgctcaggggccacgacctcgactgctgcacgcggcccgtgtccgcggggacgaggcgggtgacgtacggcatgaagaacgtggccttcgcgccctacggcgcgtactggcgcgaggtgcgcaagcttctcatggtcgagctgctcagcgcgcgccgcgttaaggctgcatggtacgcacgtcatgagcaggtgagtgtaacaaaaccggttgtgaaattcgatttcatccattactgttgtatggttttatctagaggatggtttcttagtaaagttatcttttatatatgtcacgtaagtttgatatgtattaagaaattaatatgaggtatcagtacttcacggtaccaaatcaattttgatcgttggatctaataatgtccatcctgtttaggtagatctaacgattagaaacgatttagtactgttaggtactagtacctcgagatgcctttttgctagaccagagcaaatctcacgtattttactacttcataattaggtggagaaactcttaagcactctacgccgcgcggagggaaagccggtggcgttggacgagcacatcctgagcctctccgacgggatcatcggcacggtggcgttcggcaacatctacggcagcgacaagttctcccagaacaagaacttccagcacgcgctcgacgacgtcatggagatgctctccggcgaagggtcctccgccgaggacctccagctccccgccgccgtcggccgcctcgtcgaccgcctcaccggcttcgccgcccgccgcgagcggatcttccggcagctcgactccttcttcgagatggtgatcgagcagcacctggaccctaaccgcgcgccgccggagaacggcggcgacctcgtcgacgtcctcatcggccactggaagaagaacgagcctcgtggcacattcagcttcaccaaggacaacgtcaaggccataatctttgtatgttaccccttccattttaaaatataaggcgtattaggttttcacacgagctccaacattttactttgattattagttttccttttcataatatattataattttaaatttaacataaaaaatattttaaaatataacttatttttagatactagtacattcataacactatacatatatttttatgtttaactattagtaaaaaaaataatattaactttccataaagcaaggactttttatattttcaaacggaaatgtcaaggctatagtatatagaaattaattcaacacttatatgtacagttcatgcatgaatataggcattcttaaacaaaagaaaagagttatctaaggtatagctagtacgtatatacttctagattcattaacatcaatatcaatatgatgtgggaaatgctagaatgacttacattgtgaaacagagggagtatttgataatattaatcaccttatgatgtgcagtcgactttcgttgctggtattgacacgaacgcagcgacgatattgtgggcaatgtcggagctggcccggaagccgcgggtgctgaagaaggtgcaggcggagatcagggctgcggtgggtgtaaacgggagggtgcaacctgatgacattacgaagctcagctaccttaggaaggtcgtgaaggagaccctgcggctgcacccgcctaccccgctgctactaccaagagagaccatgcggcacatccagatcagcgggtacgatgtgccggccaagacgcggatctacgtcaatgcatgggcgatcggtagagatccggcgagctggcccgatgagccggaggagttcaaccccgagaggttcgaggcaaacgagatagacttcaagggggaacatcctgagctgatgccatttggcactgggcggcggatatgcccaggcatggccatggccatggccaatgttgaatttacgctcgccaatctgctcttcgccttccagtggtcactcccggaggggacgacgccggacaatgtgtgcctggaggaagaagggaggcttgtctgtcaccgcaagacacctctcgtgcttgtgcccaccgtataccgtcacggccttgaatagaaatcgagcgatcaattttgcaattatctacagatcctataaaaacaagttatctacggatcttacaatggttggtgtcagcacactgaaagaaaaaaaaaagagtcgtgtgcatccgcgatggaccaaccaaaatttggagattaatttaaactacatagaaaatgtaataatttggattgatatattgtgtgtgtaaaaacatatgaattatagtgtgtaacataccacgaaatataccttgcaaatttgtgaatcaaatgtttctatcaataaagcaaaatccccccctatgtgctttactcattgagatttgttttttctttcttgcatctcatagtaagttttatatgcattaaataaacttagcaaaatttacacaaaaatcttgattgtcaaaaactttggaaacatttccaaaaatactaaacatcgcacaaaacatactatatttgtttttcataattttatcacttgatctagtacctcaataaatccatatgcaatttaattaataaaaacaataaacctatttcacaatttcactacattttaatcctatctccttttctagtgcattttggcccaagtactaaccaagttttcatatactactagtaattttttgctcaatttgaatccagatgtaaccacatgaaatgacactgcaaaacccctaagtgataaaacacaacagctgaccttaacaattagagaactttacagtttcaccactaatcaaccctaacacctctgcctgtgcaatttttccataatgctaaccactgcaccagtaattttgtcacaattttaaccattttctaacttggtgaaaacgggcgaaaacaactaactgaccacatcatgacacttaggctgcgttcaaacattctgttcggccgagctgatctgtcctcgcaaaatgagacaactcattagcgagattgactaagtattaactattataaattttcaaatatatttatttgatgtttaagaaactctttgtttttgtacgaaagacaccattttaatttgaaaagcgtgctccatggaaaaaataaaaatagcccagccaagtagaagattcgatcaaacccagccttagcctctagtcccattccccactctctttctcactactactgggcccaagtagccatggaccccgccaatcaacctcagaatgcgcgcatgccaactcaccctccttcgtgggccgtgcacacccttgcgtcgatggtgctttgccgaagcaaccaaagtgtgtcccaccaagaccgcatggcagacttgatgttttaacctcctagcttcgccaaacagcctctcctgcacgccctctatctgttccaaatgtgaactgaggaattcatactctggttcaccgggaaatggatgcattgccctcaatgttgggatcaagaaaccccttgattggtgccgcgagattggagctcggtgtcatcttcttcctcccaaataatttgccgccgccgtcgactaattccacaatcatgagtagtttaatgcacatgttatattaatgatgtttttaatgctatagtcatttgttaccaaagctatttggcaaagagaaaaatgtaaatgagttttgaaaatagttttgaaattaatggattataagttgagtatatatgtaatctaaaaggggtgtttaagcacgtttgatttgatatttatattgatcaagtttaacttgcatatatctggagtaataatttttgttaaattttgttttatagtattgaaaatcctattttgaagaccaactatatctttttcgatggttctactttttggcttttatagcatctaaattaacccgcaaagctatgggattataggtgaactggcgacggtcgtactcattgtcgtctgacaatactatttggtacttcctccgtttcacaatgtaaatcattctagcatttcccatattcatttgatgttaatatgtctagattcattaacatcaatatgaatacagtgaatgctagaatgacttacattgttaaacggagggaatacttgcttgttttggatttctaaattataaggtaattatattttaagacagacaagaagagtctctttgttagcatcggaataacgcggtctaagaggccaagagaagaccttctttgttggcatctccggcagccgccggcagggaaaactctctcttggtccacggacctgtcgattggaagacatggggtcaaggacgaggactttggtgagctgcagtctgggcttgactgatcacttgtgagtagtgacaataatgcaatcaatgcatattgttttttttttccaaatttggattgttttttctccaaaattgttttttttctctccaacagatttgcgcgtcgacctgcagccggccggagaaaactagactatcaagtcgttgtcgttctacttgacttaattagctgtgtacttgtacactgtcaactgtcaagaatcgtcgttcgtccgtgtcgatttgttgaggaattccagctcagaaatattttagtcaaaaatgtatactactatagttgaaaattttggctacattttcaactgtaatagtagtatttttgagctgggcaaacgccgtgccctgcactgcaaaactgctccgccgctgtcacacagcgcatgcgtggtaaaagaaagatggttggtgaaagtaattaaccattcatcttcgtcctgctgactccatgaaaaaacgatttcatatcatgctagtcaccaagaccagttgtttacttgttttacgttaagaccataaatgttttgaccactgctgagacattttgcagtttttttcaagcatctcgttgagagtatcggcatatcaattctaatggtcaagcagacgtatcagaggggctgggctatatacgaccctgtacacatgatgcttcgatgcacctttctcctttgtatctttcttatgaatcgacatctggggttggattattcctggaccagcactttcagtcatcagtgctacttctaccgtcccataataacttcatttttatcatattacttgtcccaatataactttatcttttaaacaattattgtgtcggagtgattactcaacaactgcatgtgaaaattggacggtcggcgatgaagcatttgtatctagtcggccaaaggtgaaaacggtgcaaatagcgtgtcgctgtgcatggggggattaaatttgaaaaatatattgttcattttttttttctcataaatatcttggatgtaaatttttcgatacaaatataccatcaatgctgctgaatccagtggcgaagctatattatgttgggggtgcacatgaaccctaaattcctaatttttcacttaaaaacattagaatgtacagtgttgtactgaaaatttctagattcttaatggtagtgcaccccttattttgatgctagcttcgcccctggctgaatccttatgtaaaagtgacatgtgacatggatgtgatgacgtaggcggtctcgcacgatgaaaacgcgagaccgcacgatgtcgcgtggaaacggcgtaagaccgagtgctctcgtgcagtaagcgtgcgagaccgaactcgtgcgactaccgtgcgtttgaaattggatatttagcaactaattaatattacctccatattttaatgtatgacgccattgactttttaatcaacgtttgaccattcgttttattaatttttttgtgcaaatatgaaaatattcatgtcatgcttaaagaacatttgatgatgaatcaagtcacaataaaataaatgataattatataaattttttgaataagacgaatggtcaaacgttagataaaaagtcaatggcgtcatataattagtgattaattatattaattattaattaattaattaataatttctaattagcataattaatccctgattagcggcaggaggcagcatgatgctcggtctcgctcgttgggcatgcttggtctcgcagcctggccacgcgacaccgagcggtacgtcttgcgccgcaatattgatggtttatttgtgccaataaaattatatcccgcataaaaaataaatagtatatttttaaaaaataaatttaatagtatacccctgaaatttagctaatctcttttatgcccctgaattttgcttactttcttgtatacctcttgacggagcgtgggggctcctcaccgggagaccgcgcaggcccccctttgccggttcggccgggggctctgggtgaggttctaagctcctagtctgtggaaggttcgcgacaatggaaaaagcacaagacacgggcgatgtatacaggttcgggccgctgagaagcgtaataccctactcctgtgttctggtggatctgtgtatgaagaagctacaaagagctggagagccagagagctcttactctagaaaccctcttctcccttttttcctctcgtgggatcttctcctggatcctccgggagtccccaatcctaagtgggcaaggtcctccttttatatctcaaggggataccacatgcaccacttctacctatctctcttttgtgtcgggacttatcctatctttactcaaacttggcttgtcttctctagaaagctaaaaatactgcttgtttttgagtgtggccacgcgtcctcactcgtctgacctcggggatcaccctgtcatctcttcataaatgggcggagacttgcaatggctgctgtccgaatgaccttctgatgggacggcccatacctacctccacttccgccggaagcaggtgagacgtgggaacatggttgtctgccgatgacatgaccagtgtcagaccggtcataaatcggtcattcttgtccaccacgtgtcagtctagcaatctgcatgttcgcccttcttcatacaatatcttgcttgtaatggttgggatgaagcctggcatatatctgaccgggaccaacgtgccatctccaggagctaacacgccggctccggctagggacgagtgcttggaggctcttatcctgacgggatggggcgaggcgtgtgtcagaccgcctgttgccacctaacccacgatctgaccggcctgtgactggtcacagaccggataaacgagcgcgctgcactgcgttacatgcgacgtgacgctttcgtccaaaccgcaataaatgcggttaggtgagccccgccgtgctcacctaacctatacacgcggcgcaaaacccacaaggggtcggggcgcctcggccctcggggccgaaacgggagtggtccgatccctcggggagacaaagaggggggcggccacatcaccctcgggccagacccccccccccgagggggtcaggccacgtgggtgattgctcctgcccaagcctctagtcatgatactcccggtcccatgtcaccgacacctctaaattttaattttgatccctttcataccccttccgtcagttgaccatttaatttatataaaaatgactattctaccctttggataaacatagaaatttatgaattacattattaaagatgtaaaagcttctcgcatgaaactattatagttatgaatttattgtgcgatgcattatttatcccaaaaaatatttttagataatgaaataaaattgtcgacgtttgatgtcgcaattctggtatttgcatggtatggggatcgtcggtgctaggatatacgcgagactgaggtaaaagagatggagacagggatttttatacaggttcgggcccctaaattgtcgggtaatagccctacatcctgttggccggagccgatgttgctttttattcaccataatcataccagtacaatatgtggggtagcctatctaactgttgtcgacatgtcggtctgaaggtctgactcgtagtcgacaacagggtagccttcctcctcgagctcgtgcccgacggaatcagagacagtgctagatccctacggccggcctctgaaggtaccggatagggtcaatccaggcgtatctctgatgtcgatatccggcggcttgtcttggcgtatgttggcttctatgttgattgtgttgggagttgattgtctcgtggtgggtcttgatcgtggtgaccgtgttgatcgtgtcccctctcctcctagggggtcttgtattcatacccataggtgtccccttgtctgagtagaactagagagaccaatatggatacaatccgagtagtcctggtcgtttccatgtagaactctggttgtctttccttatccggaactcctcctatatccgcaggttgtttccgtataggacatggtatgtggtgggtcctgccaagatgtagtcgactactattaggtatgtggtatccataaccttgaaaaaatattatgtatttatttttcaaaaaaaggcataaaaataaggagcattcatttaaagataggactaccaattttcacaataattttatttatgaatgctcccgataaaaaatccattgtcctattaaaatttcaaataaaaattttaatttattatatttgttttatttctaaaatttatgtcaaaattttctgcactaattatttagtctctttagtttcataaaatacacatactgcgcactcaaacaaagttttcaatcgtttttaagcttacattgaaacctaaaacatcaaggacaaaaaagacatttgcaaccaaacgtaatagtgaaatgatagaaaatgtaacggtaggagcataaaagggataagttgaaatttcagggatatagaagggatcggataaatttcatgggtatgaaaggattaagtgagttttcatagataccaaggaatttactcgataaaaagagcccccaaagggaggcacagggggcagactgcattttttttctaactcccagacctcttcctctgtcagtttccttgtgtctttcattcctctgcctcggctgctccacctatcccatgatacccttccccaccaagctctggagcttggagacgaacccagagatgagcagccaccagatatggacctaccgtcctttacttgctttatccgaacttattggaaattttcaaaaataaatataaacttattggaaaacaacgcaaactttctcaaagtactggttacaaggatatacacttacttgtgatgaataccataacaacagaacccattagagacgagtacaaccgagtctaacacaaatatttcaacacaacatgtatttcaccttcgtctggagaaatcataaatgatatccaattaaacttgtcgatgacacatattacattatattattgtccaactcagtgatgtacatccgctccaacatgtttgagctaaggtatgccggtaacaagtttgggggtatggagcatgtttccgtcaaggtactacatgacctgttgcatgggtaaccttgcattaggaagtgggtatgaccatgtgagatagaagcccgagttttaacactagggaaacctagtcaagactacacctatttagaatcctcatgtctgctgccttagtgactagatcattacgccaatgttccacaacccaatctaggagaatgatgctgctgtttcccttatctggctcaattggcctccgctcaaggtgatccccagaaggaatacaccaaaggcgaacacattgatggatggggtagtcttgctggtctgtcctagttcaggagctacgtatcccagagtgcggaccatgtgtgtggtttgcatatctgtcccatgatcgtaaagttttgctaggacaaactcccattcatctggtcatcgaggagtacgttacctgctttaatatcttgacggaggacaatttgctcccaatcctcatggagtatgataaccctgaagctacttccctgatggccaatccaatgtacccttgctacaatcatataggtatttatccatgctaccatttggtatgtaactatagaccaagagaagtacttatccctttcgctagcaactgcacgaggtcgtggtggccagtggcgcagctatggggggtgtgaaagggtgccaacacccctatgcaaacactaccaccactaaacccccatgtttttactctatattaagattagctaagataagtatttatctagtttattttgtatagcttgaaagtattattagtttagttagttagcaagtctaaaaatattagcaagaaacatgatctacaaaattagtttgtgatttctcatctttttcaaagtaaaatagatgaatgtgagattattcaatagtttacattaaaagaattagcaataaagactagtttcaaacttccaatgatattattaaacagctaaaattcaagtttttcttaaaggactagtttacgtattgtttgttattgacggtgactatttgacctcctttgctatcaatattaattattcggtctcatggtttatcttcaccccacacccccctaatctcaaatcctggcttcgcccctggtggtggtgcaactgtcgcatgcttaacctctacaatgaactccttcatcccatctcccatgccatgattcatgtgacatcctctttacagcgaccttgatggcggacttgtggagcacaccctttgtagacgctacctcgattcaccaagatgtttaattttgtcttggagtaactcctatgtggtcaaggacgaggacttttttgttgcactgcagtatggacttgactgctgactggtgtacttagtagtgagagtccaatcaatccgttgtctacataagacatacagatgcttaattagactacgcaaggcaatttcgcaaaggcaagagagaggtagagatgagctcatcatcatcacaccatccagaatttgcctcttgtactgcaaatgatgatgagcaccatctcgatgagttcgagttagaattggtagtgcaagatgtgcagcggcagcagaataatggtagtgcaaacactgatcagcatgagcgtgagaacctgttgctgcttgatgacagcagcaagtcgggagctctgaagaggcgtttgttcttcgacaatctgctgaagaatgtccaggatgaccatatccgcttcctgcacagacagaaggaaagaattgacaggcacgtttttagttcttttttcagcacaccgtttatgtgtatgtctggatgaagataaaatctctgtttatacaactgttgttttccttttccgagatacagtacacactcaccttataaacatacatgcacaccgtgttccaatgagcatttttgaacactgcgccaacatattttgagattaatgaagtcacctcgtatatgtgtttctaactgttgtttttctatgattcatatccacagagttgatgtcaaattgccagcaatagaggtgaggtataataatctgtctgtggaagcagagtgcagaactgcgaatggagatcatctgccgtcgctatggaatagtaccaagggagctttctcagtaagacaattctgacatgattgattctgttatggatcaaatagcggcatctgaagcaataactattcattgaatatcatttaggaaattcatacacttttactcgctgtcaatccaagcgttgcatgggttattattatcaacactataaatattataattctaatattgtgtttgatatgttgattatatttgacattgtagttgttccacttaaaacaagagcctggatcagttacaacttgctaacattttttatattccttgttaaaatttatttaataaaataataaattaagagtatatgtactatacaatatttattaactacaaatttcgtaactattaattctcttcttaattgcatgatttcgttaacacggaatctcaacattctgctgtcactaatatgatcctttcagttacatgagagctattacaaaatgcccaattaccatatgtatatacataaatagattaacctaccttaccagcattttgtttgattcatatagggccttgtgaagttgctaggcttagaaacagaaagagcaaaaatcaacgttctagaagatgtgagtggaatcatcaaaccctgcaggtatgtgccatgtttcaaggattttagttaatggaaaaaaaagaccgtaaacataaaaaatgtgttaccagttaaggtgatccgacatgctcccatgtttgtagattgactcttctattgggacctccaggatgtggcaaaagcactctgttgcgagctctttctgggaaactagataagtctctaaaggtacccacatcatcttcctttcataaataagaagagagtaaatttcatcaatggtctgagttacacaaaactacagaggttttaagatgtgacacataaccccagaaattatgatcataaaatttcacaaaaccatactattgatcattttggtttacaatcataatatgtgggcttatatgccacgccacatcagcgaaatcactttataaaacatctagggagttattttgcattggttttaatagttgagggggtcaatatgtctggttttgtggttgacagatacaagtatatgacccatattgaggaagttaaattggactgcttccaaaaaggtttggattggatttttattattgtgaaatagaaatccctcaaatgtaggttgaatttgatttgtatctcttaatcgaagaatagatagaacaactcctccaactattaaaaccatgcaaaatgactccctcaacagtattgatgatagtatttgctgatgtggcatccacgtggcatcccagtcatcctctatccacgtggcacatacgtggggcttacttgtaaattacactcagaaacctcccctcccctcctgtactgtctcccgccctcctcactctcccctcgctctccctgcctcactcactggccacatgattattcccatccaccgccgacactatctccccgccgctgtcgcttccatcccctcactggccgctgctgctgcagcactagcagcccaagcccccctctcccaccccgtcgccaccaaccaccaccatagccccacgacacccatcttggacttggtcctccttggcacgatagcgagtgccgtggtgccatccatctcctgtaccactgggagcagcagtacgggggacaaggctcgtctacaccattgagcttgaatcgtcctccatcgtcgctgtgatagctatgtgggcggcaggcataggagcggggaaaaggattgaggcaggagctggagcgagtcgattggtgcggcggaggaggagcaacagtggacgccttgaccttgacctcctggatccagaagccaaagcaagagcagagaggcgcaacggctgcctcggcgggtactagcgagaagcaacgggatgccatcttggcagaggagcctcatcagggtagcgactgaggtttccgtgggtattggcagaggagggagggagagaagaaggtaggagccgccagtgcccttccctgctttggctcaccgttgccgatgccgccctccagacctctcgatgtactgtttgtgcccaaccgctagagctagaagtgtgtgaggggaggaacagggaagagaagaagcgaagggataggtggggaagaagatggggcaaggatttacatgtgggtcctatcgtctttttttttttccttaattataatccatgtagacgtcaacgtatgataaaggctaggccagtgtgtgccacatagaacaaaactactattcaaacagcttgaggagtcaaattaaattggtattgatagttgagggagtcgttatatccgattttacggttgagggatattaaatccgagctataacaagggagtccatttggaccttttacttgcgaaatcacagtcccaaattggattcagcccatgggctggattgtccccaaatcccttcgtacactttctccagccacagcgccgccgcaattcgctcgccgccgccgccgccgccggtgggcggtggcttgccacctccctctccgcctccggcagccttctacgctgcccgtctccgtctcttctcccttcacccaaatccccagacattcggccatggccccccctgactcttctctcttcttggccgcccgccgcggcgctgcctgacgaggatcggcggctcggggcggaggaaccccgagcttccggcgcgagggggtggcctcctcctcctcctcatcctcatcgtcgccgccgcccacgtcgtctcgccctcggccaacgcccgagctcgaccacaaactaaaaatcaagaacaagaaagttttatgttctgacaaactgaatgtgaagatgcaaagcttttacaggtaacaggggatatctcttacaatggctatcagcttgatgaatttgtgcctgagaaaacagccgcgtatatcagccaatacgatttacacattcctgagatgactgtgagggagactttggacttctcatcccggtgccaaggtgttggaagaagaccaagtaagtgtaatggacattcttcaccaaaattcttgatcagaaaaagaaaaagttcttgattaattgcaataatttcttactcactgattttgtttgctcaaagaaatactcaaggaggtgagcgcgagggagagcgcggcggggatcatacctgatgcggacatagatatatacatgaaggtaaaagatgtgttatccttttatgcactggctggcattattcttcctcacttcacaaaaaaaagcaacacctgattatttgaggtaatactaacaatgtaacctttcttgctagaataatattgggttgtagtaaaactaaggcaaagctttcagtaatcaacatttctatttctatttctataattaaacattttggttttcaaaagcaaagtggctactgcaggctatatcagttgaagcttcaaagagaagcctacagacagactatattttgaaggtacatttccccaaaacatacaagtttaactttcagatagtgaaaatataccaacaagaatcacagtgccgcttgaattgtagatcatggggctagagatatgcgcagacacgatggttggggatgcaatgataagaggactatcaggggggcagaagaaaagattaaccacaggtatggtaaagctgatcgatattacttggaaatacattcttccaaattaaggcgatcgatcgattaccttgtgtataatcttaaactttcaccttcttgcaccagctgagatgattgtggggcctgcaagagcatactttatggatgaaatatcaaatggtctggatagctctaccacttttcaaataataagttgtttccagcaactgacgaacatcagcgagtacaccatggttatttcacttcttcaaccaacacctgaggtatttgatctttttgatgacctgatattaatggcagaagggaaaattatataccatggccctcgaaatgaagctctgaatttttttgaggagtgtgggttcatatgcccagaaagaaaagaggtagctgactttctccaagaggtaattttcctcaatcacaagagcagctgcagcacctgatttatatataaattgcatgttcatgaaaacagttcttttttttctgattccgaaaccattagatcttgtcctgcaaggaccaacaacagtactggtctggtccaaatgaatcttacagatatatatcaccccatgaattatcaagcatgttcaaggaaaatcacagagggagaaaactagaagaaccaattgtttctccgaaaagcgagttgggcaaggaagctttagcattcaataaatattctctgcaaaaactggaaatgttcaaagcctgtggagcaagggaagcactcctaatgaaaaggagtatgtttgtttatgtcttcaaaacaggccaggttatacttcattctaaggccctctttcctgtacgaagtaaattttgagtcctaactgaggtttactccttactgcagcttgccattattgcactcgtaacaatgtctgtgttccttcgaactcgcatgacaacagatttcactcacgcaacttactatatgggagcattgtttttttccatcttaatgatcatgctaaatggcacaccagagataagcatgcagattaggagactcccaagtttttacaagcaaaagagctattatttctattcttcatgggcatatgcaataccagcttcagtcctaaaggtccctgtttccatattagattcacttgtatggatatgtatcacatattacggtattggttatacagctagtgtttcgaggtaaataatttattggagatttggcaagttttcaacgataagaacaaacattgagaaactctttaacacaatttatttatacccatttgtaggttcttctgccaatttctgatgctttgttttgtccatcaatcagtcacttcgctgtatcgatttattgcttcatacttccaaacacctactgcgtctttcttctacctttttctggctctaacattcttcctcatgtttggaggcttcactcttcccaagcgtaagataaccatcgctcattgtgcatataaacctagcaaaaataaacatattgtgttactttgtttttccagcctccatgccaggatggttaaactggggattttggatttctccaatgacatatgcagaaatcggcacagttattaatgaattccaagcgccaagatggcagaaggtgaaatatgtttttttttcaaataaaaaaaaatgagttatcagctgctttcaagcatttacatcattgctacttgtattattttcaggaaactattcaaaacataacaattgggaaccgaatcctgattaatcatggcctatattacagttggcacttttattggatatccattggagcattgttcggatcaatcattttattttatatcgcttttggattggcgctagattatattacatgtaagtttgctaccattgaacaaagtgcatatttctcagactcgagctccatggtactcaggcagcataatttgacatacagtgaacttggggtaatgcttttggaaatctctattttagggaatacacctggttgtgattactgggcgtaatttctgaaatatctactcgatttccgatgttttttgaatatattcacatagcagatttatatacataatctgcagatacctacaatccaataataaatgacaaaagaaaatacaatttgaaattttgttcaaacttgtttggagtggtttatgattaaattagaccccacaaaattccatgccatatatcgtgacaagactgcagatatggggatgtaagagctggggcactatggagcaccagttaatttgactttatatacgcatattatttacttgagaaacaaattataaatttgcctatttcagctatagaagaatatcatggaagtaggcctataaagaggttatgtcaagaacaggaaaaagattctaatatacgaaaagaatctgatggtcattcaaatatttccagaggtaaagacataaacatctcaatatcaagtaatagtaagaaatgaaggtcccacaaaaaaaagtaacaaaccaagttagcagagttgcgtttcgaaagcaaaatgcatgcttcttcaatgcattgatctttttgcagcaaagatgactatacctgttatggaacttccaattacgttccacaatctgaactactacattgataccccaccggtaattaagaaagctccctatgtatttgatttttacagtttttgtgtttctcgtctggttcatatttgaagataaaggtatgtaagaaatgtactctcttgtaggaaatgctgaaacaaggctatccaacaaaaagacttcaactacttaacaacataactggtgcattgcgtcccggtgttctttctgcactaatgggtgtcagtggagccgggaagacaactctgctagatgtattagcaggaaggaaaacaggaggatatattgaaggggacataagaataggtggatatcccaaggtgcaagaaacatttgttagaatcttaggttactgtgagcaagccgacatacattccccacagctcacagttgaagagtctgtaacttattctgcttggcttcgtctaccttctcatgtcgacaaaaaaacaagatctgtatgtcccttggaagttggaacaacacagacatatactgattttaataacagatagataaacaagaagcttacctaagaaactaacaatgttgtttttgttcctttgggtaggaatttgttgctgaagtccttgaaactgttgaactagatcaaataaaagatgtcttagtggggacaccacagaaaaatggattatccatggagcagcgaaagaggctaacaattgcagtcgagcttgtttcaaacccatcagtcatactaatggatgaaccaacaacaggattagatacaaggtcagcagcaattgttattcgtgctgttaaaaatatttgcaaaacaggaaggacagtagtgtgtacaatccatcagccgagcactaaaatttttgaggcgtttgatgaggtaatttaactttcgcaatgtgttatatatatcaaacataatcaacacaaatatttttttattgaacatatcaaacatgaagaacaaaaataaagttatcttttatgctggaaacatcaataaatctagtttcaaagctattaggattaaaaatagctcgttccttcaacacggacttgagctaaatttaattaagatgtacattttcagttactgaaaatttgaaacacctatgtgtttgttgcattctccgttgtcttttcagtaaagaaaaattacagaatacaatagtatagaaatttgtaaccttcaaccattttactttgcacaatcaaaccatcaaatttgcaattttgtccccttaaatgatcgattctgtgcaacaaagccctttatattaattttgcttattagaaattttaacacttcaattatttggttttttttcaagccctttttattgaaaatacctaatcaaaccctttgaataatatatctatgttatgatatagatgtttatttgatatataacaactatctactttctagccatttttttccattttgggagaaattttcttacccgaacatttggcttaaactttgtgtacagaaaaaaaaacattgtattagttagcatgaagaataaagtataaacgttcagtgacagtttgttttgatatcttttttgaactaaaatacagtataaaaacatcaatgacagtttatttttatctcttatctgaactaagagttcatactatcacaaatttttcatcgcactaacaaaattggacttaccgggcttaattaccaaactaaaatggtttgagggcttatactttaatgttaccaaacagaatattatgccattttttttgtttcctggactatgtatatcacaaaaagacgtgacgacagacggtttgtgttctgagttttctgattacgaacaaaaaaaaggcagaaagctactttcctacagtgctagtagaaagttatatttgatgcattgagtaaatcttcttgcagctcatactaatgaaaaatggtgggaaaataatctataacggaccaataggagagcgttccagcaaagtgattgagtactttgaggcaggtttcttgaacatatttcctcatatgtatctgtcatttcttgattattcattttcactggtttttctgaaagtgagataagattcatcacttcttgatgaattgatatgatccgaactgccaatgccatgtgcaatgtttatgctattttagagataaattttatctttagaaattgtagccaaaacaattaaatcaattctgagtcatttgtgttcaatatgcaactttgctaacaaatcatataagttgatcaaaatgtcaacgagagtcatgcaattcatatgcccaggttgaaattttggttcaaattctgcaatccccccct

SEQ ID NO: 1313 - DNA, 4674 bp, Oryza sativa
cccccacgacatgaatctattttggcaaaatatttcagattttttatctttttatgaatttaggaagatttattcaattttgatctttgttcaactttttggaatttcggaggcccccttatatagatttgggcataccgaattaataaactttgtggcttgcatatctgtgtactccgtaaatgttacccgtgttttcagagaaccacatttgttgcatggctctgccattttcgtgtcatgtgtcctgaggttataatagattgaattttccttgtctatgatgatagaaaatttctggggtcttgaaagtaaagagtaactgcaatccagctgcttggatgatggacgtaacatcaacatcaatggaggtgcaacacaacatggactttgcgattttgtatgacgaatcatcacagcataggtacatatcttgtaaatttgattaggattttatgagtgaagagaacatatggatagctgaaagaaaataaaattcaactagcaatttttttaaccaaataaaaaaaaactttcatttaaatttaagaatgactaaaagttacttttctgcagagacatcgtagagctagtggagaagctaagcatcccaataccaaattcagaaattctatctttctcccatcgtttcccacggaatggctggattcaactaaaagcttgcttgtggaaacaaaacttaacttactggagaagtcctgagtataacttgaggcgtataatgctgacagtaatatctgccctggtctacggagtattgttctggaagcgtgcaaaaatattgtaagtccactactctcttatccacaacattgcacattattttgttaactttgggtacggtgcttcgccacaaagcattgccttgaagtactcagtagaataacataactttctctgatcccttctaagaaacgacgagcaagacctgttcaatgtttttggtgcaatgtatctgggttccacaactatagggtcttataatcatcagtcaatcataccattcagtacaaccgagcgcattgtaatgtatcgtaagaagtttgcaggaatgtactcatcttggtcatattcattcgcacaggtcaaataatgatcacaagcttgtaagcaaagtaaaatctacattgttgatactaatgttcataatattcaccttctacaggctgccattgagatcccctatgtatttatccaagtggtactatacacgttaattatctatccatcaattggttattattggacaacacacaaattcatatggttcttctacactacattttgttcaagtctctcctatatttatgttgggttgcttcttgtttcattaacccccaatgttcaagttgctaccatattggcatcttttttcaacaccatgcaaacactattctcaggatttattttacctgcgcctgtaagcctttattttctcctaatatcatgattattttctggtgatttactatggcctctaatggtagtagaatcaatctagaccgttcatcttttttagtttaatatatcatatttatttatactatcaccttaactattggtacgtagtggaatatgatctcgttttttttttcttgaatactaccagcagagaatggcagtcagaaattttagacactccaggatctaactttgttcacttctttttgttagcaaaattttgctgctcacgttgaatatataccaactactaagaaaataacaacctacatgagaactgcttaacgtgattttgtagtgtaattaataaattatattgtggaactactaaggaatcactggatgacaatacactgaagcactccaacataagtttaacatcgtagtagttatgggcgtataccattttttcagtcatatcatttgtcttttccatttctattttgctaggttggaaattaacatttgtattttagaagaattgtgttttgtgcaagtgttagggaagaatcctgaaaagatcaggaaaaaagaactgaaaagatcaggaaaaaagaactaacatgcatttcaattgttcgcgttgcagcaaatcccaaagtggtgggtttggctctactatctcactcctacatcttggacactcgatgccctcttgacatcacagtatgggaacatagagaaagaggtcagagcatttggagaaactaaatcagtttcgatcttcttgaatgactatttcgggtttcataaagacaagttgagcctagtagcagctgttctcattgcctttccttttgtgttgataatcctgttctctttttcaattgagaaatttaattttcagaagaggtaaagcatgttctgctgttccaacagacatcaaaatgtaacttgggtgactatttttctccaactgcgaaatgcatgaggttgattgggtgactatttttctcaaatctgatgagtaaacatcgttaattaggaaatacatattattaacttgattgtgctaagtatgcttgtgagttataaccttttttgtttcaccgaatggaatattactcgatggtttcgtgtaacctgctttggagaggattttgctatattacgttatgccttagattattgaatgcatcaatagaaaatgagcacctgatcgactaatgcgtgtacgggtatggattactgaaaagaaaagcagaggagagcggagtatgcaggtaggtcacctggtagtaggagtcacctgcatccaccaaaacctcgctcagctaatggttcagatacatgaatcaattgatcggcttatgcgtagactccatagacatctactccctagttttcaggttataaaatgtttttgactttggtcaaagtcaatatactttaagtttgattaagtttgtagaaaaaaatagtaatattttcaaccaagacaaagtaatcatgaaaatatattcaattattgatttgataaaactgatttaatattataaatattactacatttatctataaacttagtcaaacttgaaacagtttgactttaaccaaagtcaaaacgtcttataacctgaaacggagggagtaggtagttgacgccggagtttggaatccaatgacttcatgtatgggctcaggtagcttgtcaactacataagcacgtatgtaacacattaagtgggtgtttggttggttgcctcgcattgccaagccacacttgtcatgtcataatttcttaggttatgtttatttcgctgccgcgactatgtcttgtcacattttcttagccttgtatccatatatgtcattctctcaaatttgaaacaaatcatatgtggccaactatttcttagtcacacttacgccaccatgctacaaattacctaactttattaattaatggcaaggttaagcatcaaccaaatatcttcacagtgttgaagacgaccgatctgcctagagacccattgtcgctcacttccctggagaccttggaaagaatatggggaaagagaggggagaagaggaagagaggagggagaagatagggcctatgacatgtgcctgattaggatgccatgtcaatcaaaacaattatccatattgttttaggatattacttaattcgatttagaaagatgggttcaatatttctgttattgcagtttgaggatataattcgaacttgacgtcatgatgaagaacctaattaaacaccgtgtttagatcctaaatttttcttcaaacttccaactttttctatcacatcaaacttttctactcacataaacttctaattttttcgtcacatcgttccaattttaaccaaactttcaattttggcgtgaactaaacacacccttaactcattccaaaccgttatgagtgaaaattaactgcaccaacagaccgaaattactaccgcatgtgggccaaaattaccagagtctatggacgaaaattccagccatttacaggctgaaattaccttcacttatgggccgaattgaatactgctagctagggccgaaatggaataagttcacatggtgaccctcaaaagtgattgaaatctaatccgtgactctaaaccataaaaccggataccttggcccccaaattatgaaaaccggtgcaatttgattccctcggcggttttggagagcggttttgctgacgtggcggtattgacctggtctgtgtgctgacgtagcgcttagctggcatttcaattaaaagttatacgtgggacccgtttgtcattcacacacaattgtggggcccactgacatgtgggccccacatggcatcttctccatttcttcttcttcctcccctcccttctctctttctttctccctctcccctacggccgtccgcggggagcgagcgaacggcggcggcgggagctagctggagcggcggcggccgtgggctggagctgaagcggcgggctggagtccatgtcacgccgctcgcaccaccaccacccgcaccacccagcggacggcatcgagacgtcggcggcggccgagcgacggctgtggcagcccgcgggcggcggctgtgggccgcagcgggagggcaggcaggcgggcgggcgggcaaggtcggcggcggctcacggcagtgggaggacgaggggaacggcggcgggcgggagaagcaggccacggcggtgacttc

SEQ ID NO: 1314 - DNA, 5104 bp, Oryza sativa
  unsure (1)..(5104): unsure at all n locations
cgtccctcagccgccacttgcactgtcacgcccggaatttctacccaaaattccaaacgcttacatgtgtgtaaaccctcgtctaggaatcagccgaggcacacaataacaaattaataatagagtgcaattattactctaattaataagcgaatataaagtcattacagagatagatagttcctctcaaacaataaaaatctaagcagcggaaaataagataaacggcacagacgaccccatcccacaagcagcttgaccagggctacgcttaatcctccacaccttcagcatcactgtagaactcctcctctgatgaatgattgcaaggtgagtatatggcatactcaacaagcgacgcagcaaatatgcaagtgcaagggataacaaaggatggcataatatagtctcatttgcataaatagcatttaataaatacttcagaatttaggaaaaacaataaagtatttaattaatcaatattaatccatcgctatacaacatacccgttgcataggcccaaccattctgaataaccaatcccggctgcacagttctatctccaaaccaggaatataccattccaaaccaggagctaaacaaattattatcattatcatttattatggtgagagatatgaaactaatcacgaaagacattgttagacccgcccataaccgcgggcacgactattcgaatagttttactctggccagaggtgtaccactgtacccacaagacacaacctcaacatcatgtcaaccatgcgtcgcgatacttaacaagtacccgaatagagattgtgacaataccctctgcataacacaattcaaagcagtgcaccgttcctggatcataatcacccccttataaacaaggcatggactccccagcgacccccgtgggcttatctccgccacttcacagtctggtgctctacaatgaaccatactatataaaaagtaaagccgttgcctatgctggcttgtggttggcacggttaatgtttcacaaccgaaaatcgtgaaccggtccttaattgtcatgagcacgaccatcaaaaccatgtgctcacaacccaccattatcaagttttagttgacaaattaattaattaaccaatcacgattaaccatcgtgagctatcattaagccatcattaaataatagtgaatcataagttatcccatttatatgagctaatgtctctaagcatggcaaagcatcctaagcactttagctaaaaccatataatgttctagctaatctaattattaaccaaacgacaaagtataggtaatcaatatcaaagggctataacaaaggcaataggttattcccacccaatgacattcaaaaataaatgcaatagttgaatagaaacaatagctttaaatgggatcaacatgctcaaagggttgtttgggatctgtgtaacttgccttgctggccttggaactcttcaaagtcttctcctgcaaattcggactctccgggaacgtcggaatctaagcataaaagagcaaaatcaccaaaacagcacataaacaatcatgaacagtacatgtggatatttttaacatgtagatctcaattttagaaaaatttagagacttgaaccaactaaattcgagctaagatgaattagttatgaatttttaaagattaaatcggattaaatcatttatttagattttaattgaattataacgcaataaagaattatttttgaaaaggaaaaaggatttattgcgtcagcggctcgggttcacggtggaccgggtgcacggggacggtctacggaactaacggccgagatctaatctaatccaaaacggacggccgggatcgaatcgatccaccatgggtctacggatgacgcggcgctaacgtcatcaccggcggcggctcggcaactcacgctcgccggcgaacgacggcgcggcggcgcaaacagagggcacctacgcgtagagggcaacgcggcgaactcaccgagggctcagacgacggcggacggcaacggacagcgacggcgacgaggtcgaagcggcagaggcgttcgggtcgacgacgacggcggtgctccggcggtcttcggcggaaatggaggtcgggacgaggactgcgacgacttggcgatcctgacggtggccctcccgagcgacgacgacgaccggagcggcggcggcgcacggctggactcgcggcggcgacggcggcgcacgggttgtcacggaggcggcgctacaagcggcggcgaactgaggcgagggtggtggcggatagaggaggtcccgggggtccttatataggggctaggaggcggcgacggaggcccacggcggccggcgacagcgatggaaggtttagggttaggaggaaaaaacgaatccgaatcgagctcgaatccaacgatttccaaatgaaattagccgaagattgcaaaagagaaaaggaagaggagatcccgaggatcatttcccctctattgattcgatcagatcgggaaagacgcgggcgaatttggaaggggcggcggcggcttgcgcggctagggcgcggctgcggcggcgcaaggaagacgacgacccaggtaggtaggccccacctgtcagcgggagagaggagagcgagcagcggctcggctcagcgggctagctgggccaggcacacttgggccggggagagagagagaggggggttttgggccgactttcggcccaaagccaaaagaggattttaaaacctttttctttttaaagtattcatgaaatgcaattccatttattaaaaatacttccttggctcaaataaatcccagaaaaatctaggaactatagaatcaagagaagtatttaataatattttatctagcccacttttatattggaatttattatttaaaattaaatcttttcttcaaggcttttaaaatcatttctaataattccatttaaacaacaatttataaatttaggattttcagggtgtgacaaacctaccccccttaaacagaatctcgtcttggagattcggaagagctgacgaaaagatgcggatgagttgactttaattcatcttctcgttcccaggtagcttcttcttccgagtgattactccattggaccttgcaaaaacagataactcgattcctggttcttctctcatctgtctccagaatacggattggtttctcaacatatgttagatcctcttgaatttctatctattcaagattagcttcttcagtgggtacccttaaacatttctttaactgtgacacatgaaacacattatgaacacctgccaaggattgaggtaactccaactgataggcgacctcacctcttctactgacaatcttataaggtcccacaaaacacggtaccaattttcctttggtgtgaaaacgataaaatccccgaagaggcgtgacacgaaggtacacatgatctccttcctcaaaacttaaatccctgcggtgattatcagcataactcttatgacgagactgagctatacgcaatctttcttgaatgatctttaccttctcttcagcttccctcaggatatcggtcccgaaaacctgacgttctcccgtttgatcccacaacagtggagtgcggcacttccgaccatacagtgcttcataaggagccatttggagacttgcttgataactgttgttgtatgagaattccgcgtaaggcagattcttatcccaacttccaccgaagtctaaagcacaagctctcaacatgtcttccaaaatctgatttaccctttcagtttgtccgtctgtctgcggatgataagcggtactaaagttcagcttggaacccatctcttcctgaagcttcttccaaaactttgaagtaaactggctatctcgatcggatactattttcttaggaacaccatgcaaacacacaatccttgccatatacaattccgccaaacggcttccggaatatgttgtcctcaccaggatgaaatgagccactttggtaagtctgtcgactatcacccaaatagagtcatggcccgatgacgttctgggtagaccagtgatgaaatccatctctatttcctcccacttccattctggtatctttaaaggctgcagcaaacctgcgggtttctgatgttctgccttgactcgctgacaaacatcacacacagctacatactctgctatctcatgcttcatacttgcccaccaaaatttcttcttgagatcttggtacatcttggtactaccaggatgaatggagtataaagtgtcatgagcttccttcaggattgcatctttcaactccttgttctctgggacacaaattctctcgcctaaccatatggttccttgctcatcttccaaatacccgatagcctttcctcttctcatgttcttcttaatctcttgaatatcaggatcattgatttgagcttctctaacctagtcaatgagagtgggcttcgcttctaatgctgcaacgaaacctctactgacaattcccaaattcaatttttcaaattccttgcataattcccacggcaactgtcgtccttccgtagcattgcaatagcctttcctgctaagagcatctgctacaacattagcctttcctgggtgataataaattcccatgtcataatccttaatcagttccaaccatctctgctgcctcatgttcagatctggctgggtgaagatatacttcaaactcttgtgatccgtgtacacctccgtacgagtaccaaagaggtagtgacgccaaatcttcaacgcatgaaccactgcggctaactcaagatcatgagtagggtagttcttctcatgcggacgtatctgacgagatgcataggcaaccaccttcccatcttgcatcagaacacaacctaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1315 - DNA, 288 bp, Oryza sativa
tctttgtttctacctttttttttttgtttttgctgtagcttttcagtttttcatttgtgtcatttatgatcagtgatgctcgagtcatgtgggataacaaaaccggacgctccagaggttatggttttgtctccttccgtaatcaacaggcatgaacaactcagacctttttccatttcgcagatgtttaccaatttttgtcccgtgggtgatgtgtgttccacagcttattctctacctattattctggtgttttagctatactacagtgacgagtgacaacctatt

SEQ ID NO: 1316 - DNA, 351 bp, Oryza sativa
aggaaaggaagagagcaaggggggaagtcagagttgaggaagagggtgggtagtattgacaaaaacctgcattgctaagtctggtcacctcagcttgagcaagctggacaaattcctctttatttccttgaacgtaaatgtgcagtcggtttttcagggtctctgcaagtttctctttcctttccttttgaacagcctggattgaagtatactactcagcagaatattggggcagaagaatatgaaaaatgcaacaaatatgaaaagaaagctggcaaaagaatcatacattaatgtccattgactgtattcatgttattcaatgagcatggaagatgatataaaataaac

SEQ ID NO: 1317 - DNA, 393 bp, Oryza sativa
aaccgaaattttagaaatttcgttccgaaaatttgaaccctgcttaccaccacggattcaccacttccaacctaccaacgccactaccccaactacacataaaaccacttgtgttttcttatctaaggatgaaaaaggtccgaaaatatggaaaccactttcatagttatatttctttcggaacggaatcgaaaacagtaaagaataaaatgaaaacggtattgaaaaatattggaaaaaccggaaacgacgtgttggaaaacgataataaatatcaaaaacattgaacggcgaaatcacacatttaactttacatagctatataaaatataataaattcaagattatacaatgtaaattataaatgtcttttttttagccatgcacttgatt

SEQ ID NO: 1318 - DNA, 431 bp, Oryza sativa
tacatgataagactagccctctttgcccaaggtgaataatcaatactcagatgggcatcaggagagttacattgatcaatcgcaaattcacattccatcaaatacatctgttactctgttaaggcgagaactacttcgaccaaattagaaaagaaaatggtcaatagtacaacaataataagaagataataacacaattccgcgacaagcagtgaaccggaagaggagcactcactcaaatagtacagaaaccagaaaataggaaccgaaagaggaaggccaggcttgcgccgaacaagccgaacactacaaatgccttcctcctccttaagcacctagttgtagtacataagctgttgcgctgatgactggttcgggtacccgtcgtagagggcctgggagccagcagcaagaagccctgcggatacctg

SEQ ID NO: 1319 - DNA, 17742 bp, Oryza sativa
  unsure (1)..(17742): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagtaagcaatccaacgcataaatatgcaagattaacattatcaaaaacaaaaatgaacccatgataccatgctaatgcccagttcaagagagtatcaagatggtaataaaacatagaacatgggcttttagctctatcacatttgcattttattccttttcggatttttgaagaaaactatagcacaatcgcgatggtacgcctaatcttatcagtcagcgagtgatgagggcgccaaacagtgtcatcaaatctcaaacaagttttccagttagagctcctgttacaggtagtctcagtgctatcttcagcactacttatgcgtaaacacactcagtagcctgggacaaaagcagtggtaaaacacataaagcatagaaagaacataattgatgcacccatgaacaatcaagcgtgagcattcaaaaggatgtgccgaaagctattgctaagatgataaaaacatggcatatctatgagaaggatattgcatcaaaagcaaacttctagagcaagttgtgcacattaattaagttcaagtgtagattcaatttaagcaagtatcaatgcgcatgaagagcatagcatgaacatacaagctacttaagcacgtgtaacctagacaaaagatctagcttgcataaaagtaagagatgagtatcaaaaagatgtccagtaaattgttaacaaagctctttaatgaaaagatgtataatacaatgcaagaaagtaaacatgatgcaaatgttacaaatgcatgcaaaagaaaagaactccctctcaacgcaatccacaggggtggatcacccctaactcactttgcaagaactcacatcatgctcaatagagaggttttgtaaaaatatcagcatgtcgtttctcggatttaacaaactctagcacaatgtgttgacgaaaaatccacgcccagctaatggtgccaaatctgtgttgatgcgaactatgtcgacaaacacaatgccgggagatctgcttagctgccgggagatctgcttagcttcagtgcaggtccaaaaatttggattcgaatgcgggcgtgccagtcagtttgatattgcgactgacaggatagataaattgatgatcacatagtcgatcgaccaataaggcgatatggcgataccagacgatgttgataggattttgaacacatcggctatatgtccgatatagattctgacacttagataaataatgatataaagacaatcgactgatgataatataatgaaataaatatccaataaaccaattagccaacaatgatatgatagaataaatattaatctgatggttaaagcatacatcggctgggaatctgatgtcattagaatttaaatccaaaagattaggcaatcaataaaaccttgctgcaattggctaaaaccaacttgtatataatccttataagccgatgcaacatttaaataacttatcgactgaaaccccaatgaaacattgattcatgtttactaacttaaataaatctaacttacaaccacaaccctacagggcgaacacaactggatgtagcataaggttgataattacctgatagatttaagcaagccaatatgacaccaatcaaagtgatcatgtattaaatttgactaagacagtaaaatcatcaaagagaaatttaacacatcaaataaaccccccgatgaaacattagcacgaacctatcggcttaacaagactttgattattaataacaattgaggtcggacctaaccgatgcagcacgagattgcgtttaataatctgatctcaatgagtcgataaaactttctaatgcgatggatataacaaatctatttaaaatagcattgtgattgtagagatatgtcggctaagacaagatcagacctaaccaagatagtcctaactaaattgatgcgtctctaaacacaatgcaattaaaaatacaattcaaatatcaggtaggtaaaatataccaaccgaaccagagcaatccaagaggtcaaagcgatggagccttgaacaacaccaatataaccaatacaactaccagggccggcagaacttaggggttaccccttcaccgaagatcaaagacatgcagccccgcgttaggtgccaagttctgcaggtaacaaaaacctcggaaaagagggtgttatgcgccaatattgatccagagataaatggcaatgaccccaagtgtacatatttataccctcgggctgatacgagtcctaatcggacacgttacaagtttcctaaagataaaaagaaagatagaagtcttgatcagacactagacaaaacttaaggaaaattactaaaaactacctaattattagatagaattaaactgttatgccatggtcttcacgattccttcctaaactcgatctcttctagataaaattacatcggctgcttgacttctttccttaaccaaatccactaaagaatcttaccaaattttggtaaattttggcgttaacacaatggtacatttctaaacatattttcggagaaagtggtaccgtatctcaatgtgcttggtccttgaatgttgaaccggattcttaacaatgttaattgcactgttgtcacaaaaaaaacactcaaagacaagcaaccatacaccttcacttgtggttttgaatttaaacttcaaaagcccaaaaggacatctctcataaagaggtacacacccatgggcaaatgggccggcaaagtgactctaagggactactccaaagggctccaaagggagcctactcaccctaacatccacctctctatttatagcccaagatggatgaaatccccctaagataatgtcaaaattgcccttggggcaaaacccatagctcagatgaaatctaggccatccgttgttccttctcctcaaaggaaatatctcagatgtccaaacgagccgaagcttctcatgcgcacgcactccagggtgaacccgtgattcgcgcgaacgcctcctcggccaatcaccgcacgcacttgcttgcatttgcatccttatctgtcacttggtcttgatttttcaatctcttcaaataaccaagtttgacttgcaatattatttgctttgtggagcaaaatcaaattttcaaaattttgcttgaagttgccaatgtttccatcaagggggagattgtgaaacaaattgtggttttgatttattgtgatggaaaattggcgagtgtcggaagtgcaagaaatgtgtgctgactaacacgagtaaggttgtgatatctatgcccgaacaacgggcgttttgtttacgtgtgtgtgcaggtgatcgaagtcaaccttggtcaatggcgaggaccgggactatgctcagggaggaacggaggtccgacgcagtcaagaggccatgtgacaaggtgggactgacgtcaggatccttggaggtctctctaggtcaacggcagatcgggactaaactcatggaagagttgaggtccagaagagtaaaggatgccagttgacacggttgagtacaaggcggtgcccgatgaacgaacaccgtgtcagtagtacttcgcaacgagattcacaaggtcaagtgtgcaagtgtctgagattcgcgaagagtaatgtacaatgctagacgatacatgcacttggacagcgtatgtgtactgtactcatgcaagcaagtgattgggttgcgcatatgtgcacgtggcccaatgccatgcacttgtgcatgagtctgatcgacttggcttggaggaggtcaagccaattaggctcttgcttgttgacccaagacggaggcggtaaggcgtccggctagcagccttgttggcagggaggccgaaccatgctggtccaggtgatggtccaagacgatagttgcagatgaggcctggctagatgcaagacgcagcgagggcatggaggcgaaagccgtacgggacatgcggttgtctcatactcgccgcacaagcgcataaggtcgcataggtggagcgcgcctcccagagacgcgtggtgaacgggtattcggcgagcggcaaagacgtggatcaacgacgaccaagtacgtgtggtgattggccaaggagcatacgcgcggatagcaggccccaccgtagattgctcgtgccggagaagcttcagccttcagctcatctcactggtaggtgggcctagctagcaaggtgcgcgggaggagtggttcgatgcatattttatgtggaaaatgggatctggagcgggcaacaacatggaggacatccgagttatttcctttgagaaggaacaacggatggcctagatttcatctgagctagggtttcacccagagggcaatttgaacattttcgtagtgggatttccgtcatcttcgactataaatagaggggtggatgttagggaaagtagtgtccctttagagccccttggagtagtcccttaaaatctctttagtgtcccttctgcccatggatgtgtacttctttatgagagatagccttcagggcttttaagagtttaaattcaaaacaagtgaaggtgtatgattgcttgtctctttagtgttttctttttaacacctttcgtatcaaagatattctggagttggatttaatttcagtttttgcgctacggtctaagggaattcttcgctaaagattttttatgggtattcaatgaagaatttcaatacactatatacgacgactttgtccaaaaatgccatcgccgttatcgtcgttagggttccgtccattccgcgacattaagtgctataagatgaacaatgtacttaactccgcgacattaagtgctataggatgaacagtgtacttaacagtgcaaaatagacagaaccctaacggcgatggcattttgggacaaaatcgtttgtacgatggtatttcttggaactcacacttgctaatggcattttttggatttggacgcttgtcaatagcatttcttggattatctcaaagatgatggcgccaagaccttgtcacacgttgtaagcaatccacgtcactagatggtcagctccaggaaccatccacgtcactagatggtcagctccaggaaccttggcattgatggaataagccttgtgctcttagtagccttgttggtttttggtctttgtcgttctgttttgcttttagcatcttaggacagcatcctttcagttttacttttagcatcttaggacaacatcctttcggttttgctctttagcatcttaggacagcatcccttttatgctttatgttttcctttcacctttagactagcccgcagctagcaagctatggctataaatatgtatccaacctcccccggatagtatgacttggtactagagccactctatcctgtagtctagacatctcttgctcatccccttcacgagctcccctctgtcctcaaccggcagctggaacatcggctattcctgctcatccctcttcccctgcactgacgagcagcagctcgtcagaggcaaactcttcccccacactgcaggcccccaatagcatgccatgcccgcaggacagtcttagcgctcggtcgcctcgagcgcgcggctccggcaggaggccgagctcgccgcggccgaggaacgccagcaagcggcagcagagactgctgcgatggcagcgagggcgtcaaggctgcctgcggcggaattggtggcggcaagggtggaagtggaagcagcggcggatgcagcgcaagcggcggcggcagagctcaaggctctgcgcgacaatagctccagcagctctgtctccgcctacgacatccctgctgatgagctgacgagggaggcagctcgtgagcgggtggagcaacgggcagccgcgcaaccccacacgcgccgtagcagcagcccagccgggcgtggatgcgtcggcggcgttcctggcaggagcgcgcgcggcagcggtagcccagacgggcttggacgcattggcggaccccttggcaggggtgcgcatgacggcggtgctcccggcggcaacggcttggtcgacggagatcgcggccgttgcaggcggctcgtctctccctccccggaccggtaccgtggacaccacgggattcaggccgtcatcagggaagtcagccccggcggtggttggcctgccttcaccaagaccaactacatcgagtgagctgcggtcatgagggtgaggctccaggtgcggcacatgtgggaggcagttcggtacggcgacgtcgactacgacgaggatcgacgggcactgaaaggatgatgtcctaagatgctaaaagcaaaactgaaagaatgttgtcctaggatcgctaggatgctgtcctaagatgctaaaagcaaaactgaaaggatgttgtcctaagatgctaaaaacaaaacagaacaacaaaaggcttattccatcaggcattgggcttatatacttcttaaaatattaacacaccattagaacaattatacatgtgtggtgtggtgatgagatgcctgctcttgcctcctagcaagcttagttcgaacattgggtgggaatcttttttgttttcctttttttaagtggcatgcacaccttgaatggaccagcaaaagaagactagacaggaaaaaacacccatcatgaagatttgatcacatgatttccaggaacgtaagagttcatttaaccactttaagcactcgtcaacttattatagatgatagcccattaaattcttaatctcatatgagctcatcgccaacaaaatattttagatacaatttttgtgcatcaatattgtgccatgttgtgttacgcattcctggtaatgcatatgtgagctcatatgacagttgataatgagctatattctataataagttgattaatataccaattgtttaatgacatcactaaaaaaattgcactggccaaggatcgaactcaactaggtggcaagtttagacatcttaccactacaccattcatgtaccattatgtggatgggtgtgttaatatgttagaaacatatgagcccagaaccaaagttattggcgcggaccatctagtaatgtggattttgtgccacttgtgccatggtatcaatgctaggatctttggtgacaagatattgaggatgtttgaatcccaagcaaggaaaagcatagcctagcctagcaaggagagttgcttagtattagcaaaagaaaaaaaaagtattgcttagtaaggccaactaactaccgagaaaagctcacccaagacaaaaagccaaatcggttagcatccgatggcaatttgtcgggctaaacatccaagcattgtacttttgcttttttatgccatagctttcatgggctagcttgagcttgctaggccaagcaaaggtaattgcacaatctaaatagaccatgaatattggtgctaatgatcttggagccgagattcaggtccaattattttataagttttgtcaaggtctatttataaagtaagttttcaaatggaccagattataaaagatctagtccatggtctgcttcaaaatcgagctcaatgctctttagaaatcacaacaccacttaaacaaaagcatcaatgtttatgcctcaatcaaataaacatctatagcattagcagtatgctaacaattcctaggtaccaaatgaattgtcaatgacccgagaacacttaaaaaaaccatcttcaggtttagcaacttacaactaataaaattctatcacttgtaaacatcaatccaaaacaaatctattgaatgaggcaatttcaagcaaatattggaagcgctatcctaggtcacaaaagggaatggagacaatgaatgctttaaaatcttctaggcacaggactaacataaacaggcagatacgaaaagcgaaatgtttcatccgagaaagagtaacggggcctttacttgatgccaagatcaatgtgctcctggataccgaagccgaagcatccggtgtcactgaagttcctcctgagcagctcgtactccttgaccttgagcccgctctccagcagctgcatcgccttctcccctctcaccgtcacgtagcacgcgatcttctcgttacgcctgattccgaacgaccgcacggtgtacctcgctgcaaagaaagcgccccccgcaaactctcgtcatcaccacaacgaagctaagagtaaactagagtagagagacggcaatggcggagagcttaacctacccttggagaacaccggggtctgcccgctgagctgctccagcacctgcaagaaaccggagagagaggggggttgaaatggaggttggcgagaggagggttgggagaattttggggggaggggggttggtgaccttggaggcgcgggttaggcggtcgccgctctcgccgacggagatgttgaggacgagcttctgcaccttgatctcccgcatcgggttcgactgcttcttctccgacgcctgcaccacaactcaccacacgcacgcggaagaggggtgttaggttgaggagatgaacagcgatgagtcgggaaggagggagggaggaggcgaccatggcggagatggccgggagttcgtcggcggcgaggagggaggagggaaggtggcgtggcggcgctgggataaaagagagagcgcaaccctaggcggtggctgcgaccaagaggtttctggatgggcccaattgtggtaagtggccttttgaacgacagcgaaaagaatggcccaatgcttcgatgcaaccacaaaatgggccaaaagcccaaattctaccacgtacaaatgtgcccgcttgatgagttttggattatttttgggattttaaatgttctaatggtaagaacattttattcggtatttttgagtaaatttcaaaaaactacatatactttgacaaactattataaaactatagatttaaaaaggtgtatcacaaaactacagatttaggaccgaattcatcaaagaactacatatttaaggtggaagatcaccaaactataaatttagtaataaaattatcacaacagttcatgttttgcatcatgttaagtacaaaactacacatttatcactctaacatagcagtagtggtaggaatttaagctgtaaaatatgtagttttgtgatactctagtattaaatctatagttttgtgataaattttgtgttaaatatgtagttttataatacgacgccttaaatctgtacttttataatacttcgatcaaagtactgtagttttataaaatttactcgtaattttatttgtatgagcaatcataaaaagagatatgaccaacaaagaataatctcaaaatcaaaatcaaattatattattatagattttgattgcaatccaaatatttgagggacctaagagttgtatctcaaaatacaactcaactttttgaaatcttgctctacgaaaaaattacacgaaaatatccgctagttgtaattattgtagctcgagtacatttcaatcatattagcttaactagtcgcaagataaattttagattttctcgcattgccgccgctagttataacggcatttcattctagaaaccagactagaaaatcattacaatggagaaaaaccttagatgtggtgcatgacttcactcacaaggtctaaattctgatgttcataattatgcatgtgtggatacttaactgagattgtggatgtatcaacaggctttcatctctccagttgtatgttaaaaggatgtactcgtaggtatgtgcatgtgcagtgatgcatgtacgtgcatatatattccatataattgagatcacctcgatgctttcatgtgcatatgcatacttttggacaggggcagacccaggccacgggtcaatgcctaggatttggattgaaatctcactacgtagtacaaaattccatcatgtaagttcaatcttaacccaaagtgcaatgggctagcctaggccttgaccaaggctgggtcagcccctgcctttaaatcataatgtagagcctaaatattctttctcttacacggttcccacatagaaaaaaaaaacatgagcaagtaggagtgaatcgctgggcaaatctcctttggcagatagggatgggatcaaatggaagcatcagccatatccatatccaatccatccctctgccaatggagtagttgccctgcaatgcacatccacaggctcgatctcaaccattttcctcatcagaatgcctcagatagtagtagcaagtagtattacatattgtacatattgtgattgctcgagatcgtgttggtgtgatgatgagcgaaggggcgacggcggtggcagcatttatttgctgccggaaacggcatatccggcagcacaatgctttgctgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggtaggctgccatttgtgctgtgaacagttttgcagaatgcgatgccattgttctttcgcaccaaagaggaattgccacttgcgatctcaggatgcgatgctgcctatatatctgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacagtagcccctgagaccttcacagtcgaaaagataatcttctctcgaactagattactccaaagctgagtgcttcaatcatcttcgccatggtctccgaagtacttttaccaaatacgaagactgtggagggctgaaaaataaagtcaggtgtatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatgacatatgtggtataaaatccaagtaaataaactcataaaggatttaccaaccgcctgaaaaatgaccacaatatataatcagcctaagccataatattggtcaataaaaatgcacacttacgtggcgaaaagcaatgatattgtatctaatcaattgcttaaaaacccaaacaacaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccaagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattggcggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgaagatgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtagccggtcggtgacgacgtagacgcccaacaacggcggcataaaggccagccgtgcaggcggaaacaccagtcggcagcggcaaaggcaagccagtcggtgaagacgtagacgcccaacaacggcggcataaaggccagccgtgcaggcggaaacaccagtcggcggtggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcttgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatgaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgatggcaacgaaggtgagccaacggtgaggacgtagacatccaacaacggcggcataataggccagccgtgtaggcggaggcaccagtccgcggcgacggaggcaggccggcgatgaagtcgtagacgcccatgaacggtggtgtgaccaaccaaccgtataggcgaggacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggtggcataataggccagccgtgtaggcagaggcatcagtcggcggcgacggaggcaggccggcggtgaagtcgtagacgcccatgaacggtggtgtgaccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggtcgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacaatatctttgttatatttaactagaaaggtagcccgcgcattcgcgcgggcatgtatcgtaagctgcatttgagatactcgtaagtaataggctgattgtgttaaaatgtcgtatttgttgtatagtaaactataggcatatggatcttatatcgttggtttgattataaacagagcaatagttagattagaaatcagacgtgaaacttataattatagattatttatattttagttaaataggaacgtaagaggaatgaaaagtttagagcttgagccagagaggggaaggagcggctgtgtagtgatgggcgcgtgtggaggggattttttttttaatttttctaagtgattaagtgaaagccaattattagatgtaattttcctaagatttgcaagatttttttaaaatatgtgacatgccacttattaagatatatttttctaaaagtagattagatagttgaaaataatgttaataggtcatcgatctaggtgaaaaccgttag

SEQ ID NO: 1320 - DNA, 949 bp, Oryza sativa
aagcaccagtcggcggcggacaaggcggccggtcggtgaaaacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcaaaggcaagccagtcggtgaagacgtagacgcccaacaacggcggcataaaggccagccgtgcaggcggaaacaccagtcggcggtggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcttgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatgaccatcaagcaccgggagtcggcctaggcagggctgcagg

SEQ ID NO: 1321 - DNA, 601 bp, Oryza sativa
tccagcgtcgccgccacctcctccacgccggcctgccctccgtttcgcgaggtgacccccggagctgcgtttccgccgtcgcccatccatttcctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcaccttcctcctcgtcgacatctcctccggctgcccctttcgccatgcccgtgcatcagccgacgctgccgtcccctccctcggcatggtgacgtagccctccacctcgtccactcctcggtttcgccggaacgccatcgccgcgagcccctccatccgcctcgccggagttgttcggccgcccgtccctccacgccgtgcaccggtcggccacacccccatcatcttcggcatcgcagctgcgacgtcgtactcggcctcgcctcccctccgaccgaacaccgccggtgcccgtcgtcaccttcaccggtccctctcgcccggctcgtcgtttgcggcgccgcctccgtcat

SEQ ID NO: 1322 - DNA, 605 bp, Oryza sativa
tgtccacagccgaagcgtaacctgcgtcatcactccggccattatgcaagaagaagacaagtcactcgccttgtggtcactggagcaaacgccgtacctgtgaggcctcatgttaattctaacccatagtagaaacaatgtaccgatgttaagcaccttccctttttgtttaagacagtgccttgtattcatgtaatatgggagaaattggtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaaatcaagtgattaaccaaagagacatttgtttggactaagagttacagatgcgtccttttcggatcaaaggcaacgacagttagtatagcttttggcgaaacacttcaaggtttcacggaaaggcagcaagccaaaggacctcatcgtcaccagaagcatccacaactctcggagtgaagagtacttggttgacaaagtttaagaagtgattgatagaagataccagcaaagtgtttatta

SEQ ID NO: 1323 - DNA, 480 bp, Oryza sativa
taccttgttcaccctagattaaacaaaacctcaactagtggacactctattcatggttccactagtatgaacttaggtagatgcttcgctggttaattaggcaacattaggtggtttttacaactttagacttgggaaattctcatatcatttggacactatggaatggttggcttatgatggaattggacatacacctctcttcctctttcaaaacccctaaaacctgttttcggtggggtttgggtgcatgccagttgtgggaagtagcaccccggccactataaggattaaagctcgggcctctgttgcaaagcactactgtacttccacatgtctaatgggtaaggcttagtttgtggctcagtctagtcataaacaaaagtacacggatggagatggatgaagtcgggtgtcgatggacattctccagggcaaatgaaggctacacgagctgcggcccggtagtcgagatgtcat

SEQ ID NO: 1324 - DNA, 323 bp, Oryza sativa
aattttcccggtcgcgtcagccgccttcccctcctctcctcctgggccggccacccggccaaccctagccgcgcccccgcccgtgcagcgcgcgtgcgcgcgctgacgccgccgcctgaccggtgggtcccacgcgccaggccgggcgtcgtccccttcctcccgcccggccgtcctctctccctctcccgtgaaccctagctcgcttcctcctctaaatccgctcgattcaagcatgggattcccaaattgattagggggaattaatcccctttccctcctctctctttcccccttaattcccccttgaatggcgcccccaa

SEQ ID NO: 1325 - DNA, 801 bp, Oryza sativa
aaaaattcaaaatcccttatattgtgggacggagggagtactcagcatcatcggcccttgatttgctaaagggcaacttagagataaaaaagcactacaatggtaatttagtaattgtgtcagtcgtaacagcctctaactccttcctggttgtttgtgctacgccctaattaatttttagccggacacgaactggccactggacacaagccccaattcactaattctcatttccacttgttgcttgatcacatcgctatatatgttttcatccactatatcactgccacttacgtaggcttcatccactaaaccaaatctattttcttcttgcctctaatggttgatgtctaaaatttgacttttagtcattcttgtaaacccatttgtgcgaatgcaagatatatatttttctggggaaagcaagatatattctaattttaaccatgctttcttgcacagttacatatggcgttaactactaatcaattaccaatttattgtcatttacacaggttacgattaatggatgactgatcaattacatagctctatcagtatatgcaatcggccttctcttctacctctaaacgcatgtttgtttccctgtaatcgatgattggaacttcataatatgtccggggccatgcatccaccatacataactgctgtcacgtcctgataaattcatcccgaaataaaaatcattttccaaaaggaataatagaattaattaaaattcgaaaagaaattggcaaacactaaaatacgtacaagaaaaagtcaaatgtggcccggaga

SEQ ID NO: 1326 - DNA, 2095 bp, Oryza sativa
gttgatggaaaagaaaaccaattaaactgtgttgggttaaaaagccaatgagacagtagttggggaataggagtttggatacgccttttacagatcaagataaggattgttggatgaaacccataagggtacccgccatgcctctacattgataagttcggatatacctgcaaacagttaagaagatccaggagacatcaatatttgagaacataatagtcgatggttggtaattagtcgatcaggtatcagaaaagggtcaaaggtgatatggcagaagaacaatatggatgtccccatcccaaggaagcactaaaccctagtggcatagatacagatagcaagcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgtctgcatcgctcaaggaagacccctgatagtaattgcctcccccacaacagtcacctttcattaagtaagcaagatgacctaggtaaaagtgtttctatgaaggcaaggagtgaaatcttcaactcggtatcagatgctacacggagtgaaaagtgcaagcgcaggttaacaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaccaagtgatatgatcgaagatagtctacagaggtcagagtaaaatcacatctaacaacgaagcttcaaatttggccggataacgatcagacaataagaagtccagcagtaaaactatttgggaagacgtcaaagtatatcaagtgggataagttggttcccttgggaagcataattcaaaggcaaagtatcgacccttgcatcaaatagcagaagtagctatcacccggagaccaggaaagctaatatgaggcagttggtggcgagttagaagcaaatgacaagcatggtatcttagtaatgacgagctgatctcgacgcatgacatgaagtgggtaacttgtatgaggttgactccaaagatatgaactatgcaagttctggaactgaatccccatcttcaagtgccgcaacccagtcgaagtcagctaaaggttcaaccagggataagtcaggtgcaagaagattccatctgcaataggagatcgagccaagcatccatatgaagaattttatttatcaatttttttatacaaaactgatcggaagaagtcagacaagaagagaagaccgcccaacctatcttcttgctagcctcctcgaatctcggggacgagattcttgtaaggggggtggatttgtcacgtcctgataaattcatcccaaaattaaaattcattcgctaaaaggaataatagaattaattaaaattcgaaaaagaaattggcaaacactaaaatacgtgcaagaaaaattcaaatgtggcccggagaatttttgttaaattctccttggtctaaaaggagccctcaaattttactggaattttcagagcaccggaaataattattaagcaacaaaaacaattatcaaagtttatttaaaaaaagaaaacctaaaaataatctctcttcctcctttgggccaagcccagcccaaaaatctccctttcctccctctttttctctccctctccttctctccctccttctctggggctcccctttccctcggcccactccctcctccctctctctcccgggctgcctttcccccccctcttccctcccggcctgctcggcccaggccgctgtcacgtcctgataaattcatcccgaaaataaaaatcatcttctaaaaggaataatagaattaattaaaattcgaaaag

SEQ ID NO: 1327 - DNA, 2602 bp, Oryza sativa
cgctccgctcctcctcccgactcggcgacacctccctcggcatcgcggcatcgccgtcgacctcgtccgcgcctccgtttcgctcgccgaccgtcggagcaccgtcgtcatcgtcatcccgagccgcgccgccgtctccctccgctccggccgccgttctcgtcgtcgtagttgtcccggggtgagccgaggaccgtcgttcgccttcccccttccctcctctctctcgggcgccgctccgccgcgccgatggtcgccggcggtgaccatcggggcgcgggcgcgtcgctcccgtcggccgcgccggagaggccgccctcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtggggctgacgcgtgggccccactccccgtggacccggtccgcgcgtcccctccctcggctgacgcaataaatcggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgcttgttatatggagtttattagagtaaaagccttttcttttccgttggtcgtgtagacgctgcagcttcggaagatccgctcttcgtggaagtcgaagccgtcgtttgggaaagcaagcaaggcaagtcacatcatccttgaacatattgaatcccagtttataaaattatgttgatttaaattattgcattaccgctttatttaaattcccgcgttatcactgttttatttagccatgcctatttacctttgttatgaccttattattgttattgttatgattattaccttgttcaccctagagtaaacaaaacctcaactagtggacactctactcgtggtatccctagtttaaatttaggtagatgcttcgcaatttaataggacaacattagttggatttcataactttagacttgggaaattctcatatcatttggacaccatggaatggttggcttatgttggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggattggagatggatgaagtcgggcgtcgatggacattctccagggcaaatgaaggctacacgagctgcggcccggtagtcgagatgtcatacggcggagggttggtgcccaatgctaggggctcatttctacctgcctgtcccgggtatcccggccgtaggtaggattgggtcggtacttttgttcacggctaggatgggtgaagggttatgtcacatgtttacgatgggtttcaaggccatggaatgcggagtaaagatgtgttttgtgggtaaagatgtacacttctgatcagagtaaatctatttgaatagccgagccctcggatatgggcaagcctagcaatgtacccaagttagtggtttaattcttaaaatttgcttaacaactaaaatgtggaaaggttggcctgggttggcttgggacgagctgggacccaggtcgggttgccagttcggtccgaatcatcgtaggccttgggttaaggcaggttcgtgtgggtccacggccttgtttaataatactgtgtagctctaggatcgtctttataaaatagctttgggcaactaagtgacttttaaatgctgtttactgcaaaacttaacccctattattatccccttgtactcccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaattcctcttttttctccttcccccaatgctatttgcaaagggtttacccttttcttccttcttcaaatttcaactagtactaggtggtcagctttgcgaagaagaagatgtcgtcagttgtttgccgaagctccggaagactgcaggatccgctagcgaagcgaaggaagcagtg

SEQ ID NO: 1328 - DNA, 2166 bp, Oryza sativa
  unsure (1)..(2166): unsure at all n locations
ataaggtcagaagtcaggatagtggtacctcaagctcccgagtgaatgaagcaccagacaccagtcgtgtgacactggtccaacacctgattaaccagaaccgattgcttatagagatactacagtagcatcagacgccaatgctgaacctgaatcaaatacaacctcaagtgcagttggaggcagtccaagcactcaccccacaagtcagcatgccgccagcatcccgaaggacccatgatgacgtgccacctgttgacccaaaagaagcaagtaacatttgctttacgtgtgatgagcaagtgcactatgcaagggagcgtcctcagcagaaaagaaaaacaccaatgggaaccgaagatgaagtccgtaagatgatcattaccagcacagaatggcctccaccaggaatgacaagacgtcagagaagaaataccttccgaggtgcaccacagttgacagagcatcttttagctaatggaggtagagtatctgatagtgcagattcagatcaagtctcgtcagatgatgaagatgaaatggaacgtaaggcatgctctcgttgtggagaaatcggtcatgtcgccagctcgtgtgccactatatgcgttcattgcgaggaaggccatccacccgacaggtgtccaacgagcaggatcacttgtttcttttgtgaaggaactgatcatgtaccaaaagattgtcaattcagttttctgccgacgaagaagatggccaaccaacccgccagttccaacggagagaagcatcaaggcaacaccaatcctcgccaagattacagtttcagcctaactccagtgtcaggacagaggaatcaaatgagaaaagaaaatgccgagtccgggaagatatctgttgcttcaattgtcaaggaatgggtcatttcgccgacaagtgcccaaaaccgagaaacatagctgccggcatgtcagtccacgcaaccccctgcaatcagaagcttgctcctcaacgaattgtcatccatgcatccagaagcagtcctatagcccgcgttgcaacagctccaattccaatgaatgcactaccacaaggtgtcaatgctcaatttcagccccagccaccagctgacaagacagaggtcagtatctgtgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcggcctccacattttcgccaatttacaggaagcaaccatgccaatcaccaagtagtcagtggagcaaatgcagtacctgttaagcctagtgctagtcagaagcaaccataatactcttgtatcggtgttcaagtacttttgttttatagctgttccccgtcaatcatgtaataacagagaaacatgagataatgcgtgagattggcaagtttatgtagggtccatattaagattgcaagtgttgtgtgatgggtacatttggttgatgattaaggaganttagggtttcattttcgtaagctcatagtgtattatgaatcaagtaattaagggattgatggggaagaaaatcaagtgatcaataaaagagatatttgtttggattaagagtatgacatgtgtcttattcggattaaaggtaggtatttgttgtggaaaaattggatatgttgatagtatgtgtcttattaggtagtcagctctaatagtaaaattgttatgttaggaatttgtattcaaaattgtaaaagnttatatgtgtgtgaatcttcgtgtaggaattagttgagggatataataagaaattgataatagagtataaatattagtctaattaataagcgaatagaatgtcattacagaggtagatagttcctttcaatcaataaagttgtaagtaggggaaaataaataaatggcgcagagggttccattccacaggcagtttgaccaaggatacacttaatctccacaccttcagcctcattgtagaattcttcttatgatgaatgattgcaaggtgagtatatgacatactcagcaagccacgcagcaaatatgcaagtgcacaggataccaaaggatggcataatagggtttcatctgcaaaagca

SEQ ID NO: 1329 - DNA, 505 bp, Oryza sativa
tgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacacacataaaaagaaagcacagggttctttaggttataacaaacattaggagacttgaacgggtcgattcagagttcgtatgaccaacatatgatcatccgaagtttaatgctgttatatggagatttgcaaattattataattaaactttgcaattataaaacatgtgtaaacgctagcctgtaaaagacaggaaggctgcgccgttgacatgcggaccccacatgtcaacctaaaggaccacggtagaccgggtacacagagacggtccacgggccacggaagcggaccccgtgtgtcaaccgaggcgagtggccgataaacggactccactagacaccac

SEQ ID NO: 1330 - DNA, 18809 bp, Oryza sativa
  unsure (1)..(18809): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatatcatatttgtcacaaaaagcatacacatcaccaagtaaattttcccacccatctcttctcaaatcatccaaatggcacctagttgatttgacacacttaacagcattcacaatatcttgatctttcctttgcaacgctaatgacagggtgttagtgataattaatatagttgacataagatgcaaatagaagacaaactcaaaagattggaaatacactagaagaccatttgcttgatctctatttgttctatctttgtcatctttttccacaaattctagcactttgactattgttgggaacatgtcaagcaaacttttgagagttttgtagtgagaactccaacgagtatctcctggtctttgaaggcattgctcttgatttaacccagttccagtttgaagcatcccacaacctaatgccttgcatatttgttcataatttatttctctaatcatgtctcttctcttagatgatccacccaccacattcaacaaagtagatatcatagtaaagaaattactaatgcctttatgtttttctcacaatggctacaacaactaattgaagttggtgagcaaaacagtgaacataataagctgaactactttccctcatgatcaatgattttaatccattgaactcacctcgcatattgctagcaccgtcatatccttggcctctaacttgcttcaaactgagcttaaagcctgcaaatagagaatcaatcgcagccttgagataggaagaagttgtttccttcacatgaacaacctcaataaatctctctttcacaaatccacacttatcaacatatctcaacaccactgccatttgttccttgtaggacacatctctagactcatcaactagcaaacaaaacacatcatgcccaagttcttccatgatagaatgtaatatttccttcgcaaaacactcaacaatgtccttctgaatatcagaagatgtcataagactattccctgctccatatttacccactgccttccctaaagcatgatcatgctctaatagcatatcatgaaactccaagaagttccctttgttgtaggaatccttggactcatcatagcctcggaaaggtaatccttgcttcaataaccttctagcaacactaattgaaccatttaaacgagtaaaataagcctttttagcatcttcactttgaatctgaaaagcaacattaatatgttgagatgtttgtaacaaagcatcacaatttttcattgcttgattatgtaaactaccaactccaccgacatgctctttcagcctgctttttctatgccaaccattccaaccttctgtaacaaatgctttgtatccatcctccttcttattgcagtctctaaataagaaaaaaaagaacaatatgctttgtctttggcctcactatattcaagccagccaccaaactcatcaaaccattccgggataaagcttctatttctgtctgatatctttgtagttggaaaattgagtgtacgaggttggcaaggaccattctctaggtactttcttcttaccctatctctcaggttaggatgataagcatcaatcggtttcctcaatccaggatcatatttgatctcctctttccaattgagatcatttacttctggacaggaagtccttgcattgttgctgctatcaggcacttttcttttaaggtaattctccataataaagttcacctatcattcatagcactagaaattataatatataactttaattttactccaaatcaccaaatgaccaaaccctaaccatttaaccaatataatacgaagaatcgggcaatcagccaagtaatgaagtaacctgaacatatctttcaaatataaaagtttacttacagcaaatcaaattaatcttaaagaatttgagacttgagagcacagtggaggtagaggtcttaccttgcctattgttgcgttgccctattgtgagcaggggcttgattgcttgaattaatctccagatgtagtggcatgtggccggcgaggcggcggcggcggcgacgacgacggcaacggcaacggcctcgaccaccgtcgaggtcggcggcggcttcggttctgggaagtagggtggctgaggcagaggctcgccgtggagatggacgatgtggtcgtcgtcttcggcggggggatcggcgttgaggtcacgcaaggacggcggagctggatgcctggatccatggcgcggcgcgagttgttgatcgagcacctgcgcgcaggtggatgcaggggcgagaggttggaggaggtgggacgacagaaattcaaatatataggtgcgccatatgggcttcttcctcgtgtcggagtcggagtcggagtccgtattccatggggtcattgaactatttggcatttaactatttgccacccctatctcaatgacatgtgggtctacatgtatctatgacatgtgggtccaatggcaaatcgttaattaccacatctaaaagtgacaaatagttaaatatctcgtattaatatcatggcgagttgttgatcgattgagcatgagagggtgggtggggctaacgcgcgggtgatcgcatcgcatctccgtgtcccccgggccccggctatgtgggtagattgattttgaaaataaagttgggaatatatttttttaaaaaaaactacaaataagggaaaattaattctttctaaaaatatacattattcgtataaattttacccatataaaaaatatatatgcagaatcttctgatatagctccattctgaatatataacatttgaatccgaatcagaattcaaatttaaattgggcatataaatttttagagcataaacttttggtatataaatttaggagtactcttgacaggctataccgtcgagtatggggatagttggtggtaaggtatggacgagattgtggtaaaagagacgacggaagatcgtgatttttatacacgttcaagccctctaattacaggttttctgtctataaatgtcttaccaaatccatatttttggattatatttttctaaaactagaatgcccctttcatatttatgtgccaacttattgagaaacacagttctcatgtgaaaaattcattcataaaaaactaaatagaatcatttggaaaaaaataaaaactaaaattttaaaaaaatttcaaatcatttttttgaattcatacaacattttcaccaaaattcgagaacaggtaaaaataattttagttttaaaattctcagtgaaacttttgtatgaattttatcaatttttaaaatttgttaaaatatttttttcttttcaaatttgtggtcaaataatattttcctttgattttattataactaaaaatttcacattcagatatactccaccgtttcatattatataatgttttgacttttttatagcaaacttcattgagtttaaccatatttatagaaaacataataatatatataatatcaaattaatttttatacattgaatattatttctctaaaaataatgatatgttttttataagtttgaccaaaattaaagaagtttgacttataaaaagataaacatcttacattaatataaaacggatggggtgtattcttaagtaggtagcgcataagaaattcagaataggagaagaacaatatagttattttaaaattttgtagcagtcaacaactgatggaaagaaattcaaaggcatatagccaccggacaaaactttatttttaactaggaagatagcccgcgcattcgcgcgggcatgtgcattagtttgttccgaaaatagttctaaaaaataaaaaattaaagtaatgtattttctactgttaattgattatttattatatctctttttcgtgaagaaatctcgacaaactttcattggtttgaaatatatttttttaccattctgctagccctctctttaattgcttcatatacatgcaatttttatgcatgtgaatcaataaagatagaaaatttcttttaaaaaatatttattgtattttgaatttagtgattgagggattcttaattcgactttgtattcaaatcaaattactttattctaaattgtctttttagggattttaaattgcacttaatctcgtatcgtgggggcttttaactatttgccattcttacgagtggtgcttaacgatttgccattaggcccacatgtcatagacacatgagggcccacatgtcattgacagggtatggcaaatcgttaattgccatgtcacaagagtggcaaatagttaaatttccccgtatcgtgctgtatttgatctcttcttttaatacttattttattattccaaattttagatatttataacttatacttttatagtgactcttgatattttatattctacatggaatcttgttatatttttttatagttttagtgtttttttaatttttgtttgtgtattttaatcaaattgtttgttttatatttttgttctgaatttaattacaaactccttgtggtgatccgcctgtcaccatcagcctcgcggatcattgttgacctcctcatcagtgagcctctcttgatacattagacaggacgtggcggggctcggtggcaaagatgaagctattttctagtccttgtcgaagacatggaacgtctccctctgcccctcccccccccctcctcttagtccttgcccttcatctaatcatttagtgcgttattaggtccaggaacttgtagaagtcgatgatgccgctaccgtcagtatccacctcgctaataatgtcttgtagctccgccttcatcgggttcatgcccagagtttgcattctggttccaagcttcttggtggtgattgaacttggatttagacccacacatttgaattcattcatcattttcgaagtgctattttgctcaaatatttgtagtcagaatagcagcattatctaacttctatatagtaaatatgggcaatatggatcttgaatttaattataaataatacaaaaagtcaaataaactgtgaaaagtacatgtaacttgagagtcatgatcatttagctattattatttttctatatattatgtgttaggtagaaaataggataagttatattaaaaataggatatgagaattggatcctagagatgagtaggacggtggaggtacgtacgtacatgcatgctcacatacggtaggggtggaggtgggggtaccggatttatttttgtgagatgtagcagttataattattggatctacctatttaaaggaaaatcaatggtttgatttttttatcataatttctaggaacttttaatttatttgagcactatatggtgtcttatgagtggttttagaaaaccatgtgacagtttaagaggatctgtagggagtttaatgattttttagtatataatagatagttaatatagcattttttggttctttatgtactgaactgctcactagaaaatatggataagaaagtgagcaggagagataataggagatcatttacgatggcatgatatatgttactatttagttgcgataaaggggtttatgtcaaatgatatgtttcttatatatgtacataccaaaatatggtaaacatagttcaaattaaaatcgaatatattataagatattctaattatttagttgttgtgttttttatatataaaattttgctaccataaatggaatgaagaagagaggggcggggagacatacgtactttggatgtaggtacatgttaggagatgagggacctagggagaggtgtggacgtacgtgacatttgtttttttacatatatagatctaatggtgtgtaaagagaaaataaatggtacgatgttttctttttttttctggaatttcttagatttctctaatttatcagagcgtcacgtggcggctcagaagcgtttgtaggagccacatggtggcttaagagtgtttttaaaaagtttaatggacttactcgtacgatgtctatttgtagggatttttttcataaggatagaaaaagaagaaagaaacaaagataaaaaaaaaagaagggaagatagggagcgtacaatacgcatcctgcacggaggtagggacggcaggagtttttttttccgttaaagataatctaatgatccaaaataatgagcccatctatttaagtgaaaatcgatggtcagatttctctattttattacatgccccgggactcgnagtattttaggatgccacgtggcggtttgagagtgtttgtaggaagtttaatggtcttttagtatataatagatagataccaacgagacaaaactcaaagatatgaataaaatagatagagtgaaactcatgaacatatgaccaatatatgacaaacattcctagtctcctagccaataacttgtcaacatcttttggtactgttcaacaggcatgtttcgttttcgtgtatggagaaatctagccgcgtcgtggcaccaaagctatctatcatgcatggttattgtgccatggttgccagcatgcaattgcatagacataacttgcctttgctcctcaacctccggctcaatgcttgctttccctttcttcttacctatcctaagttcgtcagcaaatctaatcttctttcactctaagcaactgaacagcgcttttactttttctgataaatatatttaattttgataacatttaatttctcttaatctagagacggtacagtacagaaacacacaacacatatatacgtgtatataaagtacatccacgcaaaagaagaaaagcaagaaaaaaaaaccacaaaatatatacatgtgagcacgtactccattgatctcttttttagatcttttacataaacacttgaatagtatacgtacttgacatcatgcaaccaaacgtatatttatacgagtacacgtacacaggacacacggatatatactgattaagacatgtaattaatcgattaattaattcttaattcataccaagcgtccattgcccattattgcaagcttaccctgctcacggaagatgaacagatgatgatgatctaggccagctacggcgcgccgccgcccaccgtcgccgtcttcttctccttctccggcgcgtccgcgtctacggcgacgtgcccccggctgctcggcccggacggcgggatgcgccatgaccgccagtcgaggtcgtcgtcgccgtcatccccgccgccgccgccgccgccgtgctccttcctccccggccgatggcgaagcacgcggcgccacggcacctccgccgccgccgacgccatggcatgccggcgctgatcatctgctgctccttcctctgcgctcgcctgcaggaaggctaggccggcggcggccatggccgccatggccagaatgagagctaagagcttcttcgagctcatcatcgcttgcatattggagtagtatatattaatataggcaataaatatattcccactactaaactatagctagttaactatatgaaatatgatcgatcttaagtttatatttgaccctagaggttttcaaatgtggcgatagattgcattgatcgagaaatgggggcatatatatatacacacacacactgacacacaaaagaagagagcaataaaaatgcaattaggagagagagagagatgtttaattggtacgtgaaggcagagctaatatgtgtgtgtgctggtagttagaaggtaataattaaattgctggtgaatcaagggaagaagaaattaaagagagaggagtggttacacgtggttccttgctttcggtcaataaagcgatgagtttcttgcaagttggcatgtacatacatataaaacatacgcatgcatgcatatatatgacatagatcgatccggccggtcgatcgatcatttcgtctctttcgcatcgtatcttggaattatgttagcttgtttaattccttctctatgtggaggaagccacttttgatttgatactgttctctagctagcgagaaaataattggaaaaaaattggaaatagagccgatttgtgcaccgcgcaattaagaaaaaagaaatagcgaatgactctttgttgatcttcatacaattggtatcaaaagaacaagttttttttaattacacgacagacttacacgcacacacgccactacacgtgcaacaccattttcacaccctcgcgaatgcgtcccctagcacatgctctaagcgatggaaaccagcggcacatactgatctcactaaagttctgttgaaaaccaacttgcatatgcgtaatttttgtgagcaccaggatttgaaccatagtgggtagagttacgcacccacgactctaccaccacaccactggtgcttccccagaagaacaagtaatttattcgtgagagtggtagcatttatttggcaatgaacaaattaaatgtgcaaaatatccaaaagaataaatttatctttccttgccatgcacgaatcttagcgtggatagcatggccagagtgaaccttagacaacatccgacgactaaaaaattgcacgattttagcaattgaatttctgtcaaggtaacaattctgtggatttagttgttgtcccagtggtacaaaggcatatgtttgttttccccgtgtgtgtgcatggggagaaattcgaacgagaccctttttccccctaaatggaaatagtgataattcgaacaaattaaccttgcttctctgctactgtaacatgtacaatattcaacgcacgtgaagagaagtaaattagtcggtgctctttaaactcgttgtgaagattatggataccccatacccacatgacatgtatatctgactgggtataggggtactatatgtagatagaatatctttaaaggacttggattaatttcctaacttgtgtatcaaggaaatatccgagaatcttagtcggttacgattgtaatttatctttatccgtctattccgttaggaatatgggatgtatcttgtaatacggactcctccccctatataaggaggggttcggatgcctcttggggcataactttttctcccagatcatacgatcaataatacactcggcggatcaatccccggacaggagtagggtattacttctcattgagaggccctgaacctgtataaatctcttgtcttcaaacccatccatttttcctgcttgatagccatccttttttattgccgaaatcttgtttcgacactcgtcatctacatacacagcctaatgctttgctgtaaagattgcaaaggtacaacatttgaagaaattaaagtccaattaagctagacattgccttttgcctccctgtaagaacgaaaacagcttgcttacgttaaaaccggccactaattcgggctagttgtcgtttgtgcgcttgaattgtaccatgagtccatgagcacggccatcactcatcaacatttgctttatctacgaataaagcaaggttaggagttgggaatgcatgggccggtcagcaaattaatttgggttatgacattatttaggcccattttgcaccaggcccactctatccttgccaactttatgttaagctcctagggcttgatcatacgtggtttaaatcatcaccgtgctgccaaaaacccaaaagaaaagtcggagattttattattgagtgaatacgcagacagcatccgtaagtaagggggtgtttagatcacatcccaaaattttacgccctgtcatatcgaacgtttaaacacctacatgaagtattaaatataggctaaaaaataaccaattgcacagattgcgactaatttgcgagacaattcttttaagcctaattgctccatgatttggcaatgtggtgctacagtaaacatttgctaataacggattaattaggcttaataaattcatctcgcagtttactggcggattttgtaatttgttgttattagactacgtttaatatttcaaatgtgtgtccatatatctgatgtgacacggcaaaaattttcacccctagatttaaacacagcctaatatagaatcaaattagatacgtttcacgtttcagtactatgaatttgaacatatcacatgctcatatcaaaatttataatattaaaatatgtctaatctgatgttaagtaattatattttacgacggaggaagaactagtagctaaataaaaagagagataacggtgtgtttagtttagaaatttagttcgaaagtttaaatttcttatttaaaaaaaaacacttgtaccaatgaatactgatgagtattttttttttctttttacaaaatgttactatagattagaatgtgtgacccgtgataatcccatgttcgattagctgaaaaagtagaacccaatctagcactctctctattttaggttagaagacgttttaattttagctaaagtcaaactgtttttttaagtttgaccaagcttttgaacaaaataataacatttttaatccaagttaaatttactatgaatatattcaattattgatttgatgaaactaattaaatattataagtgatactatgtttgtttatagatttagttaaacttaaaacaaatcaaaaactcatcctgacgcatctctgaacacaagatgacgcattgtgccaaaagacacgctcgtgtagcagcgcagcatcgatcagcagcgtccagtgccatcactgcctgctaccacctgctgcctgcatttaatcaccgaccttacaccagcagcagtccaccaccccgccgcttccccgcaaaaacaaaaaaaaaaagaaaaggagagaaaaaaactcctttccgccaccctccccttcccctctctctctctctctctctctcacgcagccgaatcgcgaggagagattccatttccccaccatggcctccctcctcctcctcctcctcctcgtgctctccctcgccgccgtccacaccgacgcggccgcgttcccgtcgccggcaggtgcccgcccaacccagccaccttcttctcccgccgcgccgcggtttgtttgggggtggcggcggcgtgcaatgggcggggatatattcgatcctgacattgtttttgtgggggggattttctgcagatagcatcgtgaggcagctgtcgtcggtggtgaaatggccgcgggttccttcgtcgtcgtcgtcgtcgtcgcacgggcacaagcagccctcgcacccgcagtacggtgagcgccatagctgccgacttggtttgctagttgctactgttccagggtttatttactagtagtagtagtcagcagcgcaagttcgattagttggcggagtggtgatttgacgatttattaggttatttttgcttgtttctggctttctgcagttcggacgacttaccttgtgattactgattagcaagtgtgttagtatcagtatgttgggtggtgtctcttgtgaggaagtgagtttaaccagagtattcttaagatgaccaagctcaccaaacatacccagtgttttgtattatattgtctatgcttgcatttttgtttacttgagttcaaatgccactctgtgcgtgtgacctaagcaaaacaatgtttactgcctatgttcaatttcatgcatcctcacatcactaaagtgaacttaggggcttccagatctagcagagtgcatcattttatttagtgaatgtgtttgtggacagcacgtgttttttcattatcattattttgtgtccttgtatgctgatggtgtttctctgatgcggcagatgggggtgtggctctgcagtttgagagcggctactttgtggagacgctcgtggaaggggacaagcttggcgtcacgccacacaccattagggtgtcccctgttgagggtggagagctccttgcagtggactcggcacatagcaacattgtgcgaataactccgccactgtccgagtgtatgttttcttcttgccatcctcagctcagcgcttccttggttattttaaatatgaatgtaatatatgacatggaacattttttggtgtgtcatccagcggactgtttttaggagtgatcagagtttgttccttctttccccaaaggcatgaaactttaaaattagctttgttaaacatatcagtggctaataagcatatatgcaaatatttttttttcattttcttcttatgtagctctaatgaatttatataccaatttttaaataattgatatttccatgaaaataatgtcatctatttcgaagatttaggaataccttctttttactgaatttaggaatccatgcataaaatcggttttcaggtagtgagagatggagagagaacttcacatttgtttgtgctcaggggaatatcatctagtactagtagtgtagatactagatactgggactgatattacaacctctgcagatagcagaggaagactggttgctggttctttccaggggcattctggccatatagatggcaaaccaagtgatgcacgattcaaacgccccacaggcgttgccgtggatgatacaggaaatgtctatgttgctgatacagcaaacttagcaattcggaagattggggaatcaggtgtgctacaatttaatgttacatctgttctcaaagcagctgtgacttttgacctaatacaaactcttacctctgtttgcaatatatatgtaaatacctacatgtacagtattattattgtactttgtatgcaaatatgaaagttcattttcattttacctaattaattatttaaatttattattggtcgatgtttgaactgtgaaagccaaatgtgacagctatttagaaacagaaggatgacatatgtattttatgcattatttctgtgttagtactaggcgaatgaagtgaatgaactttctgtgcaggagtgaccaccattgctggtggaaaatcaaacatcccaggttatagggatggtccaagtgaagatgcaaagttctctactgattttgatgtggtatatgtgaagaaaatgtgctctttgctggttattgaccgtggaaatgctgcacttaggaaaattgcccttccgcaagaagattgtacctaccaggatgcaactcttctatcgtcaggtccattctcctatttttactttttatgtttgtaatctttacatctagatgtttttgcttgttgtcctatccgtcatgttctttagaacattaagaaaatgttgtttatgttagagagagagagaggagttagctggctgaatatttgaggcagttttgaacaagaaaagggtttccgggccttattttaagttttgtgctaattctgtttggtggtgctatccttgaatttttatggatgattaattgatcaccacacagttttcttctttacatcaagtgtggctcactcgaccgctttggtcccaatacatgcgttctgatttttttattattattttaaagttgtgatgtgaaatgatatctgaattggaagttggtaaaattgctagatgttttttacttcatgtatccctgtatttataattctatggtagcatactgatttgtcaagttgaaccagaagtaatattattagtgccatatcagtaatgtagatctagcacgcgccataagaaaacatagtctgtagcagatcttttgaacatacggatcgctataaatgaatttgttgattgaatacaagtgtagtatagaccatgactttctcaaccatttataacgagatatgccatcctggaactggcataatagtatcaaataaattgtggatgggcatgctatggccagtgatttgcagctttcttagtgagccatctgtaattttatatcatattttgggcctcttcctctatttagacttttggagtttgcatgataaatcttgtttagaaagctgagttacttgagtaaatgactagttttttttcataatccctaagagactctttttttctagaggtaataatgcagttggtgttgtgtttgtgtttctggctgaatcatttatatttctacactaacttatcttaaattatgactgtatgacaccagagctgtagggatttacaattattttcatgttcatttacctgttgaacatgttagtttttatcattagttcacttcttgctgcagtttatgtaccatttttcaaaagaaaaagaacatgtctagacttgatcactgattttgtttattttcacagatatcatattggtcattggtgctgttgttgccggatatattttctctgttgtgcaacatggatttgggtcatcaactgctgaaaaggtagtgttttctgtttgttacattttgggattcggttgtctttttatatgctggattttggctttcagttggtccttttcacttgcattttgcagtatcagtattcttgaagctttgttatgaagaattcttagtcactttaaactattatcaggttcttgctttcagttacaatggactgaagcagagaatccccagtatttgtttcatgaatttgaacccactatttacatagtagtttgtgtggatgccattgcagatcgaagcacctgaagatgagcatcaggagagcagcaccgtgggaaagccacctttggttgtggagagcctgaaagaggagccaagtgctgggtggccttctcttgggactcttattggtgatctactgaaacttgttattgaaggggtggggaatcagcttctcaggctcgtcccatcacgcctgcaacatgggaagagaaaaacagacctcactccactcaaagacaggcttgtgatgcctgaagacacagaggagaccccagtagcccagaagttaagtagcactccaatgagacccgagacactccatggtcctaacccagtaaacgaaacagcaccgaaggcccagaagagtgtcaaatcatccaaatttagggattctacgctgtcaagcaagcacaggtcctccaagaggcaggaatacgcggagttctacggttcatccgaaacacctcaagtgagctcaaaggtcccaaaagatcggctacgccaccgccaccgggagaagagtggggaagctgtttatgggactagtcatccggagcccaagcctgcggaagtgaagcccgcagactacagtgacccaaagtatgatccctacaacatcagaagcaaatatggtgctgacagcggctacaggtactgatgccccgttcctgccatcgttcggcatctatctacccccagtgtactgatatcaacttccattagtcgttgtgcaaaagcacaaagctgctgccggtgcttatgggtcattttctcaccagttgtaaccacccataagatgagatgcggcagatggtcattctagttaggtggtgatcctatatcaatttggcatccggaatccctctatgcggttcaggggaaagccaaaatgtaatttcgcgcagaaagcaacccgtagcctggtagtaattttgatctgctcaatacctttcatgttgcatgcttgagctctggtcttgccatgttatgttacagcctgtggtgcatgggccatctgtcatgacaggcaagtccaatgtcaaaccagctgaaatgcagctcctatcctagttctccttgagctgtcaatgaaagtgaggtctcattcttctctctttacactgctggtcctaccctgcaaaaccaagatgctgactggacagtcctggaaggatttgcatctgtgtgcgtgttgtcaattctgaattattcagattttctgactccatgggcggcctaacttttgatgatatgtgatcctgccatgtgagggagaatacgaggcgtctccgcgtgacaaagtgtggtttcttttgaaggattctgacgtgtgagcagcagcaacagcagtcaacaggaagctggggtccaaacaaaaacaaaagctggccgtttttcggcgacatggccaatgcatcatctattagcagctaatctgaacaaactttcttcctgtaataatctaatcgttggagatataatcaaagagaagaaggaaaagataattgtatgggcctgaattgtatgtagctgtctgccactcttgggaagctagcagccgaagcggtggtggtcctggccatgaactggactgcatatgtaggactactactacgactgaacaagatctggatagattaagtgataacatggcagcaatccacattgttgggcggcacgtcttgtggtctccggcgcctctttttcggaagaaaattgaggagggaactgccattttgctttgcctgaaaggtgcaaaggcactcgcatgatgagatgagaaaataccttgggatttggggactcactcaccgtcctactactgtactgttgtctgttgacttcatcttcggagctcatggttgtgacccccccccccccccggggtcacatgtgaaatccaataatttaacaacctgatggatggacatttggatggatattgctcatcctttatctcagactatgacctgttcgttttcggttttgaacaaaatgtccaaatttagctatagtcgtttttgtagttgtgtgggcgtgtgtccaacaggcggctaagctaattacttgactaacattactctctccggttttgaacaagttgagaaaaccgttgatgaacatccctatccaaaaccacagccgccttttcttctcgacacaacgggcaagtatttgtttttttttcctcctgctcgtaagagcatcactgacagtaccaattgagttttagactaggtaagccatagacttatctgtatatgactttgctttattcttgctctgaattttgttttatttctccataagttttaggatatcacaagaaataaaacaaagtaaaatttttaagaggctaggactctttcttattcccccccccccccccccacataaaattgagccagaggaatgtaatccatagttattttctttctttcctataaaccaaagggatttaggggggaaatgtcaaaataaaattgaatcgttctgaagttctttgccgatccttcgtacaaagggaacctaaggtcagcaacatagctagatctaagacaggatgtgtcatatcctaaaactactaatctagaaggtgcacatatattgggatggagggagtacatattaagcttcctctgaatgcagtaattttacaacatttccatgtaattagtttaacttcccagaaaatcatccgaacttatcaacttcaaataaatgacaaatgcatgtgacatgcatagtagcatggaaacttatcgtatgcacacttacttcggatacattacatcatgcacaataactaacaaatattacgatttcttttttggaaaatttacatgtactttcaatattatgatgttaaaatttattattatttagcctaaaagaataaaaaatgtcagttttaatagtatataaatatgctagaatttttctctcactccctctatgtatgatggatttaacaatgagtctttagagtagtatgcaatattattggaagttcatatacaaattcttttagaatatttgtgacaagttctcttgagccacttcatcggatcattgttgcggattatttgttctacgtatcttgaaatatgttttttatcttgaaaatatgatttttcataaaaaaatacttctactgcattgctcatatcccttttctaagatatttgttaagtttattaacaaaatatttaatttacatctgtaatcatatggataattcagtacaatagtcttcgcaatttttctccaagagtacattaccaattattagctaggtttattcagaccaacgaaattaaatcatgtttatatgatagaggagcagattcgggatatcccacaattatcaaagcttgaaattatgtgttttaaactgaccctaccaggttatcagctggactctagaatctactgtgagctctctggtcttgggtgcttttattaggtcaataagtggttggtggtaactggtaattaagcttctaattaagcatgtgccagccatacctggatgcaccccaggattggggttagaccagactgggaaaggaaaacaatagcagaaatcagtctgatggtttcacaccacacatgatacatactccctccgtcccataaaaaactaattaatatgacatatcttagttatatgaatctggacatatctctatccagatttattgtactagaatatattacattcagttttagatttgtttttttgaatggaaagagtagacatactcctatatatcatcgtgtaacaaaacgatcagcaacaagttgcgtgtagaaatacggtagaatttag

SEQ ID NO: 1331 - DNA, 10841 bp, Oryza sativa
  unsure (1)..(10841): unsure at all n locations
taggatttttgcttatgtggcaatgtatttaatgctatgaacactaaatggcatggagggctggggatagccttaactaccctaaatgcatagatacaataatgcttcacgttaaacgaagggacaagagttatatgatgatcaatttgaaatttgtagtttttggttatatgatgatcaatatggaatgagagagtaggttagttataatgttctttatttttttctcctctctctcatttatctatttaatacatttatcttgtatcatttgtaaatgtggctcttgcataagagccaacactcctcatttttcttatatcactgttctccacataagcttatagttttaccccattattccatctaaacttatagttggcttatacctcgttattacctttgctctaatatgaaccatggctcaacatccgatggtgctgttttttttttgcaaatggtttttcgaaaactatatatagtgggaaaacataaaaatggaatccaagtacaacttcttttacatattgttgcttttttgggggatgggaggggggaggggggatgtgttcatattacaggagacattgatttacattcgtcgacaagtaagatcttgactatggtatttgaggatgtagggcatggatggtataagtatatatgattgatacagtaatgagatacatacatggaattnatatataggtttggacctccaatatgggtggtaggcctaattgtgttgtctgtattgattgaaagtatcacaacaaagtatagtacatgaggtggatccataatctggtctacacaagtaatctcggcgaaaatgtgaaggcagtgtagttggcgttagttatggctccttctgaaagttgaactagtgtgcagattgtggcttgcaaatgtccatggcttgagataagatttgatgtccttccctcctaggaaaccttgtatttgtatcaaatcttgcccctaagaggccctgtacttatatcagagtatgacctctcttctaagtaaaactcggcatccaataaggtaccggcagagtatgtattccttatcattcccgattccgactacatgtcccttcttaatagaagggattgctttattgtcctatctaaatatacatgtttgaagatatctttccatatatgattggctatgcatattcctagctaggtaagtacatatgtatagggtatcacatatatactaaattgatagtagtcttgaacctaatttaaaatgtaaaccacacaaagtcaagttatcaacacatataacctaagcaaatttttgtttaactaggaagaggttgatcaccttaatcctttcatccgggtggtgtatatgcatgattagattataaaatttggatagatttcaaatcactcaaccgtcaaactatgcatagtaaaatttatctggaatgtcacccactttccttgaaatacgaaccgctctagactgtaaaacaagatctacttggcatccaactcatttttagaaatgtctcattgttccttttctctgcccaaaaagatatccttgcacgccatgttcttcagcgtctaccataagtttgtcgcccttcttagagccaacaccttgggccacaaagtaggtggtaggaagccaaatcttgaacttgacatgttgttgttctttattcgttcatcttatgtggattcatgcctcctctttttgagatcttggctcaaaatatgtcaaggaaatgtttggtttggagacttatcaaactttggttattcttcaaagaatgaagattatttggtagggtagtgatggttggcacatgttttgtttgttgccttatcaaaattttgcatcaaaatttggtaatatgattttggcaataaatcaaataggccttaaattatacttatttatgttcacataattttcttagttgttggactataatgaaaaaaataataatatcaacaatttaaatgcttcaagggagttgaatgggggcacatgccctcttcacctaaaaatatatgaaatatttgaaatatttaatatgcactaagttgttgctatgtaatattttaaattaaattaactaacttttggtgtgtgtgctctttgagttcagattttcgatccacctatacccaccttgtatagtcactttggtaaaagaaattatgttctttcatttgtaaaagaaatgtcataattttataaagaattttgttatttgttagttgcttgattttatattatttgtaagtccactaagcttacacaatatatatactcacgtgggaacatgtcgatatgatgcaaagcatcgggagttggcgctttgattatcattaattagaccgttaccattgctacttggagggatattatgatatcagactaccttgcatgccttaaaaagatatcaattttatcatgactacagaatagctagttttgtcgactcatatttggagatgcggctgccaggttctagaactacttaccattttgcacacccctttttctcaagtaacaaagcattatcaaggaaggtagaatccaaaagattaaactctcataattttacaatgtgatataggtgatccaggccttagtgacaaggtctgttgacacataccttgaccgcccatcgagggtacatactaagccactatggtacctcacatgaaatgactcaattggtttggatacgttgtattacatcgaatacaccgaccatggagtcgggctaatatgagcggccgagtgaaatgtctagctaccatgggataatctacaactagctggaaagtttaccgtcgatggcaatatctagctcccaatgtctattcgtcgctagttagtaatactagtcattaacctgtattgcacttgcagggcatgtagcaataaactttagatttctctcctgtctcgagtgcaagctaaggaaaataatgttggaactagggcgcgataaatttttatcctttattaaataacagatgatggtacgagttgtgagagcatgtatactcggtttatcatcaaatcatacccctaaggatcgcattagcatagggcaaatgagttgcttgtttgagccctaggcaactttaaatactagaatttatttaagagtttttttatttttatttttatctttttcaatcttgtcttctagattgctagaagcacaagtactaaaatttcagtccaaaactattttttgttattttggtcacgtattttgaaacagtctaaaccatatcgagaaaatgttgtccaaacatacgtgtgctctatattgcgcatgcagggtactaccgatttatactagagatttttaaggaagtagataacatacaatagtaatactcagtcattactcctttcagtgatccggtactcctacgatacaagagagctttcgagtgaatgtgcacatgacttagaccttattcgattaatccctctctagagaattgagcggtatttggagctccccactttctatttttacatgaatctcttctctagtcctctctaatcctttttcataggaattaatcgaacaaactcttatagcaagttgtaatactaggctataagccaactataaacttatgtaaaggtgagagaaaattagaaaaataaagaatgttagctctcataagagcaagtttaatagtatagcccactactggctccaaatcatttatagtcaattcatacaatagttacctataaatatataccacactattaatatctggtcccacctgtcatacacacattacatattggaggccgtgctgcagctggctacaaatctgtagcccgttactcttctctctcctcttttatctcctcaaaatttgtttatagctggcttgtagtctgctattgtatccactctaagagatagctctttacatactccaaagtaaatacgttaaatgcatatgtgagagaagagaagaaaattatagacaaccttataactaatactatattatacatgttagctctaatataaatttatagctactagcaaaatgctcaagcttcgctttgggtagaagaagaaaaatatataatatgtcatataaaaaatatattttgtatcaaatatcttatcattatatggtatttacttgtttgaatcaaacgttgggctatttcataatattagaaaatattataaagtaatttacaaaaactacaaaaacaataatgaagtgacagatttactgtcaccataactactccctctgtaaaaaaccaacctcgtattaggatgtgacaatgaatctagacttcgagaatatccaaattcgttgtactatgttatgtcatatcctaattaaacgaatctcatactaggattttttttagggagtagaagtttttaaaaagatataggtcttgtttagataaaaaaaattggcaaaaaatgtcacatcaaatgtttggacacatgcatggggcattaaatgtgggaaaaaaaccaattgcacaatttgcatgtaaattgcgagacgaatcttttaagcataattatgcaatgatttgacaatgtgatgctacagtaaatatttgctaatgatggattaattagggttaataaattcgtctcgcggtttataggcagaatttgtaatttattttgttattagtctgtttaataattcaaatgtgcattcgtatactttaaaaactctacacccaaataagtaaacacacccatagataataggcaaaatttgccacaggacacacaaaaaacgtgtaattggctgggagacaccgcaaacgagcaggcggccgctccgcgcagcagcgcgctagcagggactggacgcggaggcaagcaggcaacagccacgacgggagcacgtgacaaggagccgcctacggtggagcttcgagcagtcgctagatcatgctcctccacctctcgtccctccccaaccatgtcagcctccgcgccagctacctcgccggcagctacaaaacttctgtgatttcgggtgggggaagatgacgtcaagggcaatctcgtcattttaaaaacaatttcacctctttttgactcggaaataataaaataatgcgaccggtgtcctatagccaattatatattttttgtagtgtccattagccgtgtcacgtttttgtgatatcttccaaccaattacatatttttttagtgtcctgtatcaatttttgcctagataataaactctatctcttgcaaaatactcctacctccgtatctctacgagtttccactactgtgcatgccttggtatggtatcctattcctacccgcaggtaggtcgttttccacgtctgctgctgcctgcctcctgcccttgttgccagtctgctgcggtggcacagagaccgttgcgctgcacaagcgttgaccttggattttcatggcaggcatacgtcccaaccatagcacacctccccataccaatcaatactatactggacgtactagtacatcaatactacttctacagtagagtactttttgaacgccaattgccaagacctagcaacactggagtattcttaaaagtggatcactgatttggctaattcatgatttatataaaaagatggacttaattaacacagagtaccgtttaaacttgtaactttaggtaagctctccccacattttttttacatgaagctcttcccacttgaccttagagaagtggagtactatccccgtttcaaaatataataacttttggctataaatctgcacacacagttatctagattcatagctaaaaatgcttacattttaggatggagatagtaactagcagagaagagagaaaaaaagaaattagtcgatcaagctaactttacaagtgcttcaagatattatttttagataatgaagtgattcaagatatatgtattaattaaatacataagtgaaaaaaaaggaagaggagaaaaatttgaagataaacttatagccaattaggtttgaaactaataaagatgaagattaagttgatgcacgtaaaatgagaaagccattagcacataattaagttttaattattataaatttgacaatggatatatttaatattttaaatcaatttctatatagaaagttttagcatgaaacacattatttagtagtttagaaaacatgctaacggaaactaagataaaatcttaacatgtacttataattatacatgttagtcctaatattatggttagatggatttacatacagcagtagtagtagttaactctactgttatatcttgctactacctccgtcccaaaatatagtaacttttggttagtgtctagatttatagctaaaaatgcttatattttgggacggagggagtatttctttatttctaattacgatgcagattttaccttagtttttattagcatgtttttcaaattgctaaacggtacgtttgttttaaaattgtttctatatagaagtcacttaaaaatatcaaataaatttaatttttaagtttataataattaaaaatcaattaatcataaactaataattttctcgttttgccaacgctcactttatcttcatccatctcaaaaccacgttagagcgagacaggaaaaaaaaagaaaaaaaaaacaaaatgtctgaaccttgataaggtcggacagctctgtctgcagggtgggcccagcccaccagtgtcacacccctcccgaaagcaaagtttacccccccaccagtacgcgtagcgtttccccacactccgcggcgccgcaagccaacaaaaaccaaaaccaaaaccaaaaaaaaaaaaaaaacctggcaaaaccgcggatcccaacgcaacgagagatagagaaaggcgaagacgaaaccgaagcagcgaagccaaggttgacatgtcacccgctcctcctcctcccctcttccccttcctcctctagaacacgccgccctctcctcctcctcctcttcctcctccacccctcgccgcgcagggcaccgaccgtctccgcgccaccggtcgtctcggtctcacctccacctgacctgacctcacccaacgcccccctcacctaatccctccctcctccaatcgccctcgtcaaaggggtgcaagaatccaaggggggagtggttggggttgattggttcttggttgtggtggggcatggcggcggcggcgtcggcgtcgtcgccggtggagttcctgctgcggcggccggcgccgcggcggcggcggctgccgctggcgggggcgttcttcgcgcccacggggctcgcgggggccacgctgctccgggcggtggcgtcgctcgccgcctcgctggtcgcgggggccaggccgccgtcgcagcggcggaacgtcgacgcgctcgcccgccgcctcgcgctgctgtccgcgatcctcgagtccatcctcctcgacaccgcggcggcgggcgccttctccgacgcggccaacctctgcttccgggagctctacgtcgtgctcttccgcgccgagctgctcgtctcctacgtcgcctccgccggccgcgcgtgggcgctgctacggagcccgcacctcgccgcctccttccgcgacctcgacgccgagctcgccgtcgtcctcgacgtcctcccggcggcatcactccgcctctcgcacgacgccaccggcctgctcgacctcctccgcgcccactgccgctgccgcgcgcccgcgcaataccatgaccccgacgaggcggcgctccgggaacgcctcatggatgcgctccgccagttcgacctcggccagccacctgaccacccctcgctccaatcgctcctcgccgacatgggcatctccaccgcggcttcttgccgcgcagaaatcgattacctggaggagcaaatcttgagccaagaagaggacaccgacctgccgctcgtcggcagcgtcctcgccttgctccgctactgcctattcgccgtgttcgaccctagcaacgcgaaggcgctccgggattggccgttgtcgggcaacaggcagcggcttctctcgattggcggcggcgatgacacctccttctcggtgccaaaggagttctcatgcccaatttctctggatttgatgcgtgatcccgtggtggcgtccaccgggcagacgtatgaccggccgtcgatcatacagtggatcgaggagggccattccacctgccccaactccggccaaacccttgcagatcaccggcttgtgccgaaccgtgctctccgcagcttgatttcacagtggtgtggggtgtatggcttgcagtatgattcgcccgagagcaacgaggggatggcggaatgtgttgctgcatcttgcagtagtcgggctgcaatggaggcaaacaaggccacagctaggattttggtcaggatgctggaggacgggtcagaaaatgtaaaggcagtcgctgctaaggaaattcggttgctggcaaagaccgggaagcaaaaccgggctttcatcgccgacttgggtgcgattccgctgctttgcaggttgctcttgtcgaatgattggatggcacaagagaatgcagtgacagcgctgctcaatttgtcaatcttcgagccaaacaagggacggattatggaacaggaaggctgcttgcggcttatcgtcggtgttctacagaatggatggactacggaagcgaaggagaatgctgcggccactctgtttagtctatcagtggtccataatttcaaaaaactgatcatgaatgagcctggggctgttgaggagctggctagtatgctgaccaaggggacatcaagggggaagaaagatgcggtgatggcactcttcaacctctcaacacatccagaaagctcagctcggatgctcgagtcatgcgcagttgtagctttaattcagtcgctgaggaatgacaccgtgtcggaggaagctgctggtgctttggccctgctgatgaagcaaccatccatcgtgcatcttgttgggagctctgaaactgtgatcactagccttgttgggttaatgcggcggggaactccaaaaggtaaggaaaatgcagtctcagctttatatgagatttgtcgtcggggcggctctgctttggtgcagagagtagcaaagattccagggttgaacacagtaatacagaccatcaccctcaacggaacaaagcgcgccaagaagaaagcaagcctgattgtcaagatgtgccagagaagccaaatgccatcagcaatggcactagggagcacattgacagtcgttgatcgttcattggtagggaacaacacattaaggcgtgctgcgagctttggcagtggagaattgtcaaacccgatttcgatatcagtgcaggtgccctaggtgaaaggtttctaccctggattatatggatggttacatttggtgagttttgtccccaaaattctttcatttcatgctccaatgaaggtatacaaaatttaatccaaaggatttaatactcgaaatatatcagatgttcctatgtttgtgtgtgaaatgtggataactgtgcagacatatagatgtgcaattagagttccagcttgatgttcctccttggcaagctcggaaattgtccaatttttgttttatttttttataaaaaagcaccaaatatgtatgctgtatgctgtaaactgtttaaattaattagaagctttacactgaggcaacagtggaaagaaatggtatttcatttcaccaatgggattgcaatacaacatagactttcacatttactctacaaaagccagcttaaaattaattaagtatgtagtatatcttaaaaagtaactctagctattctagcataggaaatgaacaaaaaaaattgcactatcaacacagacccccccaatctgaactcttccagcatggaaattgttgggagagaatgagtggtgtagaaactgtgctactttaggacaatctctactttgttgaggagaagattgaaaggacaaagttgatcatgcaactgaagaggagggggaccatcaatccactgaaggccagaaaacactaccggtgagtaaagatgatgttctggaatacaacagctcaatggaaacagggtgcgccggcggcagtaacctgattggtatcagaaagttttatttcacaatggaacccagtttccactcaccgaggcaccgagctggtgtgttcttcgggagaagtcgtgtggaatatcacgctcctgatggaaatttccctgcttccatttgaacaaggagcacaagcctgcaacaaccataataaaaggtggatcaagtcaggatacctggactgatgaccttttgagaagaataaatcttaattggtgacttttgcagttgcatgacagttcttggcaaagttgccaaaccttcaaaattattactatatgtttatcacatatggtacagtaggatacgaacaaattatgtgtgaatcttttttagttaggttggctacaatctgaacgaagacaacaatcgaagtttgctaggtgtaggtggtgcagagaatctttctgttatatgggagtatggaactgactcctgtaccttctcaatcatctgaatttctttatcgtccgaattttcctaccatcatcagcccatcagtcttcatcacctctcttgacattttgtgcctgaaatatcttccctcatctgatgtctacctaacaaggttcctgtacaaattcacaccatgatcacgttttcgtacttaattatcctcaccgtttcgtcagcttccagggtcggtagccatgtatttcaaacgaaaacgtgt

SEQ ID NO: 1332 - DNA, 29518 bp, Oryza sativa
gtctccaaggcctgtggctgatcgtttcagttgggctatgagctggacctgtgattctcatgaccgtgaggttgatgtgctgaagcagctcgatctggcaaccggagatacggtatcaggatggttctcggcgccggatttgtggttgccttgagctcaggtcggggtcgctaacatggatgtctcggcaaccaatcaaatcaaattcatctgtagaaaaatgagaggaaaaccacacatatcaatggcgtgagtagcgacttcagttgagtcgaaagatcaaactgggacatttcagtggttaccgctggccaacatgcttggaacgcagaaatttttatttactcatgtgagaattgaaatgtcttaaaccctgtaaaattatgcattgaaaatgggccttgaatggatcagaaacatagtaaacaaacccaacggaaaataaagataacgtctgtgcggatacaaaagggttaaaaaattgaaaagaaaaaaaaaagaaaagctgatactgcaatcaggcaaaactgaacgcagatgctgtctatacgttcatggatgcgtgaataaaaacacgtcagttaaaactctaatcggattgagatccggtgcagttataaactctaaccagcatcataggactgttatgtattttcagccgtttattttaatgatcaacagttcagattcactgctatagtactcgaacaacagtaaaataagcaatgttttatattacaacacttttgccacagtatcaaattaatctgtaccgtttaagtttgatccaacttagcagctacaactgctaaagttgcagtcaataatataattgcagctgattcggatcaaactccaatcagtcagtgtgtgcttcacattctgtaccaacaagtaacattaactatgatctgacgggacgctttggaagacgattaaaaagattaggcagaatactgtcaattacctgggtaacatcagatgcgtgtttactctttaccttcatacgcaaaagctgtggtactccctgccgaagtcttcatcaagtcataatgccacggctgatcttgattgtacgatttagaaagagtcgtgatgctagccaaccaaaactgcagcaacagacttgtatttttcagttgttcacgtcagagagtacacatgaaaaaaatcgtatcccagtcgaactaagcaagccagtcattacgagtatgagcttccaggtcaaagatgtacgaacaaggcttcttttttccatcaaacacgaaaataaaactcgaaaagtttcactaagtttccataaaataaattctagagtgaaaatcagagaaagaaaggaatgacggtcgaatagcattgcttctagtaagtagtcaccgacccagtttcttgttgaaatatacaagtacaaaatgtaagatttgcaaacaccagcatcgagattatcaaatatgtcaacgggaagaacgaccgtgcgtgcaaaattcatcaggttgctgatgtcggtgaagaagttgaacctgcacggttgcatgagtgcgctgcatgactacaattggctgctaataactagtgctctacatgactaccttccaacaatttgtttaagtctatactaacaaaccaaaggcccactgattcctgacccagtttgtgcagtaagtagtcagctgatcaaacggcaccttggtttgcagaaattacctgggttaatacactcctatcattttagcaaaaggaggcatgagaagctatatgattgactgcttcatgtagcacagaactacattgaaaggtggcagtggatatcaagtatcaacagccgtcagcagattgtttctcctgtgcaaattatattagcataatgggacttgagcaccactaactctccactcatccaattgtccaattgtttaacctgatacacgagcacctgccattgtacgatgttgcctcccaaaacaagctccatactcctagcctctcatctgaggctctgaaacctttcgtctcaaacaaaagatcacataatctgtccccatctcccatccaagaagaactcacataccaaccatgccttgggctgaaagcttgctgttcctcctcctcttgttctcgctgcccattcccttctcccattcttggtcctttgattatcccagccccattgccaacattaattctctttggacgaacaacaatgccaccatcccatacagtgcaacctacccagatggttcaacgatcagagcgattcttgttaggcagaatcctacatggtatagtccattcttcgcatgtggtttcatctgcaccgctccttgcaatgattttctctttgccatcttctcggtgtccgttggtgatccgagcaaccctgccttcaatacctcgtccatgccacggatcatgtggacagccaacaggtcccgtccagtgaaggataatgcgtcactccagttcaaggatggcaatctcatactgcgagacttcgatggttctctggtctggtcgacgaacacatcggacagccgtgttgtcggtctgaatcttgctgaaactgggaatatggttctcttcgacgcaatggggaagacggtgtgggaatcatttgagcacccaactgacacgctccttcttgggcagtcactgaggcaagggaagaggcttacttcagattccttggcaacaaactggactcaaggtcagttctatctcactgtacttgacaatggtttgtatgctttcatcgaagcagatccaccacagctctattatcaaagaagattcaatatcactgatgccatagttcagccaaatatgaacatatcctctgatggagcaaagaactacacgacttacatttccttcttaaaaggtagcctgtcagcatttgttagcttcaacaatactgatatcaatctattcgatatatcactgccgtcgccatcttcagcacagttcatgagcctcgagaatgatgggcacttgagagtttatagatgggatggtacttcgtggaaacctcaggctgatgttctgcatgtggatcttgatgattgtgcatatcccacagtatgtggagattatggtatctgttccgaaggacaatgcagttgcccgagtcggaattctggggatgaagatcaatttttccgccaattggacaaccggcaacctaacatgggctgctccctagcaattcctctgtcttgtgacttgacccaatatcaacagcttctccccctcccaaatgtcatgtacttcaatttaggacaaaattggaccaccgacgaatatagctgcaaggaggcttgcttgaaggcctgttcatgcaaagcagcctttttcaagtataacaatgtctctaatggttcttgctacctaatgccaaagcttttctcactcatgaattatcagcctgaagtagttggatacaatttatctgcatacatcaaggtgcaaatgttacctccaccaccaagaagcaaacaattaaatccattagtttaccatgttggtgctcctattatagttgcagttatctgcataattattctcatcatcagaagaataatgaaaaggaagatggatgatgacgacccatttaaaggactggctggcatgccaacacggttctcctacaaacagctgagagaggcgactaataactttagcaaaaagctgggacagggaggatttgggccagtgtatgagggaaaacttggaaatgttaaaattgccgtcaaatgcttgcgtgatattggccatggaaaagaagaattcatggccgaagtcatcaccattggaagcatccatcacatcaatcttgttagattgataggatactgttctgacaagtttcacaggctccttgtttacgagcatatgaccaatgggtctctagacaagtggatcttcagaaagaacccaagaggtacactcagttgggcaactcgatacaagattatactggatattgcaaaaggcttggcctatcttcatgaagaatgccgacagaagattgctcaccttgatatcaagcctggtaatatcctccttgatgacaagttcaatgcaaagatatctgatttcggtctagcaaagctgatcgatagggatgaaagccatgtcatgacaaaaatcagaggaacaaggggatacctagcaccagaatggttgtcatcaacaattaccgagaaggctgatatctacagttttggtgttgttgtgctggaaattgtgagcggaaggaaaaacctggataacaatcagcctgaagcgagcaacaacctaatcaatctacttcaagagaaaatcaaggtcggccaagttctagatatattggacaatcagaacgaagaaatccaattacacggggaagaaatgatagaagtgatcaagctagcagtctggtgcttgcagcgcgactgcagcaaacgaccagccatgtcacaggttgtgaaggtcctggaaggcgcgatcgacacggaaacatccgcaggctacgatgcagctagtaaagatgatattaattttgacgcttcatcccctctgtccccagcaccagtgtcagcacgatgaaactctttttaagtaggaacaccgatacttgttacagtttagttgcagtactgtgtgcagtgtgctagtgtgcatctcatgtaaatttgtcccttgtaatatgtaacatcctcatcaatgtgtgaatgaatgaaatattataacgattttattatcgagctatttcatggtttcccaagtaacaagacgaacagcaaaggtagcatgtgaagggctagggaaaaggtaacatccgaaccttgccatgctcggccacgcatttcgtcgaacacgcggagggccgacaccatctgtgcccccccgaccgccgacggggaggccacgccgagggacaccgcccccggactgtcggcgccgcgcgccgcgtgcacgctcgtgcacccaccccgtaggaatcactcgacgccgcagcccatcctcatccggcgcggcgcggcgggcgacgccggcgaggctggcatgactcacgagcgccagcgcgcggcgacgagggaagcgggagagagggaaagaattataaaataataaaataaaaatctaagcgcgactcgagcactgcacgaatctcgaggcgcacgtggcccgtgctgcggcggccacgtgggcgcccgaggactcggaagagttttgtgtggccgtggtatcctcttccctccactccactctccaacttctcccgcagcatcgccgccgtcgtcgtcgccgccgccgccgcgaggtgagggctcgtagcaccgtccgggagggcggaggaggaggagagatgagctgctgcgccgcctcgtcttcctctccggttctcgccaacccccgggtgagtacgcacgccctaccccgtcttcgccttgccggcccgccgccgccgtcctctccatcgacggcggcgtgaaattcctgcaggaatccgatgcgttccccttccgctagttcatttcagccgccatcattggtcttagcggacttagggcaagatcaatcccgccgcgaacaaacccgcgcgcttccgatttttctcacaaattcttcggttcgatgtgctcgtggaatcgaatcgtcggcgcgaattcgctagttcgttgggattccgaaagggagggaatgttccgaagagaatcgattttataatatgtctggatttatctttcaccaaggtcccatggtctagcggttaggacattggactctgaatccagtaacccgagttcaaatctcggtgggacctattttttctccattttttttctgactcgctgatccttgctaggatgtggctacatccaaaacaccatttgctgagtcgaggcgtcgagctgaatccatttgctgagtcgagctgaatttatatatgctccatgaaatctttgctacgaatttatgctttgttttcatttcaaggatgttgctgcatcaaaacaccatttgcttagttgagctaaatttataaatccccatgaaatctttgcaacgaatttatgctttgttttcattttttattttaaactttcaggggggattcgctgctagctgctcaacaagaaggaaccacagggtgatcttcctcggttcaaggcagttttctccgatcatatacagcccagcacgccgcgcgtcgtcacggctgtctcggagagaggtgatagcttttgcaggccagcaatcttgggatatcggcagatttgtcaggacgctgtatttcttcaacgggccaccgaatcctctcaaggtttactcactgtattgggattttttttcacctcttctcgttacagttatttcacatttggcattgtgctcatgttttgtctgttcaatctgtagattgtagagtccattcttagcagtttcactggctctgctcctggtgaggtgccaaagaaaatggaatcttctgatgtggtgctggtcactggagctaccggtggcgttggacgaagagtggttgatatcctgcggaataagggaatacccgttcgagtattggtacaatacttgtcaagcttatctacttttggcttctctgttttcattcattattacatggatagtccaacttctccctcttttgttggatctttgctgctcttaatgttgatctaacatttcaaatttcaattcaggctagaaatgaagagaaggcgaggagcatgctggggcccgatgtagacttggtaagccacttgtttagctggatttagattcatgttccatgtgcggtttagtttcaaccaactaggtctatttcaataccccatgtattccaatatgcattacccttacccaatacccaatgtattccagcaatatgattgcctgaggtaagtctcactgttacatttctgctaaccttctagttgtgaatgaaatgaaactagggaattttgttcttaaatgatagtgaaaatttctgtgtattttttatgacattttgtttgaagtgaccacgtatatgcaatgattcactacatataatgaaccttcctatctcattgctagtttgcatatggtttatgtggttattgaatcttccacacctgtaaagacggaagtattgaatatttatattattaaaatttctattttgtgtcagatcataggagatgtcacaaaggaaaattcacttgatcccaagtacttcaaagggattaagaaagtggtaaatgcagtgtcagttatagttgggccaaaggaaggcgatacaccagacaggcagaagtataaacaggtacgccaaatgccctatcatatgttaccaatatttcacgtactctactttacaccctacaaacttacatttaatctcatcttcatgcagggcatcaagttttttgaacctgaggtagctgcatcaatacattccttctcttgtagaatataagtaacaatggatgactgacatcctcattcccaacatacaacatggaaatattgcatcagtttgcacttttgctcgttcaaaagctagttcattatattattttgttatgcctatcagatcaagggaccttcacctgaaatggtagaataccttggaatgcaaaacttgattaatgctgtcaagaacagtgtgggtctgactgaagggaaactgctttttgggggcacaggtaaatctttcattccataccaaaatgttttttgaaagaaatatcggagatttaaatctacactcaactcaactcatattcattaggggacctccatagtacccaaaaactttggtgcaagatctgcgggaaatccagtttttagtaattatggtgatcataacagtgatttttttcaaaacaacaaaatagtgaattgcttgcaactgaatcatgtataaatttatttttccatccctacatgtgtatacatttgtatgttagttgtctttcaatatataagttttttttccttatcacaacatgttagttattttatttaggcaacttatccggaaagattgtttggggagcacttgatgatgttgtgatgggaggtgttagtgaaagcacattccaaatccaaccaacaggaagtgaaactgatggaccaaccggattgttcaaaggtattttgtttttttttaatgatccctcgactccttgtatatgcgatgtggcaattctttggaaaacctctagtctaagcaggtctgtgcaatgtattctaggtactgtctctacttcaaataacggtggcttcactagtataaggacaaaggtacctactgacatgtattttcccaaaaaaaaaaaaaacaaagttgctgccgttttgtgtgttgatttatattttatttccatgtcctaactattaggaataattaattatttgtcactcttacagatggtgataaataatttgccactggacccacatgtcatagacaaatgaggacccacatgtcataaacagcgagtggcaaataattaattgccacatcttaaaagtggtacaaagttaaatgtccctaactattattgtgatatgttactctgattgcagaattttacagtgcctgaggatctgtcagcatatgacggtattgaactacgtgttaagggtgacgggaggcggtataaacttattgtgcgcactagctttgaatgggatactgtcggctacattgcaagctttgacacgactaagggggaatggcaaagtgtatgttgtatttgttgatttattgaaaaaaatacgtccctttgtttcagcaacttacagctatgcttcttattgatggaacaggttaaattacctttctcttcactgaatcctgtattccgtgcccgcactatgcctgatgctgcaccctttgatgcaagcaatgttacttccttacaggtacaatgtgttcatgtgttggtataattttttaggaataactgaacctgaaattgctgtgataattctgtagctcatgtttagcaagtttgagtatgacggaaagctgaacccaacatttacagaaggttcatttgagctccccttttcaagtattagagcatacataaacgagccaatcactccaaggtttgttctttgtactagttttactatatgacatcatcagaataaatgagcactgtaatcgtccgattgtttggaagtcatcaagactcactagaataaatgacaattctacttgcaggtttgtccatgttagttctgcaggagttacaagacctgagagaccaggcctggatttaagtaaacaacctcctgctgttcgcatgaacaaagagctgggctccattctaacttacaagttgaaggtatgcgccatttttcctttattattgtgcatttgtgcttattgattcacatcatgtctaaatgcttatcgcatgtcctttcagggtgaggatttaatccgggaaagtggcattccatatactattgtgcggccatgtgctctaacagaggaaccagctggagctgacctcatatttgaccagggagataatatcacagtatgtagaggcagcatttgtttgttgccttcataagatgccacgccattcttcttcctccataagatcaaataaagcatcagtttcatataagtttcctgtattttttttttcagggaaagatatcaagggaagaaattgctttcatttgtgttgcagctctggcaagtccaaatgcagtagagaaaacctttgaggttaaaattctgcaactcatttgcaagacactacttgggacaacaaaacttcagaaggaaattgtggcattttatttcattttaagctaactcatgtacttttttttgttaggtcaagagcactgttccattcagtgaacctttcgtggttgatccttcaaatcctcctccagagaaagactatgatgtgtatttcaaagagctcaaagctggcataacaggtaaagaggcactagaaggaacacctgctcaggtctgaagaacatgttaaatgcagaacgcccaactgctttgacaaatcttgacatggtaattctccattgtatttaggtcttaaccacttaagatatatgagattataacgctgaatttcataaattaacttcatgataggtgcttcttgaacatgaacagaattacataaatatgcaagtctgattcataaaccaccaatagttgcagtacctgagcatatgtgccacacttaatctttgcagtcatgtggtttccaaaataccaaatgggaagtactttgtgaagtatgtgaaggaacagttgtttcttttttttatgtaaagtagtatatcctctggagtttgtgttatatttaatctgctgtatctgtatgagaagatatgcatacatcttcagaagacatatggatgtcgatcaagagctcaaaggttatggagcattggagctctttctgtagcagattctgtatattatgttgcttttattttcactgaattgtgtgctgtagatagcgtattggaatctagatcgaccattttgtaaaatcaaatacattgtcatacagagagaagagaagtttacagttccagttttttttttcaaactttttatgtctctttttagtttgcccctctattggttactgcaacgcacccctcctttttttaatttaaaatatacgatgaagaaataggaagatgaaacccctcaaaagagagaatgaaccatgaatatgaaaacaaggtacatccatatcactagaaataaatgaacagttaaaacacaagcattcatatattttgcacagcatcaggttttctaccaaactgaaaatcagtgaacacaccactacaatccctactacacacaagtcatttgagtactaattttctacatgtttcctcgttacaaagccaaaattaaaaagaggaaggcaaggtgaaattactactccgtgaaacgcaattatacatccaatcaatattcccataattacatgaaaaactccctaaactgcagaatcatatccatgagtcctttgcctaatgatcaaagctccccatgcttcatgcatgtcagactgtcactcaccagcagcaaaacacctgcatcataagaaacaagaactgtcattagctaattaagctaggaattcagaagcagaaatttgtcaaacacatttctgcacaagtgagaagagcacatgacacaatagtgcagtgcaaaccacaaaccttcctcctccagctccggcgccggcgcttcccgccgccggcgagcacgagggcctccggccgcaccaccagcggcgaccagaggccgctcttctcgtactcgaagccgaactcgctggtgtcctggaacttgcccaggagctcctcgctgacgtccagcggcaccacctgcaccacgccggcgccggcgccaccgccgccgccgcccgccggagaagaaggtgggaggctcacgaggtccacgagcgatggtggtgaagaatggcaggtcgacatggcagcatgtcctggtcagggcagacagaatgcatgaggagaaggaagcaaaggagactgatggaatgatatggatagctgatgacgatgatgatgattcatgctgagggaaaaagattcagattggtgtgtagtttgtgtgtgtgtgtgagggacaatggcagggagcagcaagcagagaggcaagaggcaggtgagctgttgtgtttgcttggttgcagggcaagctagctgccaagatgaacaacatgcatgtgtgtgtgtttttgtggttgtggggctgggagtgagagagcagaaagaatctcatgctgccttttctgcagttggagattgtggttagaggggacttttaacggattaggattcacgtccacggtgacttaatcattgacatgtgagccaaggtttagagcaggtacaatagcagactataagctagctgcaaacatattttaagaagataaataaggagagaagggtagcgggctacagatttgtagccagctgtagcacggacttcaagacgcaatgtgtgtatgacatgtgagaccaggtattaatagagtagtatataactattgtatgaatgagctattagattggttatacatgaattggagctagtagttggctatactattaaacttgctcttatggggccaatatattagtgacaattaatgtcacctgactttgaaggttgaggatgctagtttctttaaaacatgcatgtagcatactatctctatccataaatataaatatttctagcgtttaaaatttttccttaaatataaacatttctacagtattatatcattgagtatgatgtttctcaaaatatcaagttttggggcgtatcaagcaatttcacaacaaccttaaatccttaattttcacgtaaaggcttatatttgtggacggatgaagtaactactgtctaaaatcatttaactttataactaatgtttcgagggtaacccaaatagaaacatgctcctataggattttctctttaccggtgttcagtgttgtgcatgcagggctgcatcattagtgcatgcattgtgctaggccaacttttcacatgcctgttaattttaattaactaaaagttgatgactctggttaactcctactagtacctttcagaacaggtaggcacaagatctgctggtgtgtttaattagccaggcatcagctataatggaactttgctttctttcttcctttcctttcctttccatatgcttcatgtgatgcatcgctgtgatgagatgagatgagatggagatggagtgagatatctgaatctggattggttcgtacgcatgatggcaaattttgcaacagggggatgggatcatggacggtgtccacccatgcaatggtgaccatacccatagggcattggaccataagatgcaaaaacggcctctagctagagcgattcacggttggcacgagccatgagatgcttccacgaggtaagaaggttgcgttctagaccgtccgatcgtgatccaacggtatgtaataattcgtttgaaaaatataaggtgttagatttttacagtctccaaccttacacttcgacatagtgtattatcaacaattataaaagtaacatcaaatgaaaatatcttcataaacgaatttaacgctaagtgacgtactagtcaaaattttcatatattgactttttgaaaaacaagaacgcattatattttcaaacggggagagtagcacacgataaccagagaaatgaaacccccttgccattatgcaattaactatatatggactgagactttcagtttatgggcctgagcttgattaggttagttaggaaaaagtacaagaaaagcaattggcattcatgagaataatatgatgttctactattctctgggcatcctgattcctgaagacatgaacagatgaactgccagtaggtacgtgaccctaccccaatcttttccgatccatatatataggtaggttattcagatcaacaatgctgacgagattacgagaaacgtcaaatccaaccaaactgatgtagaaaaaagttaggcgcagcgtgattaaactaatctctagttaaaatgactacatcaactccatcaagaaccttatcatatttgtatagcaagattggctcctttctaagtaatgatcatgagaagtaatgcgtgacatgtagtacattgtagccagttgatgttaacttctgagcagatatttccattccagatttttgaaagaatggacaaatggataaatagggacttgtttagttcctattttttttcccaaaaacatcacatcgaatctttagacacatgcataaagcattaaaatagataaaataaaaaattaattgcatagttttcatgaaaattgcaagacgaatcttatgagcctaattagtccatgattagctataaatgctacagtaacccacatgtactaatgacggattaattaggctttataaattcatctcgcgattttaagcgagttatgaaattagttttttcattcatgtccgaaaaacctttctgacatccagtcaaacatccgatgtgacacccaaaaaattttcttttcgcgatctacggggaatttttgaaatggtgccatgcattcaaacaactcactcaaagcctcccaatagagagcaataagggggaaatttccagaaaataagagtgaacatctcgcatgccccacatgaaacagcgtctacagtctacaacatcaagaaatctagcggtactggaaggtataaaataccccaagcttgttcctaaacacagcaaatagtttttccatcttctgaaaaatgttagcattcacaagatacagaaataccggtactatgctagagaccagcgagagcattcaacgagatcaggcatcgcaatgtggctttgcccccacaaataaaacggaaatctaacaccaacttggtgccagattatatcagtgtgtgcatatgccttcaatcctgtgaaaataatacaaaagttgtaaggagaagcaattgatatcatgatggcatatgaaataaaagcaaaactatacagcaaatattatcattacctcttcaattggggtgctttcttcattttgcttcttctcatccgccccattttcttggttctgaccatctgtctccatcttttcagtttcctctgaagcatcagccatattagcatctggcttggggattgcaaattcagcaggaatttggccagtgctcagtgcctaatcatcacagtagtgaaaaagaaatgtgagcccatagttagctgttccaaactgtacaaagcgcaggagctaaacgaaaggacatgctaccttttcaagccttgcaacctcctcaagtgtctgagaattcacaatggcagcctgcagatggaataattgttaaaccttgaattttgcaggtagttgtactataccaccatacatagaagatattgacatcaacagagagccatacacatatctaggaatgccaaatgccacactaactacaaacagttagagtttagaattatcaaagttaaaaatcaagagcatactaacaagccagtagaagccatagccacaatcatttttttaatgcagtagctaaataatatagttatttgcacagcttgcaatagtaccttgatagctgtgatttgctcaggtgttggagcaactacttttggaccctgctcctccattgtggtatcttgagcatccaccacctgtccaggagtaaaagttttggctggcaccttctttgcctcttcctctgcctcctttgagtgaaacttctgtgctgctgcaattctctcctacaaaaacaaaagatctcacgcataacttcagaaattaacacaaatacatgcacactagataatattaaaaataacacgtaaactaaaaggcattcatgtatttaattcattgcgacacaaagttaaagagtcgctcttttgccctttttcctgccagcacttctgcagtccattccaaaatcattttggcagtcattccaaaggaaatgaatgaacaacctgtggggaataagtaaactaatcaagcagcaacgcagtttctgcatagatccacatatttcaaaatgcctttgtgaaaaaaatatatgtacaataatataaactatataggcttgcaatgctgtttaattttgaactcctttgaaataatcgtatgctacatacttgcataaataaaacatgcaaccttaatgagtgttatgtcaatacatgcaaaatatcacaatatgtattttatggctccattaaacatttaaaaataagaagcgattaacttatgaaacattgatataaagagagttcacagaagcaccattgcacatagagctaaacgaaaggtgtttactgtttagtgctagaaactaccattagagatcaaatggaagaaaatactgagaaatttaaataaaaataaaccattcaaaatagaagtttttacagaaacttcaagagaacaaaactaagactaaatgattaacaaatttcatacaaaaacatatttacatgaaaaagaacctcagcattgctaacctgttgtttcactttcttgaaatccagcaaccgcaaatgcttcaatttatggatcacatacaaccggtagtctggctgcttggttacagtattatcaagtaagctaagaaactgaagctttggaagagatgccaggggatcgatctccgcaagatttgtaagacgattgtttgtaagcaccaatgtatgtaactttggcaagaactctagaaacaggagcaactgaaggtaagttctggagcaaaattatgaaaatgataaacagatcataacaagataaaatatataatcttaccaccaagattgggattgatacgtgtgattctgttattgttaactaacagagtgccaagacgattcaagtacgggaagttctcaagcttgacaatctcattgtctgacaagtcaattgtgtcaaattggtcctatttgagagcaaagtaacaaaaagaagtgttaaacatgctggagaaagaagataataaaacaaaagctgggtcaaatactgaaatgagaatgagtattttttgggatatcaaatcagatcaaaatgaccatactagttatttaactatcaagtgattgacatgacaaaggaaaaccaagaaacatgtcattcataacaacagaaagtatgccgttaacatactaatgctttgaaattacatgggcacattgtacaactaaaagacagctctatcagcaaaaaacactaaaagacagctctatcagcaaaaaacaatgtgtgggacttatttcctctaaacttccatagaagaaaaacatgcagaacctcaaaaaattgccaaaaagaagagaagtgctaagctacctagcgtcagcatgtacagacaaattttaatgccccaaattttgtaaaattattatgcaaagcacttcaaatcgcagcgttgttaacacatactcaactgagaatatgagttttattccattccagagatcgaaaaagataaaattgaccatactgattatctaactataggtgattgacatgagaaaggaaaaccaagaaatgtgtcactcataacaacaaaaagtatgccgttagcatgctaacgattagaaattctatggacacattgtacatataagatagctctatcagcaaaagaaaaaaaaagttcttccagactcatgtgggacttatttcctctaaacatccatagaatagaaacatgcagagccgacagttatcaagtcctacaaaaagtgacgactggtgctacagttagtcctaaagtctttgagggaacacgacttgagggggcacgactccatgtgctggccgcagaagacgcaatggagttgagacttgagcgaatgcttgggaggcctggtgccttggcctatcaggccctgctgagtgaaagggagattgagagctcattgggtccatcaggcgcagcaagttactagtaacagactagaagtagaagcaatctatgtatgtaataacaacctgatagagtagtcaactcaacgactagtcctcaactatgctccgaccagtctactacccagtagacggtatctcaacccgactttacaacttaacaaccatggcagaacctcaacaaaatgccaaaaagaagagaagggcacactcatatgttagtaatctctcatacctatcgtcagcatgtagagacaaaatgcagtgccccgaattttgtaaaattattttgcaaaacacttcaattgcagctttattaacacaaaattgacgctacgaacttagtagcattatgtactacatttcttgcatcactacctagggcacacccatatctactaatctcccatacgctacatccaagagtaaagcatgttccaccaccaatccaagaacccatcataatacttcaaatgagacaacaatggagctaagggaagaaaaggcttgcggaagctggtggagctcacctcggtggcgcccagattctcgatgatggggatcttgttacctgccaaggaaaagaaacacaacagacaaattaaactaccgagacggagggaatgaaaaaagagggccaagaacactaaaccctagatctagcgagcagggaggaaagagcgcgcaaacctcggatgtcgagctcgcggtccttgacggcgttgaagaagtgcgggctcttccatatcaggtcggcggtgagcctcaccatggcgcggccgggagggcgggcggcggcaacagcttcgggtcagtcgggctacaaactcccccgcggcgcgaggtcgaaaccctagtgatgacgaggaggggaaggaacggcaaggcggccggagccctagcaaacgggaaggcggcgaggggaggaggtggaggagggcggccgcatgctcgctcgggatggcgaggcggcggcagcggcggcaaaggagatgtggaggcggggtgggagagggttcaagggtagggcttttgtggcggtgctttacgatgacaccctcgtagtttttattaattgaagaaagcgtggattttaagcaaaatctgctcgtttgtacggtgagaaacagctgattgttctagaaaaatagggttttcgcttatagtttattttttaattttataactatagcttctcaaaatctgaatgaaatgtagtactgtttatgagagcttctaattctcggagaaagtgcagctggcaaaagctccccaaacatggatcatatagctacgacaacctgacccaatggggacacaagtcaaaaaatgagcaaatgtcgaccacttatatgtgataaaattgtaatatctcgaaatttaactaggtgtatgaaaattcggagggatcatttgaacactaagaaaaaaaatcatttatgcaataatttaattgtattatgtggaaaaaaaataggactccatcggatggctgattgagctaggggcgtttcagccgaagcccatcagatggctgattcgattaagctcattcagccaaacgaagtgagcgcacaatggttgtgtatccaactctggcaacaaatcctatgatccttctagtgctcacagccccacacatggaaacacctaaaaagaaaaaaaaaacacgagcggttggaggtgactaggccaacggcggaggctacaactaaatagccacaaaagatcaccaacactatactggattatgtcaaagaattgcttttcatagagccgttaaaatctccgtatgccagagccgcccagtcaccactcttattagcgatctccaatgtactcttatataagaaaaccccaaagaacgatatactatcaaaagaaaatgagaagatccaaggaagaaggaagaatctgaggtctcaccaacccaattttaaaccatcataccagagtgcattacacaagacatacactcaggagagagtcatgaagcaatagaaacaaattatgctgaggaggtcttctaccatgctccaatcagctcgcaaaccaactttcagtggccgtgtttgttaatgatgcttgcatcaagcatagaaagtcaagctatatcaaattacacccagttcaattttctttgatatccattagagagttagccccgaagaacaaagagatacagaatttgcatataagaataaccaagtaaaaaaaagcataaaaccaagtgatggactgacgacacaagtaaaaccaataatggtgaaactttaaatgaaaagcaaacaacaatgtgagatcttaaaagaaaagccaaatccatcaaaacaatgatcgatgaagacaaaatgaataattaaaagggaaaacagaacaacgagagcaagcaaagaacacgaatgctatttgtcacctgccatcacatgcgtccggtgatgatgacaagaaaggatgagtggtgtggggatctactcccaccgtcccatagaaaacgaatatagaatcgaatatgacacattctagcactttgaatatagatagatatatgtttagattcgtagtactaggatatgtcaaattcggtaatagatttattttttatgggacggagggagtactattttgtggaattgtttgccccctgatgacctattatttatcgtaacaatgagataaactagtaaaatcataaaaaaaatgttccaaaaaaatttagataacatattattaggagtttaggaccacacgaaaaatttatcaacaaccaggactatctagtatttcctttttcatcagaaaaactgatttatatcaattcatatatttttagttttctgtgtggaacccagtgccttcttaaaaaaagtatcactactttttttttattttcaaaaggaccattatgcccctccgcatgcccggagcagttttcccattcagcctttctcccgtccacgcgccatatctctctccccctcaacggcgacggccgccgccctcggatcccggcgagagacaaccttctaccttcctgcccccttctctccccttcgagttccaccccttgcagcgccgctggcccgcccccttccggcctcagatctgtcaggcacggctatgattgacgcgcgggcgatacaaggtcgtgggcgcggcggcggcggcggtggccgcagcggcggcgactcgaagctgtctacgcgagcttgccggaggtcgagattatcttggtcgtgggggacccagcttcagcgcgtcgcggcctccacctaccttccctaagattccctctcgtcttctcctcctacttggtttcttgggaccaagagaaattgtacgccatgctgcaagaattcacctcaagtttgctttgatttcttaatctgattcgccgtccacacacacgatgcgatcagctaggctcggccaccgcccgttttgggattcttttccccttccccgttgtacatattgtgattaattgcccttagttcagagcagtttatttagtatcgatgttgatgcacacgctgtggttagagattgttctgctggcttatacacgagcaacggaggattgggtacgaccaattcagagaattcgttagcttatgtactttcctcttaaccgaaacagcaattgtgcttgtaaattggtggcacggtggtgttgcctagttttatggtcctagacttgtcgatccatcagttgaaaaaatgtagtggaatcttacaagttgctacttgccagaactttgctttattatcgtagacgattaaaggaccataaccttctttagtatacataagtggcggacgtaggattttataaatgggtgtacgataaactaatctacttataaaaaaaataaactatctatttgttatacaatattatctctaaataaatataaagcccaatatatcataaaagttggactagaaataaactaaatcttatttttatctttaaatctcattctaatacatagacatgtaactagtaagactttgtttgcaaatgggatagagataaatattgtccatccattcatcacacctcatttaatcctagccattcatccatttctctttcccaatccctactctcataactcatttgccaacactacaacaaaaacattttgtagaggctcttttgtagagacaattttcaaaatacctctaagttttgaagctctatagtctagagacactttttagaggcatttttaaaatcacctaaaatatttatttttactatagagacactttagagacatttttaagatactttgttaaatttatcttttagagacatcttttcgacactttaaaatttgcctcatacgtaaaggcactttcttaaggcatttaaaataatgtaaagacatttttccaaatattaatatatatcaagtaactagatataagtaacacaaatcacatatttacatttaattatatgaggttgagatggttagtacattgaagataaaaaatgatcaactcaagaggtcatgagttcaaggattggtaagggataatatttttctttctttttcatattgatttgctatatttgccgtaaattctttctttttcatattgatttgctatagtgccgtaaaattcaccaaatggcacttataaaacactcttcaaaatgtctctataacatggtaaaggcatttaaaaatgtctttatagtattaggaaggcattttaaaaatgcatgtaaaggcgttttaaaaagacactcttcaaaatgtctctataacactgtaaagacattttaaaactgtctttatagtattaggaaggcattttaaaaatgtctctatagtattagtaaaatctctctacaaggtatatttgttgtagtgcaaacacatcctaattagaatatcatcactcacttcttgaacaatcctatcttcctatataaagcaaagcatgaaagaagccacatcatggcatgtaagaagccacatcatcaataattctaattcgtagagacaattcaccaaatggcacttatgagacactcttcaaaatgttctataacactgtaaaggcattttaaaaatgtctctatagtattaggaaaatgtctcaacaatgtatatttgttgtagtgcaaacacattctaattagaatatcatcactcacttcttaaacaatcatatcttcctatataaagcaagtcatgcaagaaaccacgtcatggcatgcaagaagccacatcatcaataattttaagccgttggatcgcattagtacatagttatcagccgttggatcaagaagctactcatctagtcaccttcttttagattataagtaggcgtgacattgttatccattctgtacataatattatgttttctcctcccaagcaatccaagataatgcaaacttatcttctttatttaatatgaaattattatataagatatgaattttgttttgttataaacaattggataacatagagtaattaggcattattaatccaaacttatttttgaaataagcttgagataaagtaaagatgtgcaaactactctaattatgacggcatgtatattgtgcatgaaaataacttacgtatatcataacaatacacaatgacgttttaaaataataaaacatgaattgtattgtaatagcagaggctatatatgaagccacattatcatttattttgtttatatacagagttacatctaattatttaaaacattgattttatttgatgataaaactagcaaatcccgtggcaaggcgcatggtgccaactagtatatatagagcattattatcattggattctcaacaagtgtcgatctctaattcatctataaaaaattatatgattatttatagcattctagattatgtttaataaaaatatctttccacttcttagaaaactagttaggtaccttatataattacaatattattaacaaatatactaattattatttactcatgtaaaaacatagataatatatattacagagcacacacatatgagttagctactagtattcatgtgcaagtactagtgctgattgtagcaatattattataaaaaataaataagaatgagaaagcgagaagaagatggaacaacagaagaatataagattaaaactttagttttacaccgtattaagacgaagaacaattttgttaatattagtatattattgattaatgtgagtatataccataccatgaatgtgagtaactttttcccacgtgtgtttgagctaatgactaaacctcctttttttttcttaccttctttcgaagttctcctaatgtgttcggtaaaaaaatgttttgttttgaataaaataaagaaacattttttgactagattattttttaagagaatccactatgtgccgcttactttgtccttgtactataatatggcactgagtttgttaagttatacaatatgccatcgtattttgcttaacctctataatatacgtcaccgtccatttagacttcgttagtactgtataattttgttctaatgaccgaaatatccccgggacagaaattccaaaatttggctgaatattctgaaatatcatattataaacaaggcagagaagatattcatctcaaactttggaagttttacaatctgatatttggaatttttcgtcccatggctatttcggtcattatgataaaattatataatactaacagatgctaagtagacaacgatggtatgttatagaagttaaacaaagtgcgatggcatattagaacttgacaaacctagtgacatattatagaataaggacaaaatcaataacacacgatggattctctatatattttaggaaaaattagaaccatgccattataattttgcaaaatctgatatatgtcatcctgacccacatgtcattgactcatgtgggtcctacatgtcattgagataccgatggcatatctcaaattttgaaaaattataatggcatggttccaaattaccctatattttatggttgtttagttcattacctatctactatcgtgcaacatttttataaaaagttaaatcttatgctataagttcatatcatacacattaaattacatacacttataatataattttcaaattatacaatgccatcttcacattttataggagaaatatgaaaaatgatttattatctatttaattatgagaaaaagtattagtccaaattaatgtatatgtagaaaaaaataatatgaaagaattacggaaatacctacaatcgtatatcatgcagtaagaaaaggagaccacaatcgaatcccttattgttgagcaaaattgatggcattaattttatctttttttagctaaatctatctgactataattaatcagcccgtgttagtagaagtctgcatcttcatgcatcaatatatcataactcataactcataagactattagtaatagccaagtacactgacccaacaatacttaatatatcacaagactatcgggtaatggacaactcatctttgattgtatatcacaggagtatcggataacagacaactcatctttaattgtgctaaagaaaaaaaagtaaattatagttcgtactatgtattcttaaatgttttcatattatgtcagcctttaaccattcttttcatttacagaacaactaactttacatttcaatttggaccaacctatttcatccatctccaagtccaatgactctataaccacacactaactctctctttctctccattttattttcccccgatagttggggaaccgctagatccagcaagaaggagcctggatctagcgtctccactcttcatcgggtcgactcctgcctccgtgagtcgctacaatagtatgcatgacaagagggagaggaaaaaaagatggctcatggagtgcaactagagggtgcagttgcgcatgcaaagacagagaggagaaacgatggtggctcataaagaaagagtggtggtggcggtgcgtggagtaatagttagtggttactggtagtatgaagagtttgttgtcgactcaaatcgctaactgagtttgttaatttttagaatgtggaccactagtcattataaagaaatagtcattataaagaaatagctagtcttataaagtagtaaaatattgagatatcataaaggtgagagtactcgtctagagcttttaactttttaccatttttaaaatatggtaattaagaatttactactcacaatctataatacgtggatccttatgtgtatatgacacgagaatgctccttctcggtcgcgcgaggggaggggaaaaaatcggtcgctccacccttcccccatcacgtgcgcaccagcaatctctttgggcccccaccacatgtcccctgtccccacctgccacttgtccacacacacaactctattgcaacaaatcacccacatattttgaaaaccctatattaagggaatttggtttactttttgttccaccaaaaaagtttcacgtagtgtactcataatgtttcactatgtatagatctaatgttgcagtgaactaaaatattccattgcaacaaaaaaacccacatattttggaaaccccctattaagggaatttgatttattctttgttccaccgaaaaatgtttcacctagtgtacttataatgtttcactatatatggatcaaaagttgcagtgaactgaaacattctttcactatttgctgaaacattgtttttatataaggtaaaacaacacccaattgaaacgagtgaaatattttcgatctacttagtaaaacaattccgatatacctggtggaacatcgtgcaacatttaaaaataattcaataataaggtaaattttttttcgtcgaaatatatgcctgtgtggccttgttttgaagatttaattgcagcgaatttaatgatgcaatcggattatgatatggataagtaatttaagagaaaaatcagtttaaaatagtttttcacgtaaagcgtccgatttttctccaaaccgatcagacgcacgatccgtagactcgtccgtccgtatatacatgtgggaccagcggtaaattcttaataattcccaatagtaagagtctgagcgtcttccccttccctttgtggcgtaaaagaaagaaaagaaaatctcccgtctctttgtctcctccgctccttgcgccgccgagacgagtcgcggctgaacaggggaggggcggcgatctccatcggggcgagcagagcaggggagaggattcatggtgagcatccgcatcctctttctgattcatctctctctctcccatcgggactacttttgtctggaatttgcttgcgttcgttcgttcgttcgttaaccctagcttctcttctagatctggaagaagctcttcccttaatttcagagccttaaccttaatacaagtaacagtttgtttattccccgagaagtttgaacccccatgtcccaagttggatccgctcctgtacataatattggcagcttgtggcactcttgaatggaggtcttggaagatactttagtacctgttctattagattggtgtgttataggccctgtgtggaatacaagaattttgctcggttttcacctttaattttccttgtatttccaccttgttttgttagatcgctgttgctcacttgcttgcaatgtaccgttatctgaacatcatatgctttttttctacttgtggacaggtttatcactctagctttgttgatgacaccgggattaccaaagcatgcggctgtcctttgcttccactaaaaactcatataaggggcccagcgccagcattcgatcaaggtatactgacacggtgacaacataaaatacattgtgatatacttccgtggtttcactctgacagaaccatgccaagctgctgatttatgtcgtgctattacagacaaggctgacattgttgatgaagcaattacattcttccgagcaaatgtcttcttcaaaaacttcaatgtgaaaagcccagcagacaagttactgatctatctgacattttacatcaatattgccctgaaaaggctggaaggttgccgaacactggctgttgggacaaaggcaatcattaatctgggtttggagaaagttcctgtgcctggggaaccagggtttcccttccctggtcttttcactctaccccaatctcaggaggaagcaggtatatgacttcatccgccactaccacatttgtgtgcttgtattctcttttactccctccgggttgataatacttgtcgttttggacaagagcacgctttccaaaaaacaactttggccattatttttaattataatatgtataaaggtgttaacaaatatatgattttattaaagtactttttaagactaatctatacatgtagtcaccatattttaaaaatgattcataatcaaagattctaaaatttgacctcacccttgtctaaaacgataagtattatcagtccgaagggagtagtttctcaactgtgtgaaatcattgttgctttttattcctagagaaaagcttgccttatttctcgaatagttagtttttcttcttttcccccaattgtttatccatgctgcttttcttctataccatactatttgtcctggctagggaaaaaacaaaagaatgaagcctattggaaatttagcttttgtgagattacaaggggacctttccaaactacagcaatttatgtcttagatacttttattttggatttaactaaatctgtagtgaactccttatttgatgtcctgtatatatgttttttttttgtcaatttctatggtctaaactataagtctgctctgggtatagaagcaataagttgcttactgactattgacaactgtttttaggaacatccaagttgtaattgcatcagttttttttttacttctagggactaaataaaacagtaactttccatctctcatggaatgtgatctcaattaagcatttctctgttggattcagaactattgaggaattatctgaagcagataagggaggaaacaagtggaaggttgcttaactgcgcatacagagctaatggtactccaaacaaatggtggttggcttttgcaaagaggaaattcatgaacattgtcattctttgaagtataggtattttccgcgacatgtttgagcaattgagcagcttgtaggaatggtaattgcacttgcgtacttatttctgcgaatactttagagaattaaaggaacgacaatgattctacacctcgattgatggagccaaaggttctaatgaaacaatggatagaatgtcaacaatttgtttattgcaatggatgaacacaaggacacctttcagctgttatgttgaatttctatttttcatttttattgtactccgtccgtgcccttaaattgggcatgtatttttcagatgatgtttgaatagcgaatgttccgtgtaggacatttgtacagatttaatcaggtgtaatgagaatgtgaatatatattttcctgatccctcttttttgtatcattcgtgttaatcctttatctgtttttttttcaatatgattataagatatggagaaacctggacgtgcgcttccctgatcttgccaaacgttgggagtaaactgctgcttataaacacctcaagtgtgaattggcatggttaatttcattattcgatgaagcattctttgatacaaggtgcttataaacgatttgaatgcaaagcccattgcatcactgagacctgaggtgatattcaagctctatggcttgtcagtcaccatgtcattcgacacaaaggatatctaatgccaggtgttcatacatagattcagaaaaacaaaatatcattcgacacaaaggatatctaatgccaggtattcatacataggttcagaaaa

SEQ ID NO: 1333 - DNA, 13415 bp, Oryza sativa
  unsure (1)..(13415): unsure at all n locations
agctttccagatagcattgcacaaagattctcaccagtaaatagccagttagttatggttctgcaaataaggcagaaaagggggctttacatgtgacacaaaaaacaggttcagtccatgcatttcttaccatattacatatatgaagatagctggctaaaagtaagacgaagcatgatatggttgaaagcatcaaattacttccacaaacactacacaggataagaagaggaaacctctttattgtttttaaacccagaccaaattttgcagcacacctcagatgaacatgtttccaaacctcccaggcaccttctcaaatgtgtggtcctgagatatttagtattagcatgaaataggtaccgtaatttttgttgggaatccatgctataattttctaaagaatgatgattatataagctaataaaaaggaacttgctcaaaaaccaagtaactaacaagagatattacccattgaatggatgagataatcaatcaaagtatcaaactaacgatgttgcaaagagcatgtatgataaaattgtcaggccatcacagttggtatgtgtcacacaatctcattggttgaatttgatttgaaaagttaaatttgtttgaaatggtaggcttgtagagatatggccaaagatatccacagctttcaatggaagttatctttagtccccagtcctctacaacacatctatctaccaaggattgtacaatggagataactggcaataagaagggctaccactcagcatacagatattagtctaaatcatttggacaaaattccgctgctaaagcaaattcattggttctagcacaaggccaaggctatggcatacagcatgtgatggagttctgtcagatgctatcgcataccttcatgttcaagagccgagcaaagaaaacatatgtgcaaggaataaaacaccatagtgatctgttaagactttaagaacaaaaaggaaaagaagccagtgccagtaggtttgggaattagcaatttatgattttgagtcacatgcagtaaagtacccacatcctaagtgactaagacactggacgaaaattaactcagagtctatgtatagaaacagttgttgaccacgctacaacatgggtatgatgctatttgtctgattttccaaatttaaacttgtcagtttcctatgctgctatgaagtgattattgaatctccaaatccaaagttggtcttgtttataaggatgtagaaataattccagaggtttttgaagatccatggaagaaataccatgcgtgcattctactatatgacccaaaacggcagctacatactcaaagacattggaagatcaaagcagggtttattccaaatatctttgaagatcaaagcagggtttattccaaatagcagtgcagttcacgtctgccagggatagccatagcattgctggcagatcctcctagagccatcagcctccatgccagagaactcatgctgtgattctcacagagcaatatagtacatgctacataagaaaaatattccatttgttatttaccttatgtccacactcttctttggccacaatcttttccttgttttgttttctaacttaccaggcatttatacataattacctatagcagagtcatagacacagacaagatatgcatatatacttctaaatcagcaagtgctatttagacttcatttacctttctaaaaaaatgaaccatataaaaataatgctcactattatcatctgattaaaaaaggtctagcttttttccacatatattattccctttagttctattggtagtgcaagtttgtaaaaataaatatcaataacaacacaaaatgataagttttcaaatcgagtcaatgtacatgcaactaactggtggaccacatgaatcatattctttatcatgtgaaaatgtccatgtatattatgctttgctatatggaacatccttgtggatattcttcctcatttcatgccctttcaaaactctggagaaacctgatacacaacttattctttggagaagtaccaaaagatgtgcggatcaagcagctcttgggcatcgaaaagccgcataacacttacgagatcaaatcgttagtgcaacattgaccggaacatgcttaccaacaaagtcaaagatttcagtttgcacaaccactgaacttctttgtcttagtgttctctccttccagaaggtctcgcatggctttacagttcctaaagaaaagtagcataactgattaataagcagaactgtccataaaacaaccaaatataagttcatcactgtaattatgatcacaaacatcttaaaatatgcttcataagtatgtctagtagtgtttcagtgaagaataacactttgtagaaacatgactcacttttcatcttgggctcttagctaattcattactatcagcatccctcttctgcccatgattgattcatcaaccagaactgttttgacacggctcagagtgctcccttttcatccagtgctagtcacgtagtgccccatatgaacctggctcagttggtatgccagttttaattgggatcactattaatatacagaaccataaaggttttaagtcatgtacacttcacccacctgcatatgtttggagctaattctactcttgaaggtgtaagcatacatttaaagcagatggagaaggcagtgcaaagattttaaattaacttgctgtattctgaactgctgggttacaatttcctattgtacttgtatgacaaaaatggcactttaatttgtactctgactcatttcaaatctaaggtttgtttttccaaacacatcntaggtggcataaacaaaatataaagtggaaaacgtccataaaacgaataaaacacacacacacacacacacacacacacagagagagagagagagagagagagagagagatttcttagattttgaatcattgctcatggccaaaccacatcaaagattgattgtaaagtttggaccttcggtggtggggtgtgtgggtgtgtgtgtgtgggtgtgggtgtgtgttggggctatggggggatgtggaaaaaatgagccaatttttaatacacctaacaacggtatgatgtttttactactgttgaaaatacaagttatatttatgttccatttcataactaacaagttctctttcatgtcactgcttgataatatcataataacattgtttcagatttcggcagtgatttgatctgatcaaaaccatatggcgagctcctcaggctgcatgtacaaagtattactttataaaagttgtcctttgctgtgaaagaatcagatgcagtaacggattcttcatatacagcttcaagagcacccagggggaagatccataagaatgtcccagaacagagcataatatcaggctatcagcaggatccacgaaatggaaaagaatatgatccagacatggcccatcgaattcaagctcatgttcaagactggttcccttttgtattagcaacagaaaccagaagggtacgggggtcagtcagttataagatgcaaacgcaaaagtgacagtttattagctgctcaagcattgtcagcttaggtagcatattccaaggcatatccagattttactcagtgatctttgtgctatatatacctgagttcaacaattaaaatacagagcaaggaaaatattggaagcaaagaatgacgagaggagcagtaatgggcagattgaataaattgtcagggtgagaatcacagtgcagttctcctctggcatggagggcaagaggagctgaatagctaatggatgataaactgctagcctttccctgccaaaggagagctgccctgccattcagtgaccctgaattcagcatgcgagcttcaagctgtgtgttctgttttcagtagaatgttgtgaagcacactgcatgaggtatgtgatcatgactctgtttttcatattctttgagcatcatccatgggtgaggccataacaacctcctgttttaatagtttatagttcatgaaactaatagttaaagagttaaggccttgagggtgtactacaaatggaaagatctagcaacaactctaagcgacacattcacataacatatccacagttaaagaaggtatcatgagtgtcaaatgacaattaagagaaaaatcactatatttaataataaaaacccaaagaaaagtaacaaaaatacatggatttaataagatatgaagtacctagatagggatgtatccgaggatttgaactggggttgtcagaccaagttggtggcatgcagccttgcaacagcaacggctatattcataaaaaaaaacagaagatgatggtaacaaaggttgttctacttcttcaccacagcatgccaccttgaagagcatcctgtccaccatcgaacctgccactgtttatagttagaactcatttatagttccatagctaacccagtcgctaatccaaatcaagcaccatagatatttggcatgttctaattaaccttcctatccaaacagtgggagcaatcatttgaaaatgtgaaccatccagtttcttgccaatcctatttaagttagacagaaaccctcatatacttaccctcaatattaagagcttcactaatcggattctccattaccacagaaaattagaattttggtacctaaattttccaattaatgaaatcatttgaaaataaaaacttaatagtggtacagcatttagcatgaggtagagcaagatttaagacatggaccaagctgtcacaagcaacagcattgctcagaaaaatgctctagaaaatcaacaaagctatcatgcatcatgatttcctaaaggattgcaattttattacttatagcaatgctactcgaaaatacaagcttcgatctaaattctatatgttagatttaaaataactcagtcttaatatgctacattatgcccgtcccagtgacagtccttatttttcttttaaaaatgtgctattatttagaaaaattctattatttagatctaacatattttaaaataactccgagctgtggccgttcagtggctgcagtgcttatttttcttttttgttataactatatttgttcagctctaatcttgtttaatttagtctaataataggaccttcccctagtatcttagtctaataataaggatccctccctccctccctccccctctctctctctctcttgatttggaggtgaatgattaatgtttatgcatgatactaataattattgttttttgcctgctctgctttttcttcttttcttagcaaaggttctcctgcttgctagctaggtggtaatagtcatggccggggacagagtcaaggccagggggagtataaatgtgcatctgtggttccacctagttctgtgactactgcagctaaactcttctttcatgatgcacgtaagagggtcaaagaacttgattttgggaacctgctcaatataaagctggagaaactgacaagtagagagcttgctgcacggctaacagatcaagctgaaattcaaacaaatcaagaccaaactgaactcaacaacaagcctggagagtcgctatgcatcacggtagaagtagtgcatctaattcttaccatgcggcgtggctctgttcaggagctcacgtcactgcctacaaatgaggcatcaaaagcattcatctcgatatacagtgtgttgaaggtcagggatgacaagttctcaaaagtaaaacccattgggatgctccttttgatgattgacactaaggtacttggtgttgtcatgtgttgtagttaacatttgtttgttcatggaattggcgcaaagtatcaaaggtgttcaaaaagagaaatagaaagagtacactaagtaacatacctaacaactggaaagaaaacattaatgaggaaaatatataatcgatgcagcaaatacgaagtaaatgatacacattgttgaaaaaatgagtttgcaatatttgacactggcacgtaaggaacacagcagaacagaaaattatgaaaatagctttctattttctaatatatagagagaaatgaagatttgtgggacaaccaggtaaaagtctaatttatagagagatgaagatttgtgggccaagcaggtaaaagtctgaaaaataatgatttagatgattgatacataatggcaactaagtggcatagctactatgcaagactgcagtccacataactactatggccattcctatatgcataaatctcattacaaaatgatcatgaaagatctatttgattcctaactaaacatatacttgcacataaagttagggccttgggggagacaaatagcatttgaaaaactagttaactacagcgcgtgaaggcaatgactacctgacatcgtgaaatgacacaatagtaccacaagggacaactagccaccagaaaagaggtagaaaaaataccacaaaaaatttagtcaagcagttaaagcctaaagatgttatttggctgtcaatacaaaaggggcaagaacaacaaaaagcatctacaaacccaaaatacatggagagtcatccaacttgtttagatgtgtcatataggtcactctactttcaaaatgcacatttgagccatctaactatccacgtgagcacaccttgtacacctagcgtgccacataggattaaaaaaattggctgggtatccgcagccgctgtctcctaggattgcgcctccatctctgtttaagcttgtcgttgctgccacctaggattttgcctccattgctatttacattcatagcttgtcgccgcagccgccgtcaccatgtttgatggcaagcaagataaaggactgagaactagaagaactcatcaaaacaagcataagtgaaatgatttggtttccctaatttcgtgtatctccaagtgctagggttgtgagaaaggaaaaaaaaatacacatgcggttttctgcacatgtccgagagcatttttttcaattataggtggcatgccatgtgtacaaggtatgctcatgtggatagttagatgggcaaatgacttgcttaattcacattagtgacctatatgtgtattttgaaagtgaagtgacctacatgacacacctaaacaagttaggtgaccctccatgcattttactcatatatctagtactacccaccaaagaaatactgttaggcatttgcataagttatttttcatgacagaagtgtaagaactagaatccctggtttattttccaccgtaaatgacaaaagaaatgccgacataaatacattgtcggtggagtctaggagcaatatgccgaataacaggtacagcaaaggaaatacggaaccgaccggcatccaacattctataggattcaaatggtcaatatatccatcagtaaattcagtgtatcaaatgatttcagaacaacctttgtcaactaggtatttgttttatgcatctgaaaaaaaaacagtattagagaatggataaatcataccccgatgattgtcactgagagccttcaacttcatgtccaaagctcccatcatcacaaaccaaaggaagccaggccatacatatacggtctcctgaaatctctcctgaaacagtctctcaagcttcatgttctccaggcaaagtgagaagaattaagtagggggcatggccatcaggggagacctccactgttgccaagtacacataaccagccctaactcacacaactctcatgcccttgtaactgagatatgggtgtcaaagagaatatcttctgtgatgcccatctcgcaattccgttcctgacgactctagggatccagatgaggatgaggaagtctattgcatacacaatgcaaagccctcaatccttagtctccccagccataaaactgcaacccctgtgtcattaattcccatggtaattccaccctggagaattccatggccacggtgttcagcgtcattcaccatcgtaaggccagtaaatcgagccatccactagcacgccagcattgcctcatgttgctgtctccagcaaactcaacccatggatggcgatatggatgatccaattccaatcccatgggtctcggaggacgaaaagaccgcaagcacaaagcctgaattcatccctgtaaaccggaacagcgcggaagctccatgctcttcctgttccagctcgatgccaccgagcaacagcggggatgaagtacacgtcccagatcaaaggggtttaggatggcgagcctcctgtgggttcagcaggaggaggtcgccacgccacggcatgccaaccgtgggaggcgtagtcctccagctcgtggctccacggagggcgacggcggcggcggccgaagtccggggtgccggggaggatggtgaggccgccgtggtcggtgaagagcccgagggggcagggtccgggtgggtggagcaggcggcggaaccccggcgaaaagccgggcggcgcgggagcccacgagctgcaggcgaggaccgcgcggacgagagggcatggagggacgggagggcgaggaggatgtcgtcgttgagggaggcttacggtggtgctggtgctggtgctggggttcggttcggctccacggaggcggcgccgcccattgctcgaatcggaatggattgcgggggtgtgagcgcctgaacgagtggatggacggttgttgggttgtgtacaacggtatccattctctgtattagaaaaaaaagaagaagaaggtcaatcctagtcaaggtttgtaaggaatgtgtttttatggaaactccgttcgtaggactaccttgcatgacgccgttaatttttgtgtttgacgtttgaccattcgtcttatgtaaaaaatttatataattatcatttattttaatgtgacttgattcattaaatgttctttaagcatggcataaatatttttatatttacacaaaaattttgaataaaacaaatggtcaaacgttagtcgaaaagtcaacggtgtcatacattaaaatacggatggagtattgtcgacatttgatgtcgcgattccggtatttgcatagtatggggatcgttggtactaagatatacgcgagactgaggtaaaagagatggagacgatgatttttatacaggttcgggcccctgaattatcaggtaataaccctacatcctattggccgaagccggtcattgatcttattcatcataatcacaccagtacaatatttggggtagcctatctaactgttgtcaacgtggcggtctaaagatctgactcgtagtcgacaacagggtagccttcctcctcaaatctgcatccggcgagatcagagatagcgctagattcctctctttggttcccgtaggtaccatatcgggttttcctaggcttatgtctgatgtcgatatctagcagcttgtcttggcctatgtaggcttgtattggcttgtggctttgtggcgtctatgttgtccgtgtctgttggttgtgtctcctcttctcctagggggccttgtatttatacccataggtgtccccttgtccaagtagaactagggaaaccagtatggatacaatccgagtagtccttgtcgtttccatgtagaactctagtcattcttccttatgcggaactcctcctatatccgaaggttgtttccgtataagacatggtatgtggtgggtcctgccgagatttagtcgactactattaggtatgtggtatccataacactgacagtagcccctgacttcaatgcaaatgaacaaattcatattctcaaccgcagaccctggagtaactgttatcgagttcacgtgaccgttctcggtgagttcagagataacgttagacttcccttatcagcctcgtgcgggcacctatagggtttgtctgagtcaatctccggcgtcaaccaagaaaatacagagcatacgactaagtctcccgtcttgctataatcgagaatttggatggaagtcaagaaattttatctcggcgggtacaccatgtacaccatttcttcattccgtattccttgtcgagatccaccaaccgttctcgagtggtcgagaaggcacagagcttgcgacgaagccttgtcaacatctgttgtactcgccttagtcgatcttagtgtagaaccatagagacatggagttttcaacaatgtcgaatagaatttccttaaatcaatactcagaaaaggatattagatagaaatagcccccgagcaaacgctcaaagggtgacatgttataatgtgcatggaaaactgaaaatgaattaaatttacagaccaatgttttgtgtatgagcgtcttctcttttaccgacttcgatcagtcagtttgttgagtcatacactctccctaacccccagccttttcatcggagaatcgttctcggaggataagtctcttggacccttgacctgccttggttgaaaaagcgctgaccctagcccccagtcgtgaagttggaaaactcaatttccgattacacggcttggttaatacgcacggcgagaactcttacatgaccagatcttacatggccgtttgtctctataggatccgacaaggccttatccgctctgggcgtccctagccaaagttcccttaggtttctcagaggccttgtcaggacggcgtaaagggacatgaggataggtttcaactctaggtgtcgtcgtggtaagggatctctgggtaaaacacttggcgatattgtgtacctgatatcaactttgttggagtagaggtagtgggagaatcgttatacctctggtcgaggaccaggtagtagtcgtaactcgaccacttgaagtagaaatagtgggagaatcgctacaccgctggtcgaggaccaggtagtagtcataacttgaccacttgaagtagaaatagtgggagaatcgctacactgctggttgaggaccaggtagtagtcgtaactcgaccactagaagtaaatgtacgagagatcgctacgattgactggttgagaaccagtgagtaggtgtctctcgaccatttggagttgtgatacgaggaccgctacgttgccggttgaagaccagtcgtagatgttcctcaaccatctgaagtcatctgaattcgtggtgcgaggaccgctacgctattaccgtagttgtacctcgaccatctaaagttaaagcgcgagagattgctacaatttactggttcaaaaagcagcgagtagaattatctctcgaacgccaacggaggttgtagtgcgagagattgctacggtttactggttcgagaaccagcgagcgagtagaattatctctcgaacaccaatggtagttgcggtgtgagagattgctacggtttactggttcgagaaccagcgagcgagtagaattatctctcgaacaccaatggaagttgcggtgcgagagattgctactgtttactggttcgagaaccagtgagcgagtaaaattatctctcgaacaccaatgggagttgcggtgcgagagattgctacggtttactggttcgagaaccagcgagcgagtagaattatctctcgaacaccaatggaggcgctagagttggtttattacatgtgcatctcatgtgggcagcatgactcacatacccaactcgtagcatatccggatgtccgcctgcgatcatttcgggtgatcaagccgacatcgtttgcgagcaattatccgttaacaacccttttctcaaatagcctagccaaagccggcgctatgagataggtcgtcggtcttcgttggtaggttgggtgcgacagctctgcatttgccgagaacgttctcgataatgtatgtgcttgaccacaacctactcgagtgctcacttattcctgaaaaatattttctaaaaggcaagatatatagcaaagaatatcgagtatatactcaaaaaactgcatggatcttctagtattatcagaatataacgagcagatgtaaacatcatgcattatgtaaaccataaagaagcatgatttatacagaagaaaatagagcgagcccccagcgttagactgtagtcagcctaacaccggaaacactcgcataatagatattgtataaaagacatgctctaggtaaacataataaattatagatctgacaatactgtatgatctgaataggtatgataaattacatataaaatattgcgtacctttgtagatacatgccggatgtatctatgaaattagtagattaatttaaaaaaccaatctaccaattaacttgtcgcgtactcgttcgacatcatatgatctgacgtcttttggtacgccgcttatcttgaggcctggtcgatctcgagagatcaagttgttgatgatgatggttccgatctcgtcgggagacatactccggtcgggttggatctccccacagcgaagtcgtcgagtagcttgttgtcggagaatctatctcttgaacccatctcgtcgaaatcctgaagcaccaaaatcaccctacctggcgcgccactatcgacgtttgatgtcgcgattctggtatttgcatagtatgaggattgttggtactaagatatacgtgagactgaggtaaaagagatagagacgaggatttttatacaggttcgggcccctgaattatcaggtaataaccctacatcctgttggccgaagccggtcgttgatcttattcatcataatcacaccagtacaatatttggggtagcctatctaactgttgtcgacgtggcggcctgaagatctgactcgtagtcgacaacagggtagccttcctcctcaaatccgcatccagcgagatcagagatagcgctagattcctctctttggttcccgtaggtaccatatcgggttttcctaggcttatctctgatgtcgatatctagcagcttgtcttggcctatgtaggcttgtattggcttgtggctttgtggcgtctatgttgtccgtgtctgttggttgtgtcccctcttcttctagggggccttgtatttatacctatagatgtccctttgtccaagtagaactagggaaaccagtatggatacaatccgagtagtccttgtcatttccatgtagaactctagtcattcttccttatgcggaactcctcctatatccgaaggttgtttccgtataagacatggtatgtggtgggtcctgccgagatttagtcgactactattaggtatgtggtattcataaccctgacaagtataatataagagattttgattttttttacttgcactatttgatcattcgtcttattcaaaaatttttggaattattatttattttatttgtgacttactccctccgtcccataatataaggggattt

SEQ ID NO: 1334 - DNA, 3107 bp, Oryza sativa
caaaatcccttatattgtgggacggagggagtactttattatccaaagtactttaagcacaacttttcgttttttatatttgcataaatttttttaataagatgagtagtcaaacagtacaagtaaaaagtcaaaatcccttatattataggacggagagagtacaataaatacagttataaagacatactatatacattgtagagatattttttatgatattaattgctaacgtagttcttagctatatgggttgcccatctctatatcttctattataaaatttgaaaatgttttcaccaaaattttgatatatcatccgtgtttgaattggttttaatttgatgtttctgttaaattctttctttttttttttcttacgccagagtgtccctctaatccgagaagcgcgataattaattgggcccacaccttttcacatgtcccttgcgcgctgcctcaattgggcccacaacgccctcactcgcgcgattttccgcatgcctgattaggcccacgacgccctcgcacgcgcggtttgcccttgccacatgtccaatcgcgtctcccttgtccacgatttaaaaattaaaaattgaagacgacaaatcgagcttatgcttattcctaaaggcaaattttaaattttagaacttaattttaaattcaactttttggttttttttatcgtaccttattttatatcatttgcttttgagtcgcttagaacatgtttagtcgtcaacacatatatataaaagatttgcatataaatagtcttttatttggtaataagtgtctcggataagcacatgaataaacaaaacaatacgcgatgattatttatccactgacacatatgtacaatttaaattggctcctcccgttgcaaagcacatgcatcttttctagtaagaaaataaaatataatgacttttgagttaattgtgtacaaatgaatatataaaatataaaacggttggtgtgctagggatccgttgaagtagccgttgtctactggggggggtgctggctctccatgcggcctgttattagctcttgattttatcaggaactggatttatccaacaaaaaaatcatagaccttctaaatcaagactctccaaaccatgtataaatgcctagccacaatctcctccccaaccattccccaataaattttcccaatctcagtttacccaacttcaacccacattttttacacaatttctatccatttggttccccagtcaactatacaccatatggtcattctccttcaagctttcaagctactccatatcaatgaaattgggcacaatctaatctagccagcttacaaggttttcatttgcaagaaaatatggtgcactcaccaaatcaggccacattttgtttagaccactctctttgttgggggttatatggcccagttctttttctcaacttcaaacttcaactttctcatttttcgttaacatgttctaaaactgttaaatgatatgtttttggcaaaaatagtttatgtagaagttgtttacaaaatcaaataaatccaattttatttttagatagttaatagttaattaatcatgtgctaataagttttcttgtttcgcatgctctaaaagtatgagagaaagaacagagcgtaagttagtttatgagtctaaaatatctaaacctaaacaaatagtagtaagtagcttttccatttgacttttttaaatccataagccactcttgttgtattaagtaaaagttatgtttaacttttttaaatccataagttatccttaccgtattaagccaaaagttagttaggtttgagattttttttttgcttatttaaggtaaaggtatagctttacacttaaatttagagcttaaaattcaccgacttataaattatattagctaaaaagctatctttaaattctaaactaagctttgaaaaggccaaagcttcaatttttctcctgaggtggaggagacgagaaagaggaggcactcatgcagtgcagcgaggcaatccatacacactctaagataaaggagatagaaaaaaaatggtaaatcaaacaaaataatattattagtgttagtacatcatatattgtacatgttattttttttgataagtagcatatggataagattaatgatggcaatcatcataaaactaaaattcgctctaagagaaagctacctggtctatatagatagctagaagtgcttatatatttcataatagagagagtatcattgtatttaaattgcactagttctaagaaattggcacatcagtatgtttgatataatagttttaagagtaaagtgcatggtcggtcccaaaacttgtgcagttgtgttatttagatttctaaactctcaaaatacaatttttttataacttgtcaaattgtgtcattttggtcctaaattgccacagctcatccaagctagatcctatgcgacgttgatgtggcatatcacataggcgttgacatagcatatcacctgtcaatttgttgtaccgtctgtgtaatttactctaaaaagaaaaaaggaggacttttttagtgggcttcaatgggtcggtccgtgtaaaattggtgaatatgccacatcagcgtctatgtggcatgccacgtcagcactatataggatctcagagggaccgtggtaattggagatcagaaaatacactttgacaagttttagaacctgaatatatattttgaaagtttagagacttatatgcataaccgtacaagttcaaggatcgaatgtgtactttactctagttttaaaattgagcatgcccatctgataattcggcaggatgtattaaagtatgacaacttaagtatgtcgatgcgacgacgtagatatgcaaaagtgctttcccggtcaaagaagaaggaggtgccatgcgtgactttttttttaaaaaaaaaaaacgcatcatcagggcacattgataaaggaatcacctcagccgcttggaactttcatgcaattttgttgcaaaattatgtgaatttgatattttcctcttttttaaaatataaaaataggaatgtggaccatttatttgcaagagg

SEQ ID NO: 1335 - DNA, 1559 bp, Oryza sativa
ctgaatggcagggcaattctcctttggcacggcagtgcgtctcttttttaggcctctcatgccatgccagaggagaatcgcactgtgattctcaccctcatcagtcatcacacagtcactaacacaggcagagcgccagagcatgcatgtatcactttctgcaactaattgtgttcatgctctttgacgccattgttgcattggctgctagctgcttctttctttctttctttctttctttctttctttctttctttctttcatcttcgccttgagttggtactagcttggggagaactctgaaattccagctacctatatatatcctggcatggcaaggaaatcagagaggatgatcaagaaggccaggtttctggatatgccatgatatatgctaccaccaatcaggatcattcttggcctcttgggaagctcctctctctctctctctctctctctctctctctgagcttgcaattgcacaagcatggaaagcaggaaaggtcatgcaaaaaggggacggtgctttccaatattcttcgtttctttcctccaaaaacttttgttgaattgcaactgttagaagttagtagatcttaataagcttggattggaccgttgatcacctgatcggcttacctgaatgtgtgagagggtcttcatcaattaataaattctgctagttgagcctagcaattccatcatgtggtgattcgcatctcatctttgtcgatggaatatggaattggcgacagattgcggcgctgtgccttgtcgctggacattctcaaggatcttcttcttctcctcctgctgctgtgttcagagagctgaatgaattacgggggcgtctgttcatctggtgaagagctactggtactggggcttcgaaaggccgatttaacagcagtgcagccaaataaccttttgagatcatggatgctctcagagtctcagtcgtttttgcttacatgtaattcatgtggtttgttttttctgaaatttagttggccctttcaactgtttttacacagccatgtctctctctagctaacagctatcatgggcattgataagcaactctttctggctatgcacctatacttaaacaattgatttcagtaattgaaagagaaaatataaccattgacaaacatcctattccaagaaatacaatcaatgaacacaattttaagcaatttgtcccagaaatttaagatacacacatcaactcactagcactcatgatcatcaatacaatatatatttatcttctcagtacaacatatattatttagagataattgcacaaccgtttattttaataaaaagaacacgatgacaaatcaaagttagtttgttgctaacgaacagcaacacatctatctatctatctatctatctatcttctattatatactaaaagtccattaaactttctacaaacgctctcaatccgccacgtgtcactcctacaaacactctagaccgccacatggcactatataatctcaccgtcgattttcacttaaattggtggaccccatattttagaccat

SEQ ID NO: 1336 - DNA, 651 bp, Oryza sativa
ttggttagttcctaaatagcatacaggattattgttcactataaccaactaaaatatagtgattgctttagtgagttataaaaacaaagtagatattaattgcttagacgtggtgtttaggtagttgttatccagtaattactgcgtatcccacagtacgtttgagtggtgtagaggtggtgacagccctcgagatcacttaagtcctccctatccgggtacgtagtagagcgatatctgggaacaacgggtttccagtgcctgaagtattgcgttacgattaaaattaagctttccctagatgtttctcactactaaatcctctctatcctagcctatcatctgcttggtgtccttggatgaactgaaggaagatctgatcacacacgttcccttggattcaatacccttggaatactccatagggaaagtactgcatcggtatatccgtgcgcttgcggattttatctgtgatcataagaactaccaacaagcatttctggcaccatcaccaaagaacggttgctgatcatttccaaacctagttcatcctcgtatcatttttaagttttttattatacctttacccctactatcctatagaagtattcctatcaaactcttctcaaccatgaaacaacctctttttta

SEQ ID NO: 1337 - DNA, 824 bp, Oryza sativa
tggtgtttccgcctgcacggctggcatttatgccgccgttgttgggcgtctaagtcttcaccgactgggttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgtt

SEQ ID NO: 1338 - DNA, 712 bp, Oryza sativa
gttcgcatataactacgcggcactattgaggcgattgatgctgtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtcacaccaccgttcatgggcgtctacgacttcaccgccggcctgcctccgtcgccgccgactggtgcttctgcctacacggctggcctattatgccactgctgttgggcgtctacgacttcaccgccggcctgcctccgtcgccgccgactggtgtttctgcctacacagctggcccattatgccaccgctgttgggcgtctacgacttcaccgccggcctgcctccgtcgccggcgactggtgtcctcgcctataccgttggttggtcacaccaccgttcatgggcgtctacgacttcaccgccggcctgcctccatcgccgccgactgatgcctccgcctacacggctggcctattatgccaccgctgttgggcgtctacgacttcaccgccggcctgcctccgtcggcgccgattggtgcctccgcctacacggctggcctattatgccgccgctgttgggcgtctacgacttcaccgccggcctgcctccgtcgccgccgactggtgt

SEQ ID NO: 1339 - DNA, 581 bp, Oryza sativa
tgtgattatgatgaataagatcaatgaccggcttcggccaataggatgtagggttattacctgataattcaggggcccgaacctgtataaaaatcatcgtctccatctcttttacctcagtctcgcgtatatcttagtaccaacgatccccatactatgcaaataccggaatcgcgacatcaaatgtcgacaatactccatccgtattttaatgtatgacaccgttgacttttcgactaacgtttgaccatttgttttattcaaaatttttgtgtaaatataaaaatatttatgccatgcttaaagaacatttaatgaatcaagtcacattaaaataaatgataattatataaattttttacataagacgaatggtcaaacgtcaaacacaaaaattaacggcgtcatgcaaggtagtcctacgaacggagtttccataaaaacacattccttacaaaccttgactaggattgaccttcttcttcttttttttctaatacagagaatggataccgtgtacacaacccaacaaccgtccatccactcgttcaggcgctcacacccccgcaatccattccgat

SEQ ID NO: 1340 - DNA, 495 bp, Oryza sativa
tccatactgaaaaatttgatcttttaactttcattaggccaccccaaaattaggatgttcctggtttgtgtgacatgtgggagaggggtttaccttttaagtacttgtggcgcaaaaggtcttgccataggccatcaccattaagaagcttgaatagccatttgctcacaaacatctattcatgatatcaagatttaggacacccagtccaccttgatcttttggccggcatatataatcccattttgttaacctatatttcttttactggctatcactgctccaaaaaaagctcgatcggcagtaatccagtctctgaagtacacctcgaggtattgcacgatgttaatgaacatcaagtttttgtcctgaagcaccgtaagcttcctaaatcaacatcttattctcacctcttctgaattagctacatgggaccctgctaattatgcatgaatgcattcatatgcttcattaggagtttaggactatacattg

SEQ ID NO: 1341 - DNA, 18148 bp, Oryza sativa
  unsure (1)..(18148): unsure at all n locations
gcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgatttatctgaccgaaccgagcccccgagggcaaggttgaggcacgagcgacctcatttcaagtcaaaattcttcaaaaaggaaaaagcggcccagatacagcccttaggaaattgaacctgctttattgaaatactgaaatgagagaaatgagaatgtgcatgtgtggcagcccccggccaaccctgcacacccgagggggggtgcggggttggcccgagcccgaaacctgacacccgacccccccccctcaggggtagaagcgacgaaggtgctcgatgttccatgggttaggcaactctgtgccgtcgcccgtggccagccgtatggagcccggccgggggacgccgatcactcgatacggaccctcccacattggtgagagcttgctcaatccagcacgcgtttgaacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacgaagctgatcttgatcaacctcgcagtacatggtggcccgaggagacctcagggtgagctcggatgggagaacctcttctgcgccgtagacgaggaagaaaggcgtttccccggttgctcggcttggtgtggttcggttcgcccagagcaccgctggcaactcctcgatccatgaatcgccgtgcttcttgagaatattgaaggtcttggttttaaggcctttgaggatttctgcattggcgtgctccacttgaccattgcttctggggtgggcaggtgaggcgaaccaaagcttgatgcccatgtcttcgcagtagtcgccgaagagttcactagtgaattgggtgccgttatccgtaataatacggttaggcactccaaaccgggccgtgatgcccttaatgaatttaagtgcggagtgcttatcgatcttgatgaccggataagcctcgggccacttggtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccgaaccaggtcgaccgcgtcattgagggcagtcggccaatagaatccttgacgaaaggccttgccaaccagggtgcgcgaggcagaatgggctccgcactcgccttcatggatatcggcaagaagctcaacgccttgttcccgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcagagatccaagcaatcaatctaagggagcttggagcgctcccctcgggtcccgaggcctgggctccgacgggcctcggggaccgatcaggcgcgtccgtctcccctaaggggtcgggtcgcgccgacggctgggcaagcctttcttcaaagacgcccggtggggtctgggctcgcgaggacgcgagccgtgagagttcgtcggcaatcatgttatcccgtctgggcacatgccgaagctctatcccgtcataatggcgctccatacgccgcacttggcgtacgtaagcgtccatctgcgggtcagagcaccggtactccttacagacttggttaacgactagctgggagtcgcctaacaccaagagacgacggatccccagtccggctgccactctgagtccggcaaggagtccctcgtactctgccatataattggtcgctcgaaagtcgaggcggaccaagtatttgaggacgtctccattcgaagaggtcaacgtgacccccgcgccggcgccctgaagagacaaggagccgtcgaactgcatcacccagtgggcggcgtgaggcagctgcgaggggtccgagctagcttcagagactgaaacggtctctggagccggggtccactctgccacaaaatcggcgagggcctggctcttgatagcgtggcgtggttcaaagtgtaaatcgaactcagaaagctcgattgcccattttaccacctgtcctgtaccctcccgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacccttcggtggggccgatccccttcgctaagggccatatccccggggcgctcctcgtccaagtggcccctcggggcgcactcgtcttctgtgccgatgacctcggggtcggaggacgataggggcggccttcccacagtggccttggggccgttctgggggtcgggggctcctggcgtcgtcggacaagcgggcaaagggccaactctggtcgtcaggggccttaggccaccgttcggctcgggggcctcttctccctgctccctcccgggtcgaatcggtacagggttagcctcggggtcagagggcgatagatgcagccttcccgcagtggcctcggggccttcctgagggtcgggggtgcccagcaccatctgacgagcgggcagagggccgactccggtcgtcaggggccttaggccaccgttcggctcgggggcctcttctccctgctccctcccgggccaagtcagcacagggtgggggtgcgcggaatgaggattgtcctcatcgcgctccacaaccaacgctgcactaactacttgggggggcgccgctaagtagagtagcaggggctcatttggctccggggcgactagaaccggaggagagctgagatatgctttcaactgagtgagggcgcgttcagcttccttcgtccaagtaaacggcccaaagcgcttgaggagcttaaataagggtagcgccttctctcccagcctcgatatgaaccgacttagggcggccatgcaaccggtgacacattgcacatccctaagtttactgggggggcgcatccgctctatagctcgtatcttctcggggttggcctcgatgcctcgggcagagaccaagaacccgagaagcttgcccgcaggtacaccaaacacacacttatcggggttcagttttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggagtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggataaatccggcctccagaagtctcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaaaacgtcagcgtttgcccgcaggaaggagacgagcgcgtcttcctatttgccgtccagaagaccaccgatccgtgtggtcttggacgggccgtcgcccagtgcaacctccttgaccgggacctcatcggacgtgactatccgctgcctcggggcggcgggggcggatgcgccaagcctctcgtcgccaccctcgggcttggacacgacggcgaggcggtccgcacgctgctccatacaagcgagcgcgactttgaggtcgccatggacagagatggggccgtcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcggggaaaggatgttgagggctgctcctccatcaatgaggacacgccccaacttcacgttgcaaacggtgggagaaaccaccatcgcaatctgccctccccaggcaacgcacggcgggtggtcggtctggtcaaaagtgagggcaacttccgaccaccgcgcccggcgcgtcgcctcatgagtaggggccgcagccagaagctctcgcttcatagccttgaggctccggcgagaaacgtgagcacacgctcctccatcgacagtggcaatggtggccccaggttcttggaaacctaggtcatcatcgccatcatcgatgtcctcggcgggggccttctgcctggcctcacttcgccgacggccggaaggaaccgccggggacttgccttcccggcgctcctgcctcctctcctcctcccacttccttgtccgctctgccaagcttttgactgcgcgacagtccgcaaggtcatggagggaggtgttgtggacggtgcaccacttgccggtagggcgctccctgctgggaacgctggcctccttctttttgtcgctcgcaggcctcccctttcgggtggcccgcgaagcgccctcgacggcgaggacatgaccctcgccgtcggaacggactgacctctttttcctcctcctgtctcgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacctgacagaaccgctgaatgtacgatcgaagcgactcatcgtcccttcgctgtacggcgtgcaagtccgcttcctcaccggggcgcggatacgtgccttggaagttcatggtgaactactggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcgggattgacgctgccatcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacgacgcggagccggtggtagcagcaccagaggccttggtggcggaggaccggccaccagcatctaggcgccgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacgacgtgggttcggctccccgtcgtcgccactcacactgggagagaggtcgggcgcctttgcttgctcagccatgaggctgatcaagaaaaacttgacgcacacggaaaagcgcgagagctcagaaaacacacgctgagccccctacctggcgcgccagatgacggagcgcggtgctcctcaccgggagaccgcacaggcccccctttgccggttcggccgggggctcagggtgagatctcaagctctccgtgtatgtgggaagatcgcggcctctcaaaagagcatgaaacacaagcgatgtatacaggttcaggccgctgagaagcgtaataccctactcctgtgttttggtggatctgcgtatgaaggagctacaaagtgtgagccaacctctccctcgttctaggttctgaatctggaaaagatcatcccctttctctatgggccaggtcctccttttatacttcaaggggataccacatgcacccctccctttccaaactggacttttcttctcttcataaatggacggagatttgcacggtcgtcctccgaacatacttctgaccggactgcaccacaccaacctccacttctggctgatgccggcaccgtcnttggaaggtggctgtgtgcttacgacatgagcagtgtcagaccggtcacaaatgggtcattcttgtccaccacgcgtcgggttagcaacgtgcatgtttgcccttcttcaaacaacatcttgcttgtaatggttaggatgaagcctggcatatatcgatcggggctaacgtgtcatctctgggatgtaacacgctagttccaccgggacgagtgcctagaagctctcgtcttgacgggatggggcgaagcgggcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccctcggggagaccaagaggtgggcgcacacatcaccctcgggcccgacgtcccccgagggtgccaggccacgtgggcgatggcgtctgcctcaagcctctagtcatgatactcccggtcccatgtcaccgacacccttcatcacagcgcacatgcgtccaaaggtggtgtcattctcccctgacgctgacctgaaggtactaatgttggcgtcactgctacggcgagggtgatagcggtaagcagtgttgcggaggtcgtggtcgtgtagctccctcatcctggccatcatccttaaagcagcctcctggcaagcatgctcaaaggtgcctcctgtagcagtaactaccatgttgggcaagacagtgggaatgtcgtgcacctccaagcggacttggtgcgggaactcgccattgaggaggcgaagctgtgtgtactccgggttatgagggtagcccactgcgatcgccatacgacccagctctgccacgaagccatccatgccctgaccgtgtgtagggggaaggtttgacatctatagaagacaaagggtaggaatctatgcatgctcaaatccaaattaaataaagcaataaatgactcaagtaaataagcaagcaagagcaactttttatgcacagaacattttacatgaaccaaataaacatactaatgacactgattaaacaataaagtaatgcgtaaaataaatagataatagtaataagcataaagattgcatcccatcgaaccaagacatgacttaatgcatacctcccattaaataaattctcgactaactatcaaatgaaattccaattgaccccaaatctatttacccaaagttactaataccctagactgacctaaattttaaatatctcattcgaataagcgatcaagatttttccctgtaaaccaaggaagaaaattctcaaattttccctgaaacaaatccaaatgcaaaagaacatatgcgtatgaaagagtttcagtgagctcttaaggtttccagttggcttgtcctatggtcaaggtcagctctaataccaacttgtcacgccaagaaatttacgaaacaaaattccgagctgcatgtgcattaaatgacataggcgtgtctatcaaaaccatgcgccaatagcccaccattaagcatattttagttgtttgaataccctggtggtacacgtccaatatcatcatcattaaaccaagatttaagttacatgtgagatcccccatatagtaagctagttgatctaagcatggctaagtatgtttcctagttgatctagtcatattaatacccattttatcaatgggttaaggtaaacaatctatggacaagtataggtaaccatcccacatgacattgtaaaatggcaaaatttgctacaactcaaaaaatatgtaattagttgcgagacataacaaaaatatgaatttgcctgagaacactcagtgtggtaatttgctgtaggataccgaacacattaaaatataatatccacccaattgatgagagggaacccatacaaaatgaccgttttgcccttcttcttctcccaatcctccatcgattccccaatccatcgcagaccggccgacccaaatccccatcaccccatcaccccatcgatggacgatggctgatgtggagcctagagccggcgccgcacacgagagggcaggcggaggctaggaggggtgtggtcgccgggttcgtgggcagtggcacggtaggtggcgagcaggcactggcaagctgggcaggaggcgcatggcgcaatagcagtgcaggtgcagcagcaactcagcaagcagcaagccaagcaaaagtagccatcattccaccagcagaaaatggataattcctaaatgtgaatctttgctatttgtcaatccatcactccagtaccccaccatgccggggatggctgcgaggagcttcctattacgcttgctctcagcggccacgttcctaagcttgtgcagcgtgtcaaggagaccagcagagcttgtggcgcgcacgatcagctggggacttggggggtagggatgaggccgatgacagtggcaagccattggagctcgttgcaagtgagcgttggaaaaagaccgaaagaagggagaagaagggcaaatatgtcattttgtatggtttctctctcatcaattgggtggatattatattttaatgcgttcggtgtcctgcagcaaattaccatacttttggagtgttctcgggcaaattcacgtttttgtgatgtcacacagctaattacataccttttgagtgtcctaatgcaatatttaatagaaaatgagacgtttgcgaaataggtacaatatgattaattaacatgtatcacttgccttgcccccggtgctgcaggaacttctgggaccacttcaaagtaaagtagagcttcggattcaccggaatctaagcgaagcacacatacaaaacaggctataagtctatcgagacataaacaaaactatttttaatggattttaagtttatttatgaatttactgtaatttgagtgggctcaaacggagctcggatgaattttttatgaattttaaaagattgaccgtgcttttagaaaagcccttaaataaaatattacgcattaaagccaacggctgacgtcactgagggagggggccggggctgacatgtgggccccatcggtcagcggcgcaagtgtccgatccaccgtggacaagtccacgaagacggagacgggggcaccaagtcacgtgggcggtcgaacgaacggccctgatctgccgcgtggcagatcaggcagctgagatgcggcggtgagctggcacgggctcagccgagcggcgtcgcgcggtcaccggcggcgacgcggggagtggcggcgcgcggcgcgggagacggcggttcgcacagggaacggcggcgcacccaaaggggcagcggcgcgcacgggaaggagagggcaagggagggggttcctcaccggccggcgcggaaggggacgacggcggcggtgaggaaggcgacaacctggcggcagagggcgcggacgggcagctgcgggacctaagagagagaacgagaggggtttgaggggaaaagagggttcacggcaagcggcactgtcggccgggaggcagcggaaaaggaggtgctcaccggcgactgaggcgagacgtgttccggtggcgaggagcaggcgggctcggtgagcgcggcggtggcgacggcgcggctaggcagcagccctagcagtggccggagatggtggaaggcggcggcgctagcttcgcacggcacgagagggaacgagcgagcggggaagcagcggtggttgcggaaagaaatggaggagagctcgcgagggggttttatagagccgtgggccggatggacctctctcccgtggtaggcggcaacggcggcggtgaggggcgatgtcggggcgtgaagccgggaggaactggggccgcgtgcggccgttgcgggcgcgggatgcgtcgagtggggcgcgcacacgtgggcgaggcgcggacagtggggttactggggcgccgggcacgggcggatgttgttctccccctccgatttcaccggcgagaggaagggacgggcctgacaggtgtgccccacccatcggcgacccgtggaggagtgggcgctcgcggggcccagcttgctgagccttcggccggcctagcggcagcgagggcagttgtgcgcgcgctcgggctagagcaggccggcggcgggaaattgggccggaaacagcctatcggctgaaaaagaaaagaaaatggttttgaagttaataattccgataatttgttttcaattattaaaattacttcctttgtttatatacatgtagaaagaaattaattatattgctagcaagtcattagatgtctaattaataagaattaatgttgacatcaatttacaattttttagagtagctcttacagaacaatgactcgtatgaaaaaaaaaatactacttagggtttacgacaactgaaattgatgaattatctaatttatacgattgctatctgagggtataaacgaataaattaacttttaaaaagttaaaattttattttagaaaagtattccaagattttttttttcaaaaaagcaccatttagaaacttggaatgcatgaaaataaaaattgaaagtatagaatcaggaaaaaaataggcccttaaactcgcttataacacttacgtcctactaagagttctattgatattggttcatattatgctcacatttataacataatgatttctttcacctcatgaacaaataataaaaaatctaaatacgatataacacaatctatctatctatacctatattaattggacactttttatgagctctcacgttaataagaaaagtctaaccattgaatataattaattaatttaatcagaatcatagatgcaatagtgatttaacgccataggcctgtctaccgtcaactttatgggctctttccatagcccatatgttcttatctctagtcaattgtatccgggagaggcagggggcgacacgcgccagctggcagcctggcaccctctcctaagcatgatttttttcgttttctttttttcgcggtttttttttttcatttttcattttgcgctttttctaatttttttaatcttcagcacacatgttttcaaatgtttgagttaaaagtttttaaattttaatttgaaagtttttaaatctcaacgtaaaaattttcaaatatggacttaaaaattttcaaatctcgagttgaaatttcttaaatctccagttggaagtttctaatctgagtcgaaagttttcaaatctgagttgaaagtttttaaaatttgttttacaaatttgaatttcaagttgaaaattttcaatgtttgagttgaaagttttcaaaatttgacttcaaagtttaaatcttaagtcgaaagttttgaaatctaacttgaaagttcaaatttcgagttgaaaaaaattaaaaaattgagttttgagtgtcaaattttgagttgaaagtttaaaatttcacgtggaagtttctttcacatatagatttcttttcaatatgttagtaaaaaaatcttcaaaaaaaggaaaatctttccttaattaccgtcattatcctaaactaactcgaaactaactcggttagttacgttgattcctctggaatcgccggcgcgcgttagcttttctgcacaactatatctgatggagagagctaggtaacagtctagcagatggaagcatgaggccacgagcagaaccgtgagcataatacgagagacttcaccttgccggggtgtccattaacacgattgaaaacttcagcaaaggagtcgctccagccgccaattcgaacagcatatatgcatggacggatcgacctgctgttgagattgcatatcccgcatgcatgtgcaccaacctgcgcaaatggaaagaagatcgaagtagataagttcaattatattttgatgaatcggcggcggcgggggaatcagtctcattgtgagtagagcacagcaagttcatttggatctttaaacggcagaagaaaacgcatcagatatgcatcaactgatctgtacgttgtcctaacatatccaatcctttttcccgttgcagatctactattagttttgtaatacaatggccaacaatattcatgcctggattagggtcgaatatcatctgcacaaatacagttcattaattgttgaccaaattaatacttattctccttggccagcatacataatcacattatatttctatatcatgattgtgggtgtttgcacgcaagtttcatacctatgcttattgctcgctttattgtagtgaataaatcaaaatcacctatctaggtggtatcatcaaattaggagtgaaataaaagaagagtcaagacacatcatcgcaggttcctaattcttaaatttagattaataaagaattgaaatactaaaaatcagagccctaagaggaggacaatctagtattttcaatttaaattttcggtattatcaaactaaaaaaatttcgtatttattaactatgagtccacattagatatggctcgctaatatttttttttattttgagaactattaaattagcaaaaaaaactaaatcgaaactatagacaagcacaaagaacgcatttgatactcgagtactttgcattgagctattctacaatttaaaactatttaaaaaaattaaaattaagacaacagtaaaactttatgacgtgaaaaaactatgaacaaacaaaatagaattaataaatttgtattattaattcatattttttatcagtaaaactatgaattaataaaaaaatttactattaatcttaatctttagaaatatgaataaaataatagataatgtaatgtaaagtaaatactagaaaaagcgatgtgagttttttttcctaagaggatatggccctcggagccaaatatggccacctacgaaaatttaaactggggtggagcttgtcgttcgcctgcgaagatcagttcttttatgcggatcacttaagaggtccgcctacgaaaatacctttattttcatagacgggcctcttaaggcgtccgcttggaaaaaaatgatttttgcaggcagaaccttatgttgtccgtctgcaaaaattatgcctgcagaaaaaatatctaagtcccatcattatcttctccttcaccatccttaccctgttggccactcatttcccttccccttctctctttctctctcatttccttcccattagacggcaggtcacgtgatggcctccctctcctggtgatggtggtggctcagtgacgaggaggggaggcgttggccgcaacgaggaggagaggggaggttggcggttcaactcctccctctcccggcaacagcggcggctcagcgatgaagaggtcgtgacgacaacaacgattcctcctggatctgccaccggctcgccctgggcgcgcagatccatcgccagccggccatgagtacgccgatccatcgctggcaggtcttagggaggggaggtggtggcgatgaggaggtgaggggacgggaggggatgcagcgactcggctcctccctctcccggcgacggcagcggctcagcaacatggaggtcacgacgacgatgatgatgcctcctggatccgccgccatctcagcctaagcatgaggatccacccctggccggccgtggcgagcagatccgccaccgaccagtctcagggaggggaggggaggtggtggcgaccaggaggtgaggggaggggatgcagcggctcggctcctccctctcccggcgatggcagcggcttagcgacgaggaggtggcgacgacgacttctagatgtgccgctggctcgcaccgggtgcgtggatccaccactggccggccaccggcacgcggagccgccgtcggctggtctcgttgaggggagtggaggtggtggcgatgaggaggtcagggaaggggaggggatgcggcggctcggctcctccctctcccggcgacggcagcggctcagcgatgaggaggtcgcaacgacgacatgacgcctcttggatccggtgctggctcgccccgggagtgcggatccaccgccggctggccgcgggcgcgcggatccgctaccggccggtcttggggaggggaggggaggtggtggcgatgagaaagtgagggggagggaatgggatacgggggcttggctcctccctctctcggcaacgacggtggctgaacgacgaggaggggaggcattggccgcgacgaggaggtgaggcggtggctcagctcctccctctaccagcccggcgacgaggagggccagcagcggcttggcgacgaggagaggaggtggcggtgggggtaggggtggtggcagcaaatttgtttttgttcactgaaattatttttgtatgagggtggagatgctgcctgcgaaaataattttcgtaggcctttgtttactggcggccctttccccgcctgaaaaaactacttttggccgtctgcgaaaatgattcctagtagtgattgttttctaaagcgatttcgtattgttgacatttttgagtttgaggggacgatgcctaggccacgatgcatgagtccagtgtatcttgctgtgcaacattggatgacaaaggcgagcgtcagtatggagtaagattttgtatatattgttattgtcaaaatccacaattattttcaataggaaaagtaaattacttggtttttactaatctatttatctattaaaaaaatataattctacatttaaatcgatttataaattttatatctatggaaataaaatgtaccaattatgtcggaaaatcaagattcttctccaatccagatccacacaaagttgtaggggggaatcctctaattgcctttaagagatattttgaaaaataaataactgataattcagcatatgattaaaattgtaatacttatttataaaaccaataattagcctgtgcaaagcacgggttgacggctagtacattataattattttgtattcaactctttatttcagcttacacagagctaattgttggaaaaactcaacccacgatgcttaattcttctctccctgcctcatacctttaatttgttttaatgttattaacaaaattaattgttaaccatatatgatttgatatgtggcaaagggatagcgctgcagcggtcgtgatcaacttagctgcctcagatatgatgtttcatcatgcgtgcggaaggcaaagctacagacgtgcattgtgcttctacagcgggccaaaaagaaaacttcggatgctttatttattaacaatagatagatccgatgattcaaataatagatgtaattaaattagttaatatagattttaaattgttaatttaatgagtacacagtataatgatgtaaactttattttaaaacagtttcattgtttaaaattaatagtccaaagtaagtaataaaagatagatctgatcatttaaataacaagtccgccggtttaagtgcaaatataaattagttaatatagatcttaaattataatttgataggtacacaatataataatggtgtaaactttattttaaaatagtgcattatttaaaaataatagtacaaagtaatgagtataccgatttaagtggaaattatctcacattattaatttaacgggtaaatatataatggttcaaatttattttcaaacattatagagctaatttagttacctctatgatggtatattctttcttcgtaaaattatgattatttaaaatttttacggaggaataagtgttttacagaggaagtgccgaagataagtacatctgataaaaacaaatctagcagctctttacactacaaagctagctgtaggagcttggacagagggaatcttgaaatgtaaagtaccgttttcttgtttgaagataggaaaagacataatagaatcccttatatgccagccagttctcttacacatgccaatttaaattggcttctcctttatataccactggttaagttttttcacattttataccacccttagcactgtagcattagttgattgttagtcacatgttattttttttaaatgaccaatatgccttctcaactaaaaaatgtgtaaactttaaaaaatcataactattttattttaaatccgttttgagtgaacaaaattttgtcataaccaatgaaaaatgctctttgtattaaaaatattgttggaaaactgtatgtttcatacttatattgaaaatttatttgtgatggtgatggctaaaattgcatataatgcaaaaaaagaatcaattttcatatgttgtatccagtagctatattagtattaaaatacctatgattggttgtataccaactctcaagagcaaatacgtctttttactctgaagttaacggtcaactgatggtggagtgacggcaatggcataaaagggataacatacttgaaccggtggcatcgcagagagaagccaatttgaaatggcataaggaaaccggttaatttgaagtggcatataagagattttctaattattagaaccagatcggaccgggttccgaccgaagaaaactggaacattggccggtccggtccagcctaaaaaagatgggtgtgaaataatcagactggcggaaaccattgaacggccagtttttttcatagaaaccggttaaaaccggattactagaccgctgattgggccgatgcagctcagcacgtgggagggaagagagttgctatgtccatgtggcagggagggaaagtatcccatagactcacgtctatatatcatatactcgctccattttaaaatatttgataccgttgactttttagcacatgtttaaccgttcgtcttcttaaaaaaatttgtgaaatatgtaaaactatatgttgatgagctacttgca

SEQ ID NO: 1342 - DNA, 11713 bp, Oryza sativa
accgttgactttttagcacatgtttaaccgttcgtcttattaaaaaaatttgtgaaatatgtaaaactatatgtgtacatgaaagtatatttaataataaatcaaatgatataaaaagaattaataattacttaaattttttgaataagacgaacggtcaaacacgtactaaaaattcaactaaaaatttaacggtgtcaaacattttgaaacggagggagtacatcaactaacaaatactactaaaatatctaaaaaaattattgaaagtattatatctagctaggataaaatcttaacatcaaatacattatattttagtcgtaaaaaaaatccgacagttttaaggttgtaattctgttagaattttatctttttttactctctatgtagaatgaatttaaaaattcgactttgtgcgtatatgtaatactattagaagtatatgtatgaatttttgtaaaattatttataatattttttagttggtgtatatggtgtgtacacgtgaggtcatatatagatacgctcccgtggcagggaagccggtgcctgctttcacccccaagtaattgcctattcttaaatctttgctgcaatattggttagggttgttgcaatgtgacggaagactcttgcattgcattcaagcctcaatcttgctctatcagtctagttttttttatcaacattttagatacaataatgtagagtttaggtggcgatcccatgcatggttattcgtgtaacacaactaaaaaacgatttttttacgcggactcatataggttgcaggtggaccgtagctgatcacgtcggcaaaaatcgacctatattttcgcatacgactcattatgaggccctcatataaagatctattttcacagacgaggctcttaaggatcacctacaaaaataagcctaatttcgcatgcgagcctcttaaatggtccgcatgcaaaaatacctcctcttctccacaattttatttcttcctttctctctctttccctcctcatcacttcaaaaaattttctcctcctatcctctctcgccctttttctctcctggtattattttttctctcctctctctcttcctctcctctcctctcatatgagcgggagctggtggcagtgggcggctgtgctgccgctcgacaaggaggcagccgggaaagggtggcgccgccgccaacgacgaggaggcggctaggagtggtgtcattctcatccccacccggtgccgccacagccgatgaagaggaggaggcggccaggagcggcaccgccgccgatgacaaggaagcgactaggagcaggcgactaaatcccgatccctgcctgacgtcgctgtcgtcgccgatgaggaagaggcggccagtcgcgatggccggatcagccaccgctggcgccacaatagcctgatccgccatcgctggcccagcgacggccggatctgccggtgccggcgccacgacggccggacctgcgctgtcggcgcaatcgagagctagggtttcgctttctcttttttctgagttttttattatattttggctttttattttttaaatttggtcgacataagtactaattttcgtatgcgggcgtgccacccgtacgcagacctttccgtaccgacgagcaccccaaccgtatgaaaaaataggtttttgccatggctgtccatgagggcgcgcggccggagcaccctcacaggaccccagtcttcgagggcccctagacttaaaactctaacactagatatatagcccaactagtcctgaaaatctattattttctttttcacgttgtttcaatttcggtcatgcatccttgccaagggactatctaaaatactgccacaagttctttaaggaaaaaactttcaaatctaactatagtataaatataataaaattccactataactttattataactataatataacttatatataagtactaaaataatatatgtaactttatatctaatttatatagagactacaatgtagttacagtgcagttacactgtatttacaatgtactccctttctttcagggtataagacgttttgactttggttaaaatcaaactgtttctttcaagtttaactaagtttttagaaaaaaataataacatttgcaacccaagacaaatttactataaaaatatattcaattattaattcaatgaagctaatttggtattataaatattactataatataaattttgatcaaagttaaaacgtgaaacggaacggagggagtagttagaatgtaacaatagtggtgtaactacattagagttacacttcaactatacttacatttgaaagttttttaccaaaaaaaaaattgtgacagttttttagcaattccgatcgcgaattgtgccgcttcggctctcgagcaatcgcgccgcctgcgcctgacgccgtcgctgcccggccgagagagaatctcctgagtccctgatgaagtgacgagtgacacatcgacgcctgctggctgccggccttgccgcgtccctgaccggccagccgtggtgccgcgcagcgcgtgcccaccgcggccgccggactgcatgtccgcttcactgcttggtgcttggttgcttgcagatgattgccttacttcctggtaatttttaatccggtaaccctcgtgtcgcttttcaagtgaatattattgtatatcattttagaccattttacattgctatgaaacgtattacggagtataaattattgtaatattatattattattaattatgtttttatctttcgttacgactttttgcacatgcccctgaatttgatgggacagccctggttttggccgtatagaaaaatatttttttaagtactagtgtaaagacgctctcatgctcatggcttcatggggcacgtgcattcaccacagttccaccccctttcttgagtatccaatgagaatccatgtgctcactcgcttgcttctggcagacaaaaaaagtagcatagcatatgcatgcgacattctgtcttcttacactactagaaaagcattatcacaagcggccgaaaagagacttcgcaggcggggcgaccgtccgcctgtaagccaacgactgtgaagatcgccgatctttgcaggcggggcggccgtccgcctgcgaagataatttttgcaggaagacgttggctagtccggtctgcctgcgaaaataggaatcggccgcttgcaaaaaaaaaaaaaacttccgcctgcgaagataggtagaaaatattgaaatttaataataatttgcccgtaaattacttttaaattatttagtagaaattcttgcaggtagattattatgtacatatattggaagattatcaagcatttggtactgagaaatctacatatattgcataactcaaaagtgttgccaatatatatatatattacaatatttttttacattgtcacttcaaataacgtcatctagttacattatggcatagcagtgttccactcccgaagatccttgaattcgtcacttgccgctagggcaccctctgggccgaagaaatctcctttcacatgacaacactcatggcggatgaagtgacacagatcacgctggacatttgtgatacctgtatcgtcaaagcttgttcgacattctaatcttagcaactacatgcattgaaattaatcaatatattagtatcataaatatgtggagctgtctagtacatagtatagagacttatatcctccgcgttagtcctgtaccgtccattaaccctaaggaattcgcacgcataatacccgcaaaggaccgttcctcgcggttacttgtgacacttcaggacatatcatagaaaaaagtagttaaaatttttaattagtgaaacaattggaatacattaagtgagtggagtattaccagccaataggtacgtactagcagcttcaaccgtgttcgggtctgttctccacccttgaacttgtagtattggtatgcactgtatggatgtcgtaccatttcacagtaaggaggatatttatttataatacattcatatacaaatgcaagagtcataataacttactactgtaagattgttagaaattctttgtattgcttgtgactgtaatcgagagggtccaagactaccacggttccgtctttagggtggatgagtaaacagatataatgatcgctacatattaacaacaatatagttagttagtaccagctaaaataagagatatgtgtacaagataaatataccggacttacttaaaattataagcggccatgacgactttcttattttgaaagtgcaagaaggctcatccaatgtactgtgcgacagcaatcaatttttccttgtgcatgcccttcttgtattctgctatctcttttggattcttgcccttcagctggtcagaccttgggtgctagcctcacggtatgctgtgtttggcagatctgagttggatccaagaagtcgatgggttcttttttattcttagcatccatgtattgcatcgtacagaagaagtttgttagtaacaatcacatggatttgtattgtacatatttttcatctaattatttaaaactcatactcacatgcaccaaacaccaacgtagttgacgtccatcttatcccgacgatatatggcgtggagatctgagaaatctagccatacgtaaccttcttcgccgaagcaatctgccggtgatcgagctgttatattgcccaagcctttcttgctggccttcatgtagaagttatgtaaccttctcatctcccatggtccttctttcagtgcccattccggcaagagtggtttcccatgttcgtactttttcgggcaatcatcagttgcgaagtatgttggcccggtgttaacaaccaaatttggtaacatcagcgtcggagagaagattagatcgaagcaaagtcggaagcgaagatcgagttcggaaatagagcaggaatcggctggggttcgtatcggctacggttaggatcggctgagtctgagtcgagctaaataagccgatatagccgattccgacaatatgacttgtacgcgacatcgggttcaagttaatgtacttcaagatgattgccacgcatggatagagtcctgggaaggcaattgtatctattaattaggatattttatgtaaattccttatagataagtgtgggcaaaagtctgccgcaaagacttattagatcttagagtttgttagagataatggtcgtgtccggtatgggcatatcttgtaatcctcgggtataaatagaccctgagccctatgtaatttttaacacacgttcaatacaatctcggcgcatcaccatccttttgctttagttttgtttcgacgagttcttgctttcgggttgagctgcatcgatttcgaacttcaacaagaggtaacattcgttatgacagattgcgttcttaggattagtgcttccatcttcatgatactctaatcttgtttatgtaattcgtcaagttatcatatatcttacataatctctagcaatatcgccatctgaactactatcggccaatatctgtatgcagaaggcagccgattaggttagatcttgacgttgatctggattatataagatatctaccattctatgaaacttctagcggcttgattgtctagatgttgctcttcttttcatacttaatgctgcatcagttgagtttgatctattaagtcgtgttagaatatcaatctctagcctgccttccagttgccgattagaatagcatcggagtttcagccgatcgtatctgatttagccatatttattctacatgtctcattgatatgctaaatctgccctttatatcaagatattgctgcatctaaatatgttagggttttgtttgatatgttatatctgctttaatatcctgatatagagtggtatcgaagtattagccgatacacgctagatctatttgatcggctacgctataaacatatacagtcctgttattgacatatatttcgatctaagtgatttatactgtctcggcatgatgaccgatctatcccagtcacttgatttaagtatatatcgatataaggagtatatatcgttaatatctatagccgatcgagtagatttagttcttccttacttattcatgactgccgatcgatacatcgatgacatcggcccaaagataaatgatatgtcatcagcatttagccgatcggctatcatttatagatttaaccacggtttctttgcttctatttcttgttgattataggatcaaatcaactggcacgttaatacatccgaaggcgagttttggacatgcactggagttaagcagatctctcaggccacgtgttttctgtcaacacccggctagttcagcagccttctgggggtcgtcatctctgaacttagcatgttccttaccccctctgaagacggttaccatgaacttctccttgttctcatctttggagttggagtcgtggctcctaagcactcgtggcacctcagaactggtagtggccttctcagggaccgtggtctcttgcacctcggggtctttcgcaggagaagggtcttcaaatatttctggctctgtaccgtcccattccaatcctggtacttcttctatttctgacccgactgatgccacaaattgcacctctggttctgccactgtaatctccatgggcacatccggcactggaatctccatggctgcctccggcggtgcaatctccatagctgcctctggcaatgcaatctccggtggcacttccggcactggattttccttttgcatctcgggttcctccgccttatcaatcaccttcctcttaggaggtctcggaggttttcccaaccccggtttaggcaccacaggtttttgcgtggcgtcggtgcccaatccaaaggatatatcattcttgtgccaaagaattacaagatcaaccgcatccccagatactaatacaccatatgcagtcaggaagtcaatgtcgtaggactcaaacctttcctggaccacttgcggctgcaccttggcatacgcatcgggtatgaacttttcattgtatgttctcccagggatagcactggctgtagcggcctcaagagttttcccggagcatccaatgggaacgtgcaatctgtagggtgtattctccttgaggtcatcgaaggggtaatctggctcaggttctttggtttcggggcaaggcaaaagcatgtgcttgatgcagaaatccatcatttgcctttcaaactccgcagccccttcgtctctaagtttatccttgtacgcttcacgcttcttgtgggggtcatttttgaacccttccttccaactcatcttgctcgacacacctcgaacccttcccccatgctcaggagtacctagcgccgtacttagcacatctttctcccttttaggcttgaaagatcatttcttttgtgaactagataaattttctattttatcggcaacgctttacagctccggattttcaaaagatacttttccttcatccgtgatcttcggagttctagctcttacctagttccttgatctttgtgtccactcctccattggtaccggttgccccttcttcctcatttcctcctcctcttttgtccactgctccacctttggtgcatatcccgcggagcctaagtgatgaggaaatttgttcttcttggccaactctgcaaacatttggctcctttgaatttcttctgggaagttcttcaaggtcagaaagtcgtcccactgattgggggttatgttggcatacgtcgaaaatggtgtgcatcctgtcttcacaaatttcttgttcaaggtggttttccaaccacgccaagacttggccattgtttgcaatgcacaattcctcactgctgcctccgatccatctgagaactggaagattttcttcaactttttccataggacttccttatccccattcgatacatgatcccagtccttgaccgtgatggggatcttttcccttacaattatgccacactgtgaactgaatttcgcatgtgccgtcttaggggtgagcggctctcctttaggcgaaacatgggtaacaacatggaacccttcatcctttctattcacgcttctctcgcccttcattttcttcgcctttgctgaccgttcgcttttctttgtgccgtttgtgttagctggtacgtcgtcgtctttcgacggaacttttttcttcggctgccgttttgatcgccgtggcgccgtttcctatgagaaggtatacatggaagtttcgaattagctcgggctaatagttatcacggtgaacattttacatattaagtttacttaccccttctttagggggaatgtagtccttgtcgccttcttcaccgtcgccctttttccttctcttcgggcttgggcttggacaaggatcgcttggcgacgagtactcctcgtctttgtcagctacgtcgctgtcggaactaccttccggtgggactgttggttccggagcaaccacaacagcaagggactgctcttgctcccctaaacccttctcttcagtccctttagtactatcggtcatcgtttcaaacctctaatataaaaaaaaagagttatcagccacattttaaattactcaaattagtacaaacaactttgtacaaaaataaactgtatattaacaatatatcgtatgaacaaatttaaattctctgatattcccaaatttaactattatacaaaattaattagtacaaacaaatttaaattgcaaaatattattaattagtacttactattatgctaaattaattaatacaaacaaatttaaattgtgaaactaatgactacttactattatcaagtagtgcactaattgacagttatatttcatcgacatgttgattataaaaaattgaaaaggcaaacatatcctccacatttttttaaaaaaatgttaacataccctccaacatgttatttaaaaaatttgacaaattcacatatcctgcaaaattgaacataccctcccaatttcattcacatatcacccacattcccaaattcacattcacaatcaacatataacccctcattcaaatatcacccacccctcatgcccattcacacccacatgcacacacatatataccccctcacacccacatgcacacacatataaaaagaaacacccacatgcacacacgtccgtgttcgacgaacagccgatgacgagcttcggtcgtggacgacgaaggaagggccggcgacgaggtttggccgtggacgacgaccggccgaagacgtcgttcggccgaggacgtcttcgctcgtggacgacgatcggccgatgaagccgttcggtcgcgagcgagatagagagagaggtggcggccggcggcggtggaggggcggctgacggcgcggtgaaggggccggcggtggttgaggggccagcagcagccgcgtgcgtggtggaggggccggtggtggtggaggagccggcggtggtggagcgggcgcgcggtggaggggtccgcggcggcggcggcagagtggtggagctcgcgcgcggtggagcggcggctaggggcggcggtctcggtaacagcgcgtggacgacgacggtcggcggcgatggaggacgacggtcggagagtgaaggtcgcaggtgggcggcggcggaggacggcggaggtgtgcggcggcgaaaaaattcagtagcctgatggcgccaaaatttctagggttcccgcctggatttagaaattttggcgccgcgggcttgcccttatatagggcaacgatcttcgcaggcgggcggtctgcctgccaagatcatcttcgcacgcgggccgtctgactgcgaagatgtaaaccctactctatataacaattctcgcaggcggaccgccccctgcgaaaattggtacagagttgaatatatttattccaaaatatacaaaccttaatattattacaaaatatacaaaccttagtattattacttttcaaatgtataaatggtaattgcacataaacatattactaatttaaattttttaacaaattttttacactacaaatggtaaaaatggtaattgcacataaaaataattacacttttcaaatattactaatttaaattttttaacaaattttttacactacaaatggtaattacacataaaaattagtacaaactaattaatatgcaaaatgttgagtacaattgttcgtcaatttgcgatatgatcacacatcaccttacataccatcattacataactactaacttcttagattcttacatgccactcaacaatcattaccctttaacatttttgcccacaccgttcgtgcgcatgtaaggcttcacggtcttctgagtagatgtctcgacattcttaatcttctgtacaaactgacatataaagtggcatactatcgtattggttgtaatcttcgacatcttcaaccccatccactcccaatatcttttgtttccctggtagcactatatcttcaaatttgaagggtctttcacataaaacacttgtgccacgcaattggcgagtacccaagggtcatccttgtgacccacactcgtcaggtcaacaacagtaagaccgaatttatcaacattgaccccgttcgggtattttacccattggcacttaaatatggggaattgcattgtgtgcccatagtcgatttcccatatttcttcaataaacccgaaatatgattgtttctccccggcttcatcaattgcctccacacggacaccgctgttttgcgtacaagtcttattatctcgggctcttgtgctaaactagtatccattaatgtcatatccctgccaagaatttactgtagttgatggaccacaagccaactgcttcatagttatttcattggtagtttgtccctcaggtaagtctaggtctcgcaaccaatctatgaagagacgcttgtgttctttcattatccactcggtggtgcgacctttattgttagcttgtattagttcgatatgttgatcgatgtacggctcaacgatagcaaactgatgaagcacgctgaagtgagcttcttggaatgatttgtgatcatgggtgacgaatctcttctttcctatcgttcccctgccactcaacctgccctcgtgtcggggcacaggtactccaattgcatattcatctttgaggtaatcgatacagcactcgacaacctcttcagtactataaccctcaaccattgatccctctggatttgcacgatttcagacgtaactcttcagaaccgccatgtaacgctcgtatgaccacatttgatggaggtacaatgggccaagcgcaaccatctgcggcactatgtgaacaatgaggtgctccatcatatcaaaaaatgacggagggaaacacatctcaagttggcaccgtgtctcatgtgcgaatgtacgtagatttcctaactcttcgagactaatgaccttctgtgacacttgtgttgaaaaagtagcacaaccttgtgatagcaacctttaaatgctccggttttatggcccttattgcaattgcaagaaacacggtgagcaagacatggcagtcgtgtgaattataaccagataccgacaaatctttcattgaaactaatc

SEQ ID NO: 1343 - DNA, 5931 bp, Oryza sativa
agagagatttccaagcctagtcaatactgataatttcagagcgcaatttgttggcagtgctaaacgacgcaagttgattagctttgtgacatccggactaattgctctcaaactcgaacgccttgcatcaaccacttgtaagctgtaaaggcgccagaatttctccggcaattcctttacacagctatgagatatatcgagataacggaggctgtgcaactcacctatgctctcaggtagcttgacaagtttgcaaccctgtaggctcataaataggatgttggagagctgattaaaccaggtaatctcgaccttgaggttgatccctaacctaagtgaatgaagtttattcaaatactgaatgtctcttagttcactcttcaaggattcatctgcaacctgaaccgacatatggcgaactgcatgtagctttctgccctcgttccgagagctcaaatcttgcagcaagaggcattcgttcacagaaacagactgcgccatatcatggatcaagtcatgcatgacatatctactttcatccgggtacttgggatcgatttgcaaaagaaacctgctcctcaaatcatccaaatacctaatcccaatatcttcaggacgcgtcctctctccggatacaagtttcacaaggctctctgccacccaaatgtcaacgatctcatctcattcaaagctataatcttttggaaacatggagcagaatgcaaagcatctcttaagttctcgtgggagatataagtagctcagttgaagggccggcaatatctcattctcttgatgtggcagctcccacaattcacttttctgaatagtctcccaatgtcgcacggttagctccatattcaacaagcgtccgagagttttggcagccaaaggagatccgcataaccgagaagcaatgctctgaccaattttatgcaaattattacattccgaatcagctgggcgcttctgcccaaatgcacagtccttgaagaaattccaaaatttatcttcatccaatcctttgagttcaaaaggttcaaagttgttggtgcaaacaagattagcaacattttgtaatcttgtagttactaagatcatactgcctttaagtccgtccttcaagagtgcattaagttcttcccattcacgattagtaatggaccaaatatcatccaacaccaaaaggaacttttgactctttagcttcttcttcaattcctcctgaagatcatttgaactatgttgtgatgagtctttcttggtgatggacttgaagatctcttctattatccttttcttgtcaaagaggtctgaaacacagacccatgtcctcatgcgaaagtgagatctcaccctctcgtcattatagatgtactgagccaaggtagtcttccccaccccaccaataccaaatataggcaagatagaaacattgccgatgcatttggattgagaaattctgggtccagccctgctactctctcctttcagtcgcttcggtgtggatgctgatttggcgacagtgccccctgctgctctctttcctttagctcgtgctgcaacaaacctggtgagtggcacacccatcttctcaatcactaaatctcgttcattgtcacgtccaatcatcacacctagcttctcaatcactagatctcgttcttcatcatgaccaaacacttgaggcacgccaatgactgaacttgtcactggcatgtgttgaactatctcaaaattaagacccactgaattaagctctccctctaaatcagccacagccttgttgagcttatcttggacctcctttatccttgtcttgctaccaccgatcaaagtttgtacaacatttagagaggaagagaaaaattgacctgccaagctccggtcagcatcctccatcttctgccatagcacctgatcattggactcgcggagaagatcctccgcgtcataggtggcgtccttgagatgccagagaagtgccgccagatccttgttcttgaacctgccccactcgccccgatagatgacagcgcgagccttgtccaaagagaccgggaggcaggatagatccttctccagcttgctcgcttccccaaagttgatcatggttgagaccgcttcgcggatgttgatcacgctttgcagcatctccataactgccgcgcgcagcagtccttgctccctctggatcttggcctagacttgtgatctgattgagcgatcgacagtactgcagggagactatgcggtgggtggaaactggaaagtgagcacgatacagaagctgagatgttaagtcttgactatagtcccctctagttcaggactcaagagagagagagagatgctccttcccaaattccaataagccttcacatgactcatacgtcttttgatcaacgttctgtttatctaatacttcagcccactgtctttttctgtcttcaaataagaaaaactctactttgcacttgaagattccatctgtccgatctcctagttcagtgctttattagttgtaatgtaaaaagctgctacatctgtttttattagttgtactagttcagtgctttggctcttactctgtacaccttttgtaaaaaaaaaatcttctattgatgaatatagacaaatgcctatttatgtccatcctcagaagttgatattttataagacggagggagtaaaacacttaggagtatctttctccatccccctttgttaattgatttgctagaactctcgtcttcctatagaaaagaagaaagatttcatttgcccgtgtaaatataagtgcacaacccacgagagaagaatatcttcctgtaatcctaactggaaccatttgttcaagtattttttaaaaacaatttaagtcttaacgcattcttaattctaaatcccaagttttagagtttacaaaaaacaacaaacaaaaataatcatataaccaatatatatctctacgccatccaattctcaatgcattacacatatatacaaaatagtatgtggtatttttacggcgctgctatacatacgattcttttttacgattgttgtacggtaaaacgcttctttccagcggttgttaacgatgaaatggattcctcttccactattgagcccatatccaaagctcaagttcatgatgatgtcttggcctgctatatcataaccctttttttttgataaatttgtccttttcaaaaacttatttcgaaagtagtcccaacaaaaaacttcaaccaaaaataagccatcggctcagcgccagagaagttggcaccgagttcctacatgaccgtgccacacgtgttggcgctgaacccctgctaacgtggcggccgagccaatccccttcgacgtggcagggttctcagcgccaaggcggttggcactgagacggctaacctcgccaaacgcatttgcgttgagcctgcagcctatagatcgcggccgagccgcccaggcccggcactcccttctttttatcctcgcggctagggttcatccacgtcgccctctctgctcccctccgaatatctcctcaaatatccctcaaatcgaaggctattttgtacgcattgcgttggagattgatttgtaaggtaaattccctccaaaaaccctaatttccccaatgttttcatcatttttgtagagtattttggttgaaaccgtacgttattgaatgtggctcgggttgtggtgtgaattagggaatatgggtaagaatgcaatgttgtagttgtatattgatgttcgtatagaggatacatattgtttttgcaagttatacactattttgctaagggtgaacttgggagggatgtatagtgccgttgtattgtgaatattttggggattcatactgatttatgatgatgttgataggtatagatcctaggaacattgtcaccggggggaacggctcagccgccacgctggcagggtgttagcgccaaggtggttggcgctgagtcggctaaccttagcgccttcggcccgtgcaccagatctgagagagggagaggggtggtggcggcgggggaaggggaggagggaggagcgggggagaaagacctggatccgccgcctctcaccttcccgtcgcccgagtggtcgcgccactggatccgccgcccgtcacccgagccgccgcgccactagattcggctaccgcccgtcgcccgagccaccgcgccacctgatccgaccaccgcccgtcgcccgagccgccgcagctcccgatcgaggcctaggcggcggatgagcgagagaggaggcggtgggagaggagtcggagagaggaggctgtaggagagagtcagagagagagaggagggaggcggtgggagagagacgcgtgaactttaatggcgagaggtgggccgtgggcggtggactttaaaagcagcggtactctgtaccatccgccagtaaaaatgtgattttcgttggcagtgtattgagtgggctgctagcaaaaatggctacatctttactggcggcccgcttagctcggctgccagcgaagatttgttttcgctggcaatccgtagccctccacccctcgttacatttttgctgacagttttcgtatttttccgccagtaaaaatcatagggcaacgccatgaaaaatcttttttctattagtgtgtgctcccgttaggtacccagtgccttctccgtcatttacgtttgctcgtatcaagatcgtaagcgaaagtcgtacgtgtagcattttccatagtacaaatattaacgtgtgttttgcataattaagtcttggttttgtgaaacatgttgtctcaaaatcaagggctccttgaaccaaattagagatgcttgaatcatagtcacggtgatcttgctagaaaactcattttcggagtcgtaggggatcgattttagcaggcgggcatgtaattgtttatatggtccgcgtggaagatcaatgttcgcagggtacgcttatatggtccgcctggaagatcgatcttcgcaggcgccgcttatatggcttgcctgaaaagatgcccctatatagtcttcttcctccccgagccctgttcattctcccggaagtttctctctcttaaagtgacctaaatataggggggaggttttgaacttcaattcttcgggggatttttctacggtacttagatctactcattttcacactaggtatgcaattttttaagcttttataccttaatttgtgatggatttatgcatgcaaaattgtgaaggaagagctccatgttttttaattttatttcttttgatatgttgatgttagatgtatgtacaatacttgatgcctcttgttgtagtggtttaatgtggtaacataaattctcaattttttttatttttgctatcacatccacctcctagttctagatctagatctagatcttgtcatatatagagagagaataaaattttaaatgtctatttattcggtgaaatcaaaaaatagttatagtattttgtaatatggcgatgatatgattttgttagattttcctaatgtactaatttggcatgtctgtgtaaaaaaaattgaaataaactttgattttttattaatttacacttaacttttagttaattagttttgaatagcgataagttttttcaataaaccctacaaatttggtattaattgtgcaaatattttacgtgtattcttttagagatacggaaagtcgggaatggatgtatcattggccgagatttttgtctccatatagaaacgaagtgtctaaatttattggtattgccaaggcacacgctgagaagaacaatatgaggaagataattggtccatgtgctgactgtaagaatgaaatagcctgggactttgacgatgcttttaaagtgaaggagcacttagtaactcgtagattta

SEQ ID NO: 1344 - DNA, 757 bp, Oryza sativa
agtagtccatcatgaggctgatcaagaaaaacttgacgcacacggaaaagcgcgagagctcagaaaacacacgctgagccccctacctggcgcgccagatgacggagcgcggtgctcctcaccgggagaccgcacaggcccccctttgccggttcggccgggggctcagggtgagatctcaagcttccgtgtatgtgggaaagatcgcggcctctcaaaagagcatgaaccacaagcgatgtatacaggttcaggccgttgagaagcgtaataccctactcctgtgtttggggggatctgcgtatgaaggagctacaaagtgtgagccaacctctccctcgttctaggttctgaatctggaaaagatcatcccctttctctatggatgcacagaacattttacatgacccaaataaacatactaatgacactgattaaacaataaagtaatgcgtaaaataaatagataatagtaataagcataaagatggcatcccatcgaaccaagacatgacttaatgcatacctcccattaaataaattctcgactaactatcaaatgaaattccaattgaccccaaatctatttacccaaagttactaataccctaaactgacctaaattttaaatatctcattcgaattagcgatcaagatttttccttgtaaaccaaggaagaaaattctcaaattttccctgaaacaaatccaaatgccaaagaacatatgcgtatgaaagagtttaagtgagctctta

SEQ ID NO: 1345 - DNA, 314 bp, Oryza sativa
ttgtaggtggggtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtagaacctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaaga

SEQ ID NO: 1346 - DNA, 6675 bp, Oryza sativa
agggcgagcaatcgccaaacagcatttccggaccgagccagcgccgtgttgccttgcaccaatcccgcgcacgctcgcgccgagctcgtgccgccccgcgcgcgccacacgcccgcacacgctcgcacgaggacgaacgacgaacgaatgccgccgtgacacctccagcttcccgcctccgtatctccttcgttccttaactagaagactcaataccggaggcaaaagaagcgcaatttaaacctctttcacctcctcaaatccgcccctacccccgctggaaaattccccgaaaccctaatatcggcgccattgattgagctccaaaatttgtcgcatacatcgcaaatcctctgaaattgaaggtaaaaacggattctctatgccgagtactccctttcccctctcttcccccatctaatccgacgccggagtgccgccggcgccgcctcccggtgtcgccgctctgttcggccacagctccaggccgccccaggccgagctgccgccaccaccgcgctccccttgctctactgatgctcaccatagccatcaccctcaccgaagttcgctggaaccaccgcgaccatggccgctgccgcctcctgctccaggccgccgccgcctgcaccgccgccaaccacgggaacagagtcgctgcaccctgtagatcacaaaaccggcgcccctttgcccaaaaccggccatctccaccactggcgccatggagttgtcagccgttcctgtgcagagcgagagaagaaaagaaaaatccgatttttctgttgaaaaattaatcagaaaaatcctttttatcttcctatcaagttgaccatccgtttgacctcaaaatcaaaatctgagacctattctaaactcctagaattattccgaatccatgcgtgtcagtttcgttgcaattcaagcacccgttgtcgcgaccctaattttagccctagggttcgccgttcaccgaaattccaaaaattatttctttaaatccttttcacccattgttgcactttgtgatactattttcttttggttatctttgtttttctgttatttattgtggtgatgattgttgcgtaaatagaaaacgctgacgctggtccggtagtcggagcgagtgaaatctccgcgataggaggagacggtttgtacgactacatcaagcccgaaggttgcaagatatgcaccctcccttgaacaatctaatcccagtagttagagagttattttggtagcgtacttgtcctttggagtacgatagactgcatgaatccttttaaattaattatattactattattgcattatattttctgttgttattataaacaccttaatgagccttagagtctaacaaatttaggataaaatttgagaaacacttaaacaaactattaattatttagcatgctatcgatttagtatggatattatcattgcatatgaaaacatgcttatggaactatttatagctatatgctaagaattgttaacaccgcttgtgagcggatggtacacatgatagagttcatgtgtttggttttatggacctttttatggttgtgatggatatatggatatatctatggttatttcttatttaaaattgatataataatcaacccccttgtgtcaataagaatgacatagtttcgcccatccacacgatcgatttgtagaacctggtcgtatattgctccaattgattaaacttctgaaggcctttcggtgtactggccattagctttcaagtgtgtgaagcaaagtgaaatggttcatgtttatatgatttatatatgtgggctcgatgggccctgagagttcagaactaccctatgggtccatgaagttctgggctgcccatcgaataacgaacaatggtaagtggatgcagaggtaggttggtacacaccttggaccggatcactccgagcaacatcccgagcatcctttaacttactaggcagaagggagagatatatggagcaatattacaccttgttacttttcagcccggccagctgtgggtatcgtgtgggtaaagctgggcagacgctgcagagtcgttgagtattcgaatacgccgtgccacctcttacaaatgttcttatatactgcagacttacagttcataatagtattatatatatcctctgtatggtgcataaattcagatttttatgagccttcagatttttttttactctctcagcttctcatgcagattaactgttgtattccatgtgcagaaaaatttacaaggtctgctccccttgtccaacaactatttgcataaatttcccttgaaaaaaataggttctagccttctaggcataatttatagcaaattgaaatagatatttgctgcgtgttgaactttttagttgatgattgaatagtttctggaaaaggtaaaaacaaggagaaaaggaaatcccaatgttgctaatgaggcaatataaaaaaatgctatattgcaatctgctttgtgtaaaaactttttcaatcttcaatctaactgttattgtgcattattatcaaccaaatgaagagagggtgcaacctggaattccacgaggtagatattttacgtggcgatcatgtgaattaagaccttatgttcatgggctttcattggaaaatttgagtcattaatctgataagatttcgtcctagcctattcttctccaagcttagtaaattgggtttcacttatttataatttatcgtttaatttttagcctttgattaaatgtcttgtactgaatcacgtaattttaatgtgtaagttttgcaagaatctctccaacaccttaaatgatgttgtttggaaatcagatgatcttcaaagtcaacattcctagagtaacttgggagagtaggattgtgaactattagcataccattcttttgaatcaatattcctacttctagaggcgagaaaaggagaaagcatgtctattgcacttgtacatgtgaatgaccctgtaaattatgtttggtctccactcctgttgtatgtgttgctattatcttttagagaacctttctgaaagcttaagtgaagctgatcatgcaatgagttttatttgttagtaagttttatgtgtaaacagtatgttgcgaggaacaagtatacttattttttaagataatggatttatattaaacccggcctttacacctgtgaaagtaaacttattggtcagcatcattttcatttacactgtaaagttgttttcattctcagcaggaatttcatttctgtttatcaccgttgcctaatgaaacagtgcattttctgtttgtcactgttgtcttatgaaacatcaccgtaacgttagtacaggcatattactagtatttataattagtgtcaaaacattcgatgtgatagggacttaaagttttagtcccatctaaacagggtcttagctgcgtggatggtgtttcgggctttttgggcttgggaggcacaaggtttagaactatcagccggtgagggaaacacgaatttttttgagaattaatattatttttatggaaaattgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggacctgtcgaacagccccgttcgacaggcagggctgtcgaactgcccctgttcgacaggatgtccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatctgaagaaatttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgttgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggatgaccgtgagatgtgtgggccgcttcgtacccgcgacgtgaagaggatggaccactccgatccatgctggaacgtcggggtagtggtggtgatggccgtcggcccgacgtctgcaccacatctgccgcgctccgacaggagacacgacgtagtagtgcggcagcacgtgcacggaagttgcgaaggatgctcgccacgtcgtcaagcctgacgactggaggtcttgcctctagtctttgcagtagggtgtcggactccacgtgaacatgctcaacaaattccgcctgttccacaaataatcaaggcaattaaaattatttaaccagttacacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcgataccaatgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaatgtaggattaaacaactgtgatgtgaactaacctatgaagactatcagccaaaggacgaccatctctcggagggaagtccagatacatgcccaactgtttgagaaccctgtagacattgtgtggctcgacgtgcacgtccaccacgaggtgacaagtcgtcatccagagttgcatatctcgcgtgcaaagatctgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaaatacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagttatcagcagccccaacaaataagac

SEQ ID NO: 1347 - DNA, 1835 bp, Oryza sativa
gatcaatacgccaatattgatccggtcctggcatctttagcacattgcagaaagttcctgtaataagacgtcgcgatcgatggttcctatcgatctccttgtctatcagctgcccatcatattgatcagccatacctgcagatcgaaagccacattagtacaatgcacgtatggtaacagtacagtaaatgtatgcaacataattcaagtaacaaatttgcatgccatttcaatttaaaattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaaagataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccacaaagaatgcaagctttcttacgacgagaacgatctttcacttcagcttcatccataaggttcttgatcctgcgcgactggcgacgacccttagtatcaactaataaatttgagtcaggaacccaattggcttgccctggaggaggacgaatgaaatcgcacaaggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaagtcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaataacggggctatacttaacactgggtttgctaaggttcagactagccatggaataccttttacagagatatttctgtgtacccctcgtgatgccctccaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactataggttttttcctaacatcttccatgtgtgtagtggtcaaacgatccagttgatcccatatggcatcaaactttctttgttgattatgcttgcataacttcttgaacaggtccatcaatctcttactcctgaattgtctataaaaattaagcccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatag

SEQ ID NO: 1348 - DNA, 6568 bp, Oryza sativa
tttgaatataccatttgtgccacaaatgccgctgtcaggtttctgtgcaccagacgggtattctccaacaaacacgtatgttgctcaactctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgttgcatcaacacgcataggcgaatccggttcttcatcatccgagtcgttggcctcacgattagtaccacgaacaatgacctctccttgtgtattaccctctactacttcttcccctcgaccttgctcagtccgccaaacattttcagcttgtccaccttccaacgttgtttcttccaccacggcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccctaaacatattatacaaccaccctaacacgtcgttcaaacccatatgctccggtgcattagactagtatcatgggaaaggatataccagtccaaacccaccccgttttacaatattgggttaaaaccatccccataatacagacaaatgggcatatcacctgacatccttgatgaaaatgaaaaaatagtctcacgtttaatcatttaatcattcataattaccctattacacttatactacattagctagtactaatttacaactattagtaacaaacaactagtttaataatccaaataaaatataacacctttatacctattttaacacataacatatcaataatatgtactaactaacaactaatttaacccgtacaattacttaaatacctctaccaacatttagcaataacaaatatgtgctaaccatacatactaacatcgaacaatgcgaaacaattaacaactcttaaaccaattttttattaaactttcatatgcattgtacttatggattactaatgtataccttaacttcactgctagagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaactcgcggcctgggtggacggggctttaaaccggcctgtcgaacgcccattgttcgacagggtcggtggagggccatgtcgaacgcccccggttcgacaggcctcgcggcgccgggtggtgggccctgtcgaactccctccgttcgacaggtgagcgtgtcgaacgccagccgttcgacagggttttgtcgactgcccgtcgttcgataggtgccctatcgaattgcacccgttcgacagggacctactttcgcgattttcccccgttggccactacttttgcgattttccataaaaataatattaattctcaaaaaaattcgggaaacactgctgtcttgctcctgagcatgtgtactaggtgacatagctgagacacgtacaaagaaattgaggcgatttatgtgtaggtgggtgttagctctatggttttgagattacagcggcaaagcatgaaacgtattgaagtttgtggtgaaaaaacagtataactagagaagtagatatggaatgaatggttcaaaatgaaccgttgcagagagcagacccaaaatccggatcctctgcgtcacagttgatcaatgcaatgaacggtactgtagatacagaaccatttggctaagagaaataagtatgttttgaagattaaatatgatgatattgttgtacaagtcattttagggaataccaaaaggatgagtagaagtaaatgttatctcactaatatcttagtctttaaccatgaatgcctaatataattcttagtacaatgaaaaatcgcatgattcaataagcggcgtataaaaaaaaagttcattggtatcataacatgcttagcagtgtcataatatgctaactatacttagaaaaaaattacgaatatacttattttttcaataatttacgtttatatacatgcataggaaggaattgcaaaaatttacctgtcccgcgatggtcccgcagctccaaaatacgggaccgacagtcccgcgggacagtcgcgtggctccgcgatagtcccgtagctccaaaatacaggaccgtgatagtgagcaattttacattgtttttagtactgtttgacattgttcacgcatcggtcccgctgttccattgtgcggaacgaatcgtggatagtgtcgaacagtgccaaaacagtgacccaaatagtggtgaacagtaccaacacagtaaaaaatcgctagctacgtcagtgctgcgttctggagccgtgggaccacgacgatcccgcgttttagagtggagctacggactggcacggtcccgcgtttccacccctcggaccattgtgtaagttcttggagtcgtatgggttgatgtgatggagaagaatatttagtccgatgtgtgataaactgagccacgtcactgacagtaacgactgccacctgcgtattcatgtggtgaatgactgcacactactcgtggccaaaatgtgatgtagttggcaaggtgtaaatagcttgactataaaatccgatggctcttccgcttccctagcctgaagtgataaattatgcatagttgattccctttctcaattttacctgcgtggatggtgtatggggctttttgggcttggggaggcagaaggattaaaactatcagatattgagggaaatgccgttcttggtcctgagcatgtgtactaggtgacataggtgagacgtgtactgagaaaaaactgtggcggtttatgtgtacgtggctgttagttctatggttttgagattacagcgacgaagcgcgacacgtattgaagttggtggtggaaaaacagtgtaaggtggtgtttggatacaggtgtccactaatttaaaagtattaaatataaactatttacaaaactaattatataaatgaaagctaatttacgagacaaactttttaagcctaattagtttactgtaacatcacataggctaattatggattaattaggctcactagattcatctcgcgaattagtccaaaattatgaatagattttattatagtctacgtttaatatttataaaagttttagtcccatataaatagggtctactatagaattagagatcagatgaattgttcaaaatgaactgttgcagagagcagacccgaaagcccgatcctctgcatattagtgcagaggttcactatccatgtgagtattacagtagaccaacgcaatgaacaatgttaatttactgtagatacagaaccattaacactctgtcgcactatttttttgatcgggtggctgccaactcacctaatgtatggtactcctaacatatatactagtgttatctgactaatatcttagtctttaatcatgaatgcctaatatacttcttagtacgatgaaaaatcgtatgattcagttatgtaatgaagcaaaattatttttttatcgacattctccaaaatgtacggtgtccttgtgcctttagctcggtgactaaaattcttggatacaaccctatgattatagtacttgcgtaattaaagacaagctagtttgatatatttgttcttattatgatattaatatcatcagatatattttctctactagcataatgcacatacgttacaacggattttttaaattaaaaatagcccattatatataattttattaaagtcttaaaaatatgttatctacttagggtttgtttgtttgagatgtggcttttggaaaagtagctatgagttgtgggcctgtggctttataaaagcaacggtggaatatggtccctgccttttgaaaaagctcgtttggtttaacaactgtagcttttgaaataactagtcctgctgacaaacgggcctcacatgtcatacacacgttgaaaaaaacgagaagaggaagagatggagatggccatcgccatcgccgttggcctcggcggcagcagcggggaggcagacgtgcgcggtggagtcggtgcggctggagcagcggcggccaccatgcctgacgggcgaagggggcggtggccccgggagaaggaggcagtggtgttgccaccgccgttgaccacctcacctctctcgtctcccacctccacggccgacgggcgaaggggcggcggcaccgggagaggagggcatcagccggagatggcggtggcggattggagggggaaacgcggcagtggcggcagaccgacgagcggcctcggtgagatcgtctcgctacgcgtggcctcggcgggatcctctccccatgggtagcgtcagcgggagaggagggggcatcggccggtgacggcggtggcaaattagaggggggaaacgcggcgatagcagcaggctgggaagatcctctccccgtgggtggcggcggtgggggaggaactcgccgccttgccgggagctcgcctcgcctagtgaggccacagccgcgtgtgttggaggagctacccaaaagcagctcaaagcaggagatagaggtgctttcaatttgtactagagcaaaagcagtttttgggtagaagcagctatggcttttgagctttttggttggtttttgcttttgtaaaagcaaaaatgggttcaaaagcccgccctaaagcacccttatattaccatgctgctaattttgttgtaaacaaagttttatccttttttatgatttcaacatgatagttgggtagtgatggtccactagcatcttttttttttttggcaattgtaaatttaccacggttttgaatcgttattgcgaaactaccactaaaaaattgcaaaaataccactggaactatcattcgagtagcatccttacaaaattaaaaaaaaacagtggtaaatttgtaaatgccctttttttattgatagtataggtaagacacgttcaaatatgatactaatgtaatatgtagttactgctggtactgtcttacaatatcttaattttattgatagagagagatttacggatgtgtgttcttttgatcacttttctaactcctataactcgttttctataggcacattttctaaattgttaaacaatatatttttctttaaaaaaatatagaaaagttgcttttaacattcatgttaatattttaaacttttagttaatacttattaataattaacatgtgttaattcattgcttcgtttaacgcagctttgtgaatttccatgaaacaaaagccaagaatggaacactgaaaataaaatttcccacgaaaaaaagaaaaagcccaaaacccctttttcctcctatcctgtctctcatctcaaaccccacacattccccacaatccgctcgccatggcgaccaccgcctcctcctcctcctccctctccttcctctcgccgcaacccatccacccccgccgcgtccgcctccccaatcccccgccctccaccgccgcgccgcccactccgacggccgtacgctgcacgcccgcgcccgcggcggcgccgtcggcggcgtctgcggcgtccgcgaggtcaatcccgccgccgaagctggtgcggtgcccggcgctggaccgccaggcggcgcgcgccaaccgcctccgcttcgcccgcaagctcctcgtcctgctcctctccaagccgcgccgcttcctcccgctccgcgtgctccgccgctgccaccgctacctcggcctcccgccgcaccgccgccgccgcccgctggtcccgttcgtgctccggtacccggcgctgttccgcctcttccaggcgcccacgtcgcacccgctctcgcccaacctctccaccctcgccgtcgcgctcacccccgccgcggaggcgctcgccgccgacctcgccgcgctccgtggctcctcgagctcgcgccacgcctcgccgccaagatgcaccgcctcctccttctggcacccgggcggagcctcctcgtgtccaagattgctcacctcgcacccgatctcggcctcgccatggacttccgcgccacgctctgcccgcagcaccccgacctcttcaccttcgtgaacacctcccac

SEQ ID NO: 1349 - DNA, 2985 bp, Oryza sativa
acacctcccacggccacgcactccagctagtcgatcccccgccgccaccgcctccgccgctcccgcctttccgccccgcggcgccatccgaccgcctcattgaccggccacgaaggttcccccacctcaagctccggcgagggctcaacctccgccgcgcgcaccgggattacctcttgcggttccatagcctgcccgaggtgtcgccattcgagccactcgatgagggcgcaagcttggagatgatggagcgacgggcgtgcgcggttgtccgggaggtcctggccatgactgtggagaagagaacactggtggatcatctcacacatttcaggcgtgatttcgggctaccgaaccggctgcgcgcaatgctagttcggcacccagagttgttctatgttagtgtcaaggggttgcggcactcggtgttccttgtcgaggcgttcgacgatgacggtaggctacttgtggaggatgatatgcttgttgcgagggatcggcttgaggagcttgtccgcgaggggaagcggatgaggcgggctaagaagaagggccttcttgctcttgcggatgacagtgatgaagatgatgaagaggaggatggggaagaacaggattcggtacaggtcgatggtgaatcttgggacttgttagaggatggtggcattggcgaggactgggaggaggtgggtgatcttggtgaggggagcgatgacgatgctgatgctgaattggatgcgttggaggagttttgggtgaagaaagctgtggccgaggggttggttgacactgggagcgagcttgatgcttggtgaagcggacaatggcaatctgatgatctggtttatgagcattcagccctgcacgtttctgaagattttgctgactaagaattgctcaagtgcattcttcctagcgatgtacagaagctagaaaccattagcacataaccttttcttatctgctgtaattctctctcttacaaaataaaggtgtgttcttcctaaccttggttccagtggagttatgcaatatgcatttacaatttctatttgtctatttgcatgaaaatggatacgcctgtaaattataggatgaattgaaagactaattctgtgatctgaaacataattacatagctctgatgcttgaacacggaatagtcgatgaatcgaactgaccttgctaattgctgtactgaagtagttaatattattactagctgccatatgtggagattctagatgctgaactcagatgattactacctgcaatcttacactggtcatggttgtaacttgcgattttcaacctttatctgtgctatgtataaaagccttatctagttgtttttactggtaacctggacacctggtaggaaagctgtttttctcaagaagaataatgagcgtgtgaactaatttgttgagttctttccatcctagtataatcctagctttaactgtcaattgttgtatgtcgagatttctgcgacatactttactaaaattaatttaattattatggtgaacacgagatattttgttgaaaagaacagatcatcaaatgtgtcatcatgttggttctttagaccattccgtatccaataaaccaatgtactgcaattatttgcatatgttctatgttatggtgccatttatttcaaaagtacgagtgttgtgtttatttacatgttttaaactgcttgaaccgattggtcatgttggttgcatctgatataatatgtaaatgtagatagagagggtttacacataccctttttttgtatcattcttttgctgcacctgttgtgattttgcagaatttctgttcatcgagatcgtgctggatcaggctcaaaccagggatttctacgttttctataatcaccaagttcatccgctcttaaatttctgtaagttcgtagttttaggagtggtgctatacacttgcacaacacagtaggtcgtccatttttctgctcgaaatgaagggttggttttctgcagttcatccagtggcattcctgtttcgtgtcaggttgttcactcacttgccggggcttatgttcttaaactagttgataccccgcatattgcagcgggtattgctaaaataactttgtatatatgcaaggcagaaaattgtgtgcttcaataaaataatttggtatcggtttcaggtgagcaaagacaacaaaatatgagctacagaaggtcagagaatgttttgtaatataacatatgtgattactgcagctatatttcgtccaacagtatgcattactgcacacactcaattctcatcaaatatgtagctattggaagcacatgcttatgtttttccaaatattcacagatggatcatacggttaccattaaatcagcgaaaaagaaccatatccttctcatggtgctatctgcaagggagtaactttagtagctagttttcttttcatgcggaatccatgctgtaagttgtgaataatagcgggaaaataaaattaccatgctaaacctgacacttaaatctgaactgctgttgtaaacaatagttgtggtcatttttttttatttgcctagcaaagatgtaatgatataaacaaagcacggtcaaatgtagtattttatccaaaggctccaagcccacaggtaccaacatatatatatttaagcaactcgattccgcaatgcatcgatcatttgacaaattacagattgcaaatattgcaaaatcccatacatatataaacttgtaaagcaagtggcaactacagattgcagcaactcatgatgctgcattgtagtattggcaacattattattatagtattggacatggaactagtacacatagcaggcatgatcagcttacacgaagaacggctcgatacatgaagataaaagagcatgagaaattgcagaacaggaaacaaccgtaattggctctacataggaagaagcacatcggaagacacctcacttg

SEQ ID NO: 1350 - DNA, 1516 bp, Oryza sativa
  unsure (1)..(1516): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaacctctcttcgccatcttgtagtagtcgacacgagcatcatcatacgcctgcaccatcttggccaggtgatcgatcgtggtgtcgttctcgtgctcggcatccctgaaggtggcatagtcctccgccaaactgcgagtaggatgatagcggaatggagtgtgttgcagacgtgtccagtgtcgttgaaacagcctgccaatgcccagaagcaccacttcttggcatgcgtcgatgaaggtgtcagtcccttccgttaggttcaatgattccaagctaaggttggtggagagcaaggtggccttgactgaccattggggggatgccaactttttttttcctttgtttggcacagtggtaccaaccaactggacttttttggggaagccagtccacgataagtgggaagtgcaaataacccttaagtagagccatgtaggggcaaggtggtcatcatttttcaaaaaacagacaaagaattagtaaacaattttccaaagcaagagagggtgaagatagaataaaaaaagtttccacaattaaagaactattttctaaaaaaaaaatatcatcctaaggcttagaccacttgctcatcctacggtcaaggtggctctgataccaacttgtcacgcccggaaatatacaccatttccaaacgctcagtgcattaatcctcgtcccagaaggcgaggtacacatagacattgttgattattacaagccacacttgcggaaatgtaaagcaagtactttattacatgggcgacttaggccctcacactcaaagataaacaaataaaacagcggaagactacagaacaggcacttgatggcggagcgaactagagatccaagccttcatcttcctcaggtccatcctctggattatttttgtgagcaagactgagtaccaccaccgtactcagcaagtcacaccggaaatgcaacaataatgcatagggtaaacaaggaaatggcctaatagggtttattttgcataaagccatagtttaaacattttaatcaggttaaagctcattctaaaacacgatcctgttctaagccaatattttcatatcatcaaggtcgcatgagcctgcgaacctgtcttaacccaggctaatctccacatgactacaccatcatgatttcaccctcccaaggttttataaaacaaaactaactttgggtacattgctcagcttgcccataaccgagggcgcggctatttcgataatttttaactctgatcagaagtgtacaactttacccacaagacacaacctcaacac

SEQ ID NO: 1351 - DNA, 6536 bp, Oryza sativa
gtccttatattaggcggggtatgactaccaaaataacctgcttgcaccccgagcccagcccaaaaatatgttttagttgtacaaagcattttatcacccatctattgacaaaccagtcaatagtccataactaatccagttttagttgttaaccaccatagtctagtttatccaaaagttctacttcctccgtttcacaatgtaagactttctagcattgcccacgtttatttagatgttaatgaatttagacatatgtatgtgtgtagattcattaacatctatatgtatgtgggcaatgctagaaagacatacattgtgaaacggagggagtaggttggaactaagcatgactaagcatttacctaaaacaactagttagtccatcatgtaggatactagactagtcaagttataattttactagggttcacaatgatcatggatatcaaatcaacatcatggccataacaaagagcataggaataactaataaaacaatattaataatgaacggtataatctataaagcaatgcaatataagtaaaaccacataattttcacaatatgggattcaacatgttcaaggtagatatgacttgccttcgctcacaaagtcttcggcgtcaacggcgatgaagagctgatcttccggaacagcgggatctacacgaccaacacgaagaaatataaaaaggctaataaaaaccacatgaacagaagcgacaaagcacataaatgggttctactcatttttaaggggaaactagagatttgaacgggtcgattctgagttcaaacggtcaagatatggccatttgaagtttagttgttatttaaatggaaatttacaattttgtgaattatttttctaaaggaaaacttgaattattgagagagagcgcacgcggaccggtccacgagcgggtcccacttgccagccgctcgatccaccgtgagccgagcacaccgagggcggctcacggcacaccgacgcacaggcacgacagcaaccgagccaggcggctcgccggcgacggccaacggcgcggcggcggtgcgacggactacaggaaagggaaaaacgaaaagaggaggaggtgacggttctcaccgagcagacacggcggcgagaggtcgacggtgttgctggcggcgagggagaaacgacgaggaacttcgggttgtcggcgtcgtcgtcgttcccgcggtcctcgtgctcgacggaggggtggacggggaagaggaggaagcgaagaagcggatggtggcgacgccgggctccgacgaggtccggaccaccggcgaggggcgaccggagctgtgacggcggcggcacaagaagagagcggcgcggcggccgcgaagagaggagggacagagcggcggtgtgtggggagggaggagggagtcgagggtcccttttataggccagaggggagggataagggtgccggggagggagatcgacgccggccatggtggagctcaccattgatgaacaccatcaaaatccaccgcaaataatgcgggatcgagtgtgaaattatgggggaattggacaggatgaggtggaaattaattcccctcaattaatttgatgaaacggcgagtggaggaggcgaatctgaggttgccgtcggtaggaattcggccggagagagagaggatggctggaggttagggatgacgggtgggacccacctgtcatcgagagggagcacacctgtctctgactgggcgcgcgaaggaggaatgatggacttagtccgagggagaaggaatgagctgggctggcccaaggagagggagggggaggggggaataagttcaccttgggctgggccaagagagggagagatgggctggaagcagcccaagaggaggaaggggttttcttttagcttttcctttttataaaattcctttaattgtttttgttgccttaaaattatttaggatgctctgaaaattcaagtaaaaattggttacacattttgaagcatggggaacttattaaaaatacccactagccaacttgacataaatcttggtgaattttaattgttggaggctcttttaggctttttaaatttctagaaatgcattaaagcacaatttaaacttagagcgattttcagggcgttacacaggcccaggaagccaatcccggagcccacgagtcaccctcagcctggcctctcctttcatccgcgtcgctggcccacgctgccgtcgatggggaccgactcaagcccacgccctacgctgaggcatagccgccgctgaacttccacaagccgcgcaaggagaacccggtgtcgtccttccttaaaatggtgttatgcatcgccctaacactaaccctctccctctatagataccgccggtcgtcgccccttttcctcccttttttcatgctatttccactgtcgccgtgccacagatttcgcctctgcctcctcctacggacaccgcagctagccagtgcctcggtgcgccgtcgccacagaacgatgttgtcaatgccgttgtgccggagcgtgcccatggagccatggctgctcttcctcctccgatgtgtagctgatctgtgggtcccgcgacaaaaaatccccaaataatcacagccatccaaacccttgattcaatctcaaccattggatctatttaaccctagatccatccctgtcagcgccacatcattgccctgtatcacctcatgtccatacgcatcagctgagtccacatacaccgagtccaccatactccataacactgtcagtgggccccacacatattttcttgtcagaaaaaattcaatccccgaaattaagtatccaaagaatattcccggaatattacttttttcttttaccctcagattttctctgaattcaaacttctgaaggctataaattttccattcgaactctgattcaatccattcttccaccttaagtcctctaaaatcgagctctacgtcctggtttaatttgttgtttcattttatgttctttagttagatttttcttttgtttatttgtttttcgtttgcgatcgtatagacattggagcagaagagcagtttgtttcagaagatgtcgtgcaagactgggatcaacgcaagtgcactctttgaacatattgatcccatttttatcaattgttttgttttgaatacatgcattattttatttacgaactaatgatgggtagcgtaacctaattttcattatatcctaccttgataacttttgattacccatgataccttgtcaccctagtctttgtgagttgaacattaggctcaacaggatgcaatgtcgtacaccccgtaaaatagtgaatgctgtacaattggaaactttttttttcttgttgtgcattagcttaaattgattaacgtaaattattattactccgttatgctctatagatagtagcaatatgaaataactgcatacatatatttgtattaactactcaattatagttgtctcatttatttctttcagaggataccatgaaatgcaaccctacaaaagcatagtgctaccaatgatatatatgtttgggcttcaaggatagaaactatatcaaggcggcaatatattactatttattcgctcttacagttttataacatcggattgggaaaaccatttcatgaaaaaaagtttcctgcacatggagaccaaggtgttgccctcaagtatattaggaacccaaccgccgctttattggatttaggagttggttccattgtgcaacatgtgtgctagtaggggtgaaaacggtacggaaaccatctttatcgttttcgtttcaattttttttcggaatcggaaacgctggatacaaaaacggaatcgaatattatcgaaaccgaaaacagagtgaaaacgaaccggcgcgaatacggtaacgaaaatttattagaatacaaaaacccatcaaactgataaattcaattctcaagtctcaacggtcaacaatttattataaaacacaatcatataagtccaattgttaagtctcaacagtacatcacaaaacacaaatctatggaataaattatctatatttaagagagtaatgttgttgataaatcccaatgcagaaaaaatatattcttatgtaacttcaaatttgcataacaaatattttttttaaaaaaataaaagccaaacaccgtggtagatttgcataacaaatatttttttttaaataaaaaagccaaacaccatggtattcactattcagtgctaaaaaaaatccagggtattccgagaaaatttccagaaagtttccgactgattccacgttccgacaaaactgcccttatcattttcgattctgtttctgagaaaatatttccgaattcgtttccatttccgaaaaaattccaaccaacagattccgttttggaaataagtccggaatccggaaagtttccgtaccgttttcacccctatgtgctagtggcgtcttgtgcttgcttaggttgatttctgacctggtcatatcttatttcatattctgtaaatggctagcatgcaaatatatttcgagcatggggagcagctctccaacccctgggaaaaccggttgatgcaattaagtgaagttacatgcttttagactcaagtcttaaacagtatggtgatgttatgaggttgtgtctttttaataagaaatgttatgtcagtttacaatataatcgcataaattgatatggatctgcactccaagacgctgtttgtgctaaaatacttaattaatataataaaatcatagtacttttgtacatatagaaacagcagaatagaagaaaatttctcataaatattagccatataaatttcagctctttccagtgggaatatacaagagtgcagtatatcggagatattaaagaggaccatagaatgctcgcaccacagcgattctgcggtttttcggctggcgtgttcgcttcccgtgatgtccacgctgggcgctggagctggcaatcttgcaaaaaagtccttgattaacttgataatcattcttaagtccctcactgtatgtttctgtattttgtattcttttgtaaaagccctcaatgtcttggtatatcctacgtgaaggagacgaaattccaaatataggaccgcgctctgaaaaaaggaaagtaagggtgttttctgcaaaacagaacatccctatcccctccattcccctcaaaccctagccaccactgttcacccaccccttctcttcctttccccgctcttgcgccgccgccgccttgccttccctccccggcttctcctcgccaacgacaacttgctcctcgcgctctcccctatcctccccttctcctggtgctccctccatcactctcctcccagtggagcaaggggactgggggactcgatggtgcaggattggatttgggtgcggtgatggagtttcgccgcctacagactccccctcgagctctcacatgttatcccccatctctggcactcccccaccgctctcctcccagcaagcagagggagcggacggcgtggcactagatccgcggcacggtgatggagttcgatagtaaggagagtcaatctgttgcctcaccccttgacccattggggaagtcgttctgatgtgtgcaagggaaaaaaagaagaagaaatccccttcatgttggatctatgcatgactgatctgcttcccgttctgtgtctaccacttgccagccatgttttttctcagatgagtgcaaacctttcctctattcttgcttgtccatggtcatgagctgcttttgacttattgccacaatcttagccgcttgccatctatatatctatatatatataatggttggaggtcagagattaatggtatggcccgtgcaaatatctaccaagattcatacacctacatgcgctgcttagggactctgcatttttcttggtagaacttgaaatcttggtacatatatagatggcaaatcttttcctgtagaactgcaaatgttttttaattaaaattgatacccccatatatttcttgatcactgcctgcgaacctctgtaactattagattcagctataacatgggattctaagtagtgaataagctggttatatttgcatatttaaatccgatttttaggtgccatctatctatttgttgtagttctctacagaatcaaatgcaaaatctgaatgttcataaccactttataatttaggccagtttgaggttgcgtcattgtgtgccatgccgtcgagcacctacacacctgctctttttaggttgaatgtgctttgtgtttctatggttcatcctatgaaatgatttattctctgaaaagttattgttatgcatggactacttttgttccagcatgatgacccttcttgggggtggatcgacagcttgagtaaccatggctgtaaaagttcaagcggagaaagttgcatggtgaatcaaattatttttctttttctagcattcttatattttccgtgtaaaatactg

SEQ ID NO: 1352 - DNA, 786 bp, Oryza sativa
taccatccagcacatatcaagcaaagacactcatatgccccctttcacttggtgtggaaaagattcatgcgtgggtaaatcactgcatactgtacaggaaagattacgcttctttagatgaatgtccaacatgcggtgcaagccggtacaagtggatagcaatactggctagaaccctctgaagcaactgagggacgacagagaaaaatcccgcagcttgtgatgtggtaccttcctgtcaaagactgcattaaacggatatactcaaacccgcgagatgcggaactaatgtgctggcatgaagaagggcgcaagaaggatgggatgattcgacacccggcaaatgctcgtaagtggataaactttgatgctcagtatagaaagtttgctaaagacccccggaacattagatttgccttgagtactgatggagttaatcctttttgagacatgagcagctcacatagtacttggccagtgtttttcaccatgtataatcttcctacctgcctttgtcaaaagcgaaaatacgtactactatgatcctcaacagggaccccgttagcctggtattgatattgacataattcttgaaccattgttggaagatatggctgatttatggaaagagggattgaaagtgtgggacgagtacttaagggaatacttcacagtgaaggccatcatcttcgtgaccattaacgattatccagcaatgttttcagtttcaggtcaaattaaaggtaaaataggatgtgtgatctgcttgaatggaacgtacatagg

SEQ ID NO: 1353 - DNA, 4321 bp, Oryza sativa
aattgcatcctaaagttaggatatgataaaaaataaatatttcttatgagttaattaataaagcaccatgaatacggtaatgaacaatgatcaaatagacttatgtgggaatttaaaggttatgattatttctttttaccgaaattattcaaaattattatttttaattgtaaacaaacttaaaagaaataaagagatgagaaaattggataggagggggagggattcgtacgtacgtacatagggaggagggtgggctggtgggggagaggggaaagaggtggattatgggatttttttttctaaaaataaatctcatagataaaaatagtgggtttctaaaagtaaatctaatagataaaaatagtgggtctaccgatttattagagagccacgtggcagcttagaaacgtttgtaggagtcctacgtggtggcttgccgatttatcaaagagccacatggcagcttaggagcgtttgtaggagccccacgtggtggcttaagagcgtatgtaggaagtttaatagatttttagtactccatctgtcccataatataagagatttttagttttttgtttgcaacgtttgacctctcgtcttattcaatttttttaaaattattatttattttatttgtgacttttattatctatagtactttaaacacaactttttattttttatatttgcaaaaaaaaatttaaataagacgagtggtcaaacgttataatcaaaaacttaaaatcttttatattgtgggacggaggagggagtatataatagatatgataaatagatgtcaattgtcctgcatacctcgtagatgtactagaggactaaaggtccattcagcatgccccggccgatctggttctctagctcgcaccacacactacattgcctaacctcgatgacaggcttcgtagctagcacaaggagtgccacatactccctccatcccaacaaaaacaaaccctagtttccgtgtccaatgtttgaccatccgtcttatttaaaaaaattataaaaaaattaaaaagataagtcacgcataaagtattcatcatgttttatcatctaacaacaatgaaaatactaattataaaaaattttcatataagacggagagtcaaatgttggcacgcaaacccgtggtttacctttttttttggatggagggagtaaatgatagtgtaaatcatcatataattaagtacaccccctctcatctttcccttaattaatttctatcctaatctcgtttgcggacacctgaggcaacgtttatgtatgctaagtcaacgttgacatagagttaatcagcgatcgatcactggttgcagatgctagcggcaatatggcaatactgttaggctgcgttcgggagttatagttccctaatcttttccctcatttttcgcgtgtacgcttttcaaatggctagacggcgtgttttttcaataaggaagttgctttaaaaaattatattaatctattttttttaaaaaaataacaaatacttaattaatcatacaataatagatgcttcattttgcgtgctgggacaatccctctggaacacagccttagttatatgcagcacagggcagggccacgggacatctatatatgtatatgctcaaaaacatgagttttatgtccaaacaagaaggaaatatttgcattgacaaacacaagacccccgaagaaattaggatgactcccacacgggagtggattctaatccctcaaggggatatcccctcgtatatctttttttttcaaattcgatgtaaatagttgtgaaaaattctaaaaacaattgacaatgtagagtataatgatacctattagtccaccaaaattcatgttcaaattcgatctacacatcgagaaacaaaaaagacaaatttagatataaacagtgcactactattcatacgctgaatttgtcctttttatatctcgacatgtgagttgagtttgaacttaagattttgtgaagttgtatatatgtgttgtatgaatgttgtcaaattttttcagaatttttgataaccgtttagatggttttagagcaaacgaggaaacatcccctcgagggattagaatggtttcccctcccacacccacgatgcaacatgctgctgcgagtgtcctgatgctacttgcaatgactatctacaactgtgactcggcaaatctgaggctgcagctctcgcatgtggacgccggccgtggactcacccactgggagcttctgcgccgcatggcgcagcgcagcaaggcccgggccactcatctactctctgctcaagctcaatcggccggccgtggccgctcggcgagcgcccccgtgaacccgggagcctacgacgatggcttccccaccacggaatacctggtgcacctggccgccggcacgccgcggcaggaggtgcagctgacgctcgacacgggcagcgacatcgcctggacccagtgcaagcgctgcccggcctccgcttgcttcaaccagacccttcctctcttcgacccctccgcttcgtcgtccttcgcctagcgagagcgagactactcctccctgcggcggcggcggcaacgacgctactagctgggcctgcaactacagcatatcctacggcgacggctcggtgacacgaggcgagctcggccgcgaggtcttcacgttcgcgtccggcgccggcgagggatcatcggctgcagtgcctggcctggtattcggctgtgggcacgcgaacagaggggtcttcacctcaaacgagaccggcatcgctggcttcggccgcgggagcttgtccctgccgtcgcagctcaaggtggggaacttctcccactgcttcaccaccataaccggatcgaaaacgagcgctgtcctgctcggcttgcctgccaatctctacagcaacggccgtgggcgtggcgccgccgtcgtccagaccacccctctaacccacaactctcgccatccaaccttataatacctgtcgctcaagggcatcaccgttgggtcgtcgaagaggcagctaccggtgccggagcacgccgcgatcatcgaactccggcacgtccatcacttcgctgccgccgcgcacctaccgggccgtccgcgaagagttcgccgcgcaggtgaagcttcccgtggtgcccggcaacgccacggatcccttcacctgcttctccgcgccgctgcgggggccgaagccggacgtgccgacgatggcgctgcactttgagggcgcgacgatgcgcctgccccaggagaactacgtgttcgaggttgtcgacgacgacgacgcgggtaatagtagccgcatcatctgccttgctgttattgaaggcggcgagatcatattaggcaacttccagcagcagaacatgcacgtactctacgatctgcagaacagcaagctgtccttcgtccctgctcagtgcgaccaactttagactcgcatcatcgccctagccacgatcgagcccacgacatccgtacatcgtccgtgctcaatgcgataaactttatagtcgcgtcagtcatcaccccctagtgtggccacgatgtgtttgccatctatgttttgtttcacttactaatctacgtgttaacttgttatatatagctgaataatttggtgccatacttagtttacaccgtgtaaaatccttctcttttaccttgaggacggtcaggacccaaggtcatataacacgaggcaattagcagttcaatctatatatgcacgtatcgtgctgctatctgtatcaaattcattgccgcggaggctgcaaattttcctttgcgaagaatattcagggaatcagctatgccaagtggcgaagccaggatttgaggttgaaagagtgttaggggataagtcgtaagacctaaccgtagcaaaggaggctaaatattcactgtcgataacaatcaatgcttaactagtcctttaaaaaaacttaaaatttagctctttaacaataataatcactactagaaaaataatttttcatgacgtcacactataattttcactggcggttatatgctaaaactactagcaaaaacataagcagaggttgggggtataggaccaccagcgaaaaccgattttctctggcgcccacgttaagacgtccgccataaaaaatactctatttttcgatgcggacctcttaagtgtccgccaacgaaaaccaacattttcactggcgattactaaacagttcgaccagcgaaaaaacagagcccgcttaaaaaatgacgtcatttaaaatcacgcccatgctgagatatttt

SEQ ID NO: 1354 - DNA, 3671 bp, Oryza sativa
tcccatcgtctcctctcccctccgccatatctgtccgaggggaggaggctgccgtcggggaggacggacgcggggaggaaggatccgcccggcggcgcgcacggggagcacggatccaccccggcagcggcgcagggagcacggccacggggcctcgggcggtggagcgcgaccgtcggcctcgaccttgtcacgactgacgccgccgggccgcgggcagtggtgctcggatttctgtggatttgtgtgcatttgtgtggatttatgtggattgtgaatggaaaatatctgttgatttgtgtggatttgtgtggaatgtgaatgaaaaattttgattgcctttattgtaaattgttgatgtaaatttttgtgaatttgtgaatcgaggagtggatttgggaataatttgaatcggtgttgatggaggcgaatggagcggtgttgccccatcattttttttaacctggtcactactttcgcttgcgactggtataacgcaactgccagcgaaaatcgtttttcgctgacggccggtataacacaaccgccagcgaccgaaaattgattttcgctggtggccgatctgctagtgtacaccttgccaactatgtacagcacattttggccacgagtagtgtgcagtccatcatatgaatacacatgtggcagtcattactgtcagtgacgtggcgtaggctatcatgacctatccaggtcaacccgtcacacatcgagctcaatattcttctccgtcacatcaacccatataactcccaactcccagagtcttacgcaacgatcctagagacttgttatcgggtgtgatccatgaaaattattctatattattgaacattatctctgacatcacttgtttgaatacgtagtccggcctacactactaaaaaaaccctcatagggaccggccttataggtgccggttcatttataaccggcacctatgagacttttcccatatccgcacgttgaaaaaatatacaaccgacacctttaaggattataggtgccggttcattaggaaaagctggcaccaatattataggtaccggttttaagaagaaccggcacctataatataatatattataggtgccggttaattaaaaaaccaacaccaataatatattacaggtgccggttaattaagaaatcggcacccataccaaaccgagccgaactgggcaagccaagccggcctcatctccgaacttatccgcgcgtaggtcttgcttctcttccttatccgcgcgcgagagaagtctcgactcctcgcgctcctctccaccgccctcccctcctcctcctcccgctcccgcccacaccttgtgctccgccgccctcccctttccctccccctccagcacctgccgagtccccctctccctccgctttctctctctccagccggccgctccccccctccgtccccatctcgcagcgacgcatggatcggcggcccgtgacgaggaagagcagatccggtcgcctcttcctctccctctccgttggcttcatcgaaggcggccagatctggggagggggaggtcggggtggtgggttggtggcggcgatgtccggcggcggtggtacggtggccaaggtaggtggtgggcggcctccccataggtgaccaggcgcagatccggtctccctcctcctctccctctctggttggggcggtgacgtgcggtggcggcatgcggcgacagccgtggccaagggaaatggaggtggcagcggcggtggccaagggaccctggctgcgattggcagtggcgcattgacaacaacggagtgagttcgtgtatttgcttgttttgttgatctgtgatttgtgattgattggattgttgttcactcgggacttgtgattgttgttgttgatctatgaagaattttgttgttgttgttgttgaccggatggaattgcatatgtaattgttgttgtaaccggggaattgcatctgtgatttgtgatggaatgcatcggctcggctcggcttggagccggcttcttcttttttttgatctgggagagcacaaaggtgccggttctacaaccggcaccagtgacatagggtcattggtgctgaccaaaaggtgtcggccaggaaaccggcacctattgccggtttccaaccggcacctataagagtttttttactagtgctatcaaccataagccagtaaaatcatattgagtctacttcaccatattcctaaccagatccacaacttggatcctaagctaacacaattcaaaaaactagtcctattggtgtgaactgttttcatcttttaagtttattttttccactctcaattatcattgtgggactaaaccaaatagttatagtgtaaaagctataatatattcattctagaaaacgaagaaaatgggacgaaaaaacaatcactgtccatataagtacgcaagtacacaaaagattttcctggacgctggtcccatttggtcgagcttaaacaaattaaaacccctatacgcttcaatttaaactgtgatgctagctagggacactgttacgtactgatatataacagcgttccatcatctggcttatgttcttcatgtatcattcagatcgaatgactatatgaaattacgtcgataattccacatattatgggtagtgtaggagacatcctattttcccttggagtcttaattaccactacttagcttttaatttgcctatgagcatcaaattaaatgtgaataacctatccttctctctctttgaaacaaggggcgcttccggttctgtgcaagcttctaacaattttgtttgctccatattaccatatctctagagtcaataattttctatgaggaactactgaactcaatcaggttgagtgttattttgtcatgcctaggaccagcgtatgaagcagaggataatggagaagaaggtagaaggcagcaatggaaaaaaaaaaatcttccttcttcttctccatctttttcctccgagcaagtcgtcctctacggcgaccccaagctcgtcggcaaaccgaggacacgatcgatttccatgtgaactggccgctcttatttaccagactttggaaatgatcacatgaatatattttgagataatctattctattttgtacaagttcaacgattttacatcgacattgtctctttctataatttaccggcgactttatcgaaaatacgtcattgggttgggtattcttttcaaaaatacccaaaataccctcatggacatacaaggttaacaattgatttatcatattagaactttcaaataatatgaaaacttttatgtggccttctttacacaacatgaaaatttagtatatttaatatctttacaaaactaaattttcataaaactaaatagacctttttagaccttttgatttgggataaatcaattgttaaccttgaaaattttgtaaatttttttggtatatttacaaaactaaatataccaaaaacaaattccataaaacttccacgttgtgtaaggaggccacataaaaattttcttatttttttgaaacttctaacgggataaatcaattgttaatcttatatgtctctaaggctgagttcggatgggggagatgggaacccaacttctgcgtaccgaaaacgg

SEQ ID NO: 1355 - DNA, 5757 bp, Oryza sativa
ttgggtatttttgaaaagaaggtctgacccaatggcgtattgtaaaacaattgataaagtcgccggtatattatagaaagagacaatgtctatggtaaatcgttgaactcaaataaactcagtggtatagaatagattctcttgaaaattagagaccccaacactagtacagttcctcttatttgtacagacccctactctagtacaaaccccatacatgcttgcgttttgtgggacgtcacaacgaagtcatctcaaacagggcaaaaagatgcctactcgcacaaacatgttagatgtgcatagagcccgtcacggatgacacctattagtgacgggacccaacttgaggcctgatatagagaaccaatgatatctttgtgggccttaacagaagcccatcaccgatgtccatcattcgtgacgggctccaacttgaggcccgattgagataactattaggtctgtcaccgatgtccatcatccgtgacaggctccatcttgaggccggattgagataactattagacccgtcaccgatgagtcaccgtgacgggctctagactaagcccgattgagataatgcttgatcatatttagattagggttcactctcgctcagatctagatcgaaaatttttctaagtcccgccactctctgaaccctagcaccaccgccctatgggagcctgccgccactgcgcctccgtttgggagtgcgacgccattgtccactgagcccggctgcatcctcgagcctgcgttagccaccgttgacctcctccacgtcatcccccgccgtccttgcgccgccgcattgacgtcccctgctgtccccgagcccgccgtcctctaccgacctcctccacgcagtccccgagtaggacaccgtcctccaccgacctcctccacgccatcccccgctgtcctagagcacgcctcgagcacacccaccgccgacaaccttccccgagcacgctcgcttcctcgacctcctcctccgccggttagaaatttttgtgaattagtaggatattttttttgtaacactaatgtatatatttatgcatatatttgttatgtttatgtatatactcacaatgctaaatataaatttgttctaatttacaactcggttttgcaggttttgatgcttagcatttgaagatgttattgtgaaatatgcgaataatggatgtgtgaaatatgtgaataatggatgtgtatgtgaatggatgtgttaaatatgtgaatggcatatgtgtatgtgaatgattgtatatgaacggggatgatgggatattgtgaaatatatttgtttctgtcattttgcagcgggcatagctagcaaaggactgaggctagccaaaaaaacagaataaattttctttcgggggaaatactcatcagtgacgggctttaacttaagaccaatgggaatgacctcatccgtgacgggtttaagttaaagcccgattgggttgagtcatctatgacgggctttagtttaggtccgattgggattgtattcatccgtacatgacgggcactaattgtggcccgattaagattaggtcatcggtgatgggctcttgtttgactagtcatctgggtcaaacctatcggtgacgggcttcagtttaggtccgacaaagataagttcatccttgacggccttatgcctgatagagatgacttcccaatcagtgacctttacaccgtgatgggtgccatatctgacaccgatgaggtttgccgcccgattgagatgtgggtgaccgttgtagtgcaaaatattaattatgtgtttgaatttaagctactactttcgatatatttaggatctatagattcctttttttttcagttttcactcttccaagttcactgaatcggctaaaccaagttgtttccttctcaactctgacagatggttgatggtaattataactacatctgagaagtgtatttcgtgacgataatatgaacatgtgttctagacgataggaattcatttttctatttagtaagagaaaattgaattgttgtaacagttcttcttctacttagcagaaacgctactacacatatactcctatgtaggtggatgagattctttgatatagctctaattgtcgttggttgtgaatgaatatctgcttgtttgctaggagaatctagatgaaaaaaaagaagtgtatcagattaatgccagcattcctaacgtggttgaaaggcaatgaagatcaagaaaaaaaaaacagtggtataagagacccgtcctaattttcaggaatgctgcgtggtcgcacagcttgtgcgtccgtacggacgggcctagttcccgatgcttgccaagcccaagatatctcttgctcgagacatatgggatgctaaccataagcatgaatccgagaccggacaaaaataaaatgctggtggtagaggcgctttatgtactccggtttgggctctagaccacttatagctcaaggaagaccatatctactactacttaaaaaataagaggtgcttccatcgtccgtcaaaaaaaccgggtgaaaaaaaaccggaacgaatccgattcatcaacgcggtaaaagaatatgtccgattccacaaaaataggaaacaaactcccatctgttttcgtttgagctgattaggactttgtttctgtttgggcgaataggacttggtttgaattataccaagttctattcggttagcatcaccaggagaacaagtgcatatatacatacatagtataaaaaatcatagcacataacaaagaatcacatgcagccttatagcactttgcaaaaaaacaaaaaattagatcgaagggggtcgccgccagcacacatatatccaaataaaaacaaaaaattagatcgaagggggtcgccgccgctgccgccgtcgccgtcgccgtcgttgccgaaccgccgccgtcgccgtcgctggggatccggtggaggggagagcaccgccgccgccgcctcccctcccgctagatccgccggcggcggcggcagagggcactctccggtggtgggggagagcgccgccgccaccgtcggtggtgggggaggactccaccgccgccgccgctcgcgggaggaggggcgccgtcgccgccgctcgcggggcgcctccccacccgctagatccgccgccggtggtgggggagggtgctgccgccgccgctcgcgggaggaggggcgccgtcgccgtcgccgccgctcgcggggcgcctcccctcccgctagatccgccgccggtggtgggggaggatgccgccgacgccgccgtgggtggtgggggtgccgccgccgccgccatcggtggtgggggaggggcgccgtcgtcgccgccgccgctcgggggcgcggaggagagggcggcgaagtgagataggagggggggaaatgggctagggttccgcggctgagagggagtgggttttgtttccccactattgacgctcggtcgtccgatcaaaaccctagagatcggacggctggtgtcgtccgggccgaaatcggcccaagagggatcgagagtgaggcctcttttccggcccaagcccaggttgcggcctgggggaggaaaagtgcgcccgcgcatgcgcaaaaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataagaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttatttaaccatggagaatgaaaattttacttgtaaatttatttaattatacacatacctacttaaaaataccaaatatttcagcgaatttgtattttaattaattgcatatttttctgatctgtaaacttcccggtgcaacgcacgggcacttttgctaaaccaaacaacacttttggtcaatatacacactctgtaatcacccggtgcaacgcacgggcacttttgctagtatataatataatatatatgccatatctcattgtcccgtgtaagaaaatcctatagcgtatatgcgatattaattacagtaaaggactaaattattattattctttttagaaaaatgactaaattattttttattgcatggaaaatgctgctgtcgagtaccatgatttgtgtgggcattcagattttaacaattggtagggggttgagtcatgtacccatatagctcaaccatcacactagctagcttcccctttcattattaatttgatcctgcaataattcatcacatcgaaatggtttcacttacacatgtaacctgaaggcccaccgggatatgtatgtaagaaccgaagatcctttattttgtacttccgtatttggcataattactttaattttttcatcacaaatataacaaaaatcgtgtgtcaccaaatttgatgaagttagtccagttatgcatgatataaaaaccgaaaaacaaagaaaaatgaagctagaataatatattatcagtgctacccaaatagagattttatcagtgctaccacaaattcagtctttcacttcggataaaaccgttaacataaacacccgtatttagcgttgctcagtattaccaattatacacaaatgcagtatctgtaatgatgcataatatgacttgactgcaggcagaatgtgagcatagacatgcaatggatgcgtttggaatttcaggaatgcgagagtgcagtgctgtgagccgatgatggtcatagctctgattgtgcagtccccttggaaggtatgacgtaccgtagggttctaaaacataactttccttttttctttagagtgtacagcatgacccatcatgagtggccgagtgggccacttaggtcacatttgttgacaaatcaatgcggtgatgatatacgcttgtcacaaattactgcacatggtcacattgtacaacttcaaagatgcaaaaagctctatatataaatactggtacctattattaattttttttggccgaactgtgtagcagcatatatggagagaaagagtgaaactatgaaggacctcaactatcacaagctcagtgaaaattcatatcctaaaagcctccatacatgatgatgagtcttgggaattggaggctctaggaactgaacagcaacgtgaggtcgaattctatccattttgcgtgcaaccacagtagcagaccacgcatgcaatagtcttaattaggaggatctccaagtcactttggcatcttgggaaggcagagcatggaaagaaatgaatttgatgagccatcgagaaccattcgaaaatgtagagctcaattcgtcgtagtgcaaatgatgctacagccctccttgatcgatctagctgttcatggcttcatgctgatgggagtagtagtaacatggatccataggacatagggccagccggccggtcctgccagttgtggacagtacattgtcttgtccaacatttttgttgcatttcaagaccagccaaaccaaatgttggagcaatgaaatgtcgtgcaacatctcctcttgatagggattaaacaaatatgc

SEQ ID NO: 1356 - DNA, 1031 bp, Oryza sativa
ttgggtttttccaatgatcagtactttctcatatacttgaattatcaaagtcgaagaattgcatgatgtttaattttttagataatggaaatgggttacatctccagcctctgcccgtaggcacacatccataaagtccagaagtgaatagaaaataggttaaaaaaggcgagatgggacaacccccaacttctgccgataatatgatctactaaaatcatgttttttaaaatcatgtagattctatcatgaaattctgtaagtactacgccatgcaaactggaataaaagttccttggctaccaattccaagcgtgtagcaccattgcgcatagtatcctgttgttcctgtaaaagcatcatacatcaagagtggagccaatttaaacacatgaagataacctgcatgatgttaggcatttttttatgattaaaaacatatcattacggcaacgccaaattgaccaacatagagcactagctccaaataaaatcattttttttgtgggtctaggcactccccttagctagttaccaaaaatatcttttgcattgtggggagggggaatattgaaggcaaagaagacacatcgccaagcaaaacgtgcaacatgacagtcaaagaaaatatgttggatggtctcttgtgtattacaaaaacaacattgcttgtttcccctccattttctctttatgaggttatctttcgccaagattactttttttgaagaaaccacataaatactttgatttttagtggtacctttacctcccataagatcctcttgtggattcttacattggaattgatgatcgcattatacatggatttgaccgaaaaattgccatttttatgtagcgaccaaataaagcaatccttttcatttgacaaggttatgttagctagtcgagaaatcaaatcattccactcaactaactttggtcctataattgatcgtcggaatgaaacattcaacggtgttgtgctcataacctctgccaaagtagaatgtctgtttcgaaccacattg

SEQ ID NO: 1357 - DNA, 923 bp, Oryza sativa
ggcgcggacggattccaaattgcggcgggcctgctccgtcagcgctgcctcagggagggacaggctgtccgccaaccgttgcgcctcggcctcggccttttcgagagctcgctcccgctcggtaagcgcgtcctcgcggaggcggagtgcggactcctcctcggcgcaggcagactcgtgcgccgccagcgttgtctcccgggaggcgacggcggcctcgtggtccgccaggtccttctccgcgacgcaggcgcgctcctccagcgccatggcgcgcgcctcgagggcctcttcacgccgccggagcgccgcttcggtctccgtcgctcgctgctctcgggcagcggcggcatcaaggaccccctgggcggcgtcgagctttttcttcagctccgcctcccagttcccgtgctgaaggcggagggagtcctgcgcctcgttcatcacagtggtggcgatgagggcagccccccgctcctcctccacctctcgagcgatctccgccagtgccgtcttgcgggcctcaagatctgagacgtgccggcggtgtgccttgcggcccgcttccaccatggcctccaccgagtgccgcccctcctcgacacgtgcccatgcggcgtcgagctccgcacgctccgcctgcagggcctccacctgggcatttaacccatccaacactgcggtatttgcggcggctaaggcctgcagaaggggctctgcgctcagcggggcgacggaaggcgtggggaagggctgccttggagaagatgccgcgcggctcggcccgccaatagacgcgcccgcggcctcgtcgcgagccgcccccggacctgtttggtcctgggcgtcacccgaaggggtggacccaagcgaggggcccgcggcctcgtcgcgaactgcctcggaagccgccatcgcctcag

SEQ ID NO: 1358 - DNA, 6588 bp, Oryza sativa
aggagatgggggaggtgttcctcccagcttcctcttcccccgggcgtcggtagggcggctgctccccgagcccccgacgcggggcccagaagcacgaccccctccgggggtagattgatcccctcggcggctcccgcctgcgccgtcatggcccttaggagcctgctcctctgaggccccgaccgccgtcataatggtcaagatggaggcgcgatctggatcgctgcagagggggaggataccgtgggggatgagggacgcctccacggagttgagatttagcacacgttggaccagtatcttgaagtcctcgggagcccaatcccatctgactccctggtgggtccgcatgtagtcttcggacccggtgtactcccaggcgccccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcggaagtcggaggcgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggtggcgataccgactgcacggtgaagaaccaccggaacagccgaagagatgggcacaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaaggggagaaagaagacggacctccccgggtagtctggcgccgggcgtccctcgcccagcgtgactatatcacggccggtggcagattccggcataaagcggcgcggcaacccagcctgcttctcgctcacgatgcgggaaggcggcagcacgctaccatcaagcagtgcggagccccgtgccatggcgccggacgaagagaagatggagagcgagcgtgtgtggcgaaagaagggcgcagggaagaaggagttagggcgcaagcggcgaaggcaaggggaatgatggcgaaaggaaggaaacaaatcctatcctcagtgcctttatacccttgccaacgctgtgcccggctcctcgtttctcgcgcccattatttcgccccctcgtttctcgcgcccacgcttccactgatcccattcgcccgcttgcggcgcgtgaagtggatatgcggttgcggcagtcgagatagatcgtatcgtgcgcgcgttaattacgctcgccgaccgaagcgacattaccgtatctccaggcgaagcaaatcggctcgcccagattcgttcgccgctcaggtgatgtggcagtcttgaagagaccgcccattattgacagctaaattaccataaccggtgtacatggtttgagaccgttgggtttctgcccaaccatggagaccggtcccacctgtcaccaggctttaggagtggcgtcacgcccggccgcttcccataagaagggcgatcgccctggcataacgccgggggctactgtcggtgacatgggaccgggagtatcatgactagaggcttgaggcagacgccatcgcccacgtggcctggcaccctcgggggacgtcgggcccgagggtgatgtgtgcgcccacctcttggtctccccgagggggggggtcggaccactcctgcctcgcccccgagggccgaggcgccccgaccccttgggtttttactccacgtgtatgggttaggtgagcacagcggggctcacctaaccgcatttattgcgcctcggttaagcgtgtcacgccgcacgaagtgcagtgcagtgcactcgattatccggtctgtgaccagtcacagaccggtcaaatcgcgggttaggtggcgacaggcggtctgacgcccgcttcgccccatcccgtcaagacgagagcttctaggcactcgtccccggctggaactagcgtgttacatcccagagatgacacgttagccccgatcgatatatgccaggcttcatcctaaccattacaagcaagatgttgtttgaagaagggcaaacatgcacgttgctaagccgacgcgtggtggacaagaatgaccgatttgtgaccggtctgacactgctcatgtcgtcagcacacagccaccttcccacgacgtgcccgcctcaggcagaagtggaggtaggtgtgtgccgtcccgtcaggaggatgttcggaggacgaccgtgcaaatctccgtccatttatgaagagaagaaaagtccagtttggaaagggaggggtgcatgtggtatccccttgaagtataaaaggaggacctggcccatagagaaaggggatgatcttttccagattcagaacctagaacgagggagaggttggctcacactttgtagctccttcatacgcagatccaccaaaacacaggagtagggtattacgcttctcagcggcctgaacctgtatacatcgcttgtgtttcatgctcttttgagaggccgcgatcttcccacatacacggagagcttgagatctcaccctgagcccccggccgaaccggcaaaggggggcctgtgcggtctcccggtgaggagcaccgcgctccgtcaaagggcttggataagatgcactccgatcttcacaaggcatccaaggctctcaacgacaataagcttgcgaagatagccagcttgcaggatgaggtggctcgcctcaagaagaagaacgccattctgcggaagcgtctagcaccaggtgggctcaggatccgcagcatgcctaggaagtctaccacaacacccatgtgcatccagttggtgcacaggaacccgtctccaccacctccagctctagagccgcttccccgctttgtgccaccctcacctccaactccacctctaccttcaccaacgccagctccagctccctctccaactccagcactaaccttcgctccagtgtcagcttcagtgtctaatggtagcggtggttggctgttcgccacgtccagcaatagcagcggtagctctagcttcgagcctgacagttatgacacctacttgagtgactccaggagctgttctgagcattagggccgccacctttactttttaccgctttgcttagtttgtttccttgttagtttccgtgtttaggcttgtcgcttgtgggctagttggcattctatatcatgtgttggtatggctgccttaataaggatgttgcttgttttttcagttgttttaatttagatcagaacaattgcactttaattataataaaataaagcttagtttctgagcagtttgttttccttgttttccatccttttttgcctatcccctacaaatggtgaacacaaagacagaaacttcatccgcctcgcgctctacgccctgcagaacgtgcacagcaatgccgagaggcaggagaagtttctatctggacttgatgatgaaccgaccaaccagctgatctttggagattaggctaattttgagaagctagttgacaaggtgatccatcaggaagatcaacgcaataagatggaccgcaaaaggaaagtagcttagttcagggcacaccaggggaacagcagcagcagggtggaccttccaccatgattgtccgtcagcaccgtccttactactcaggcaatttccacgccggtagtagtggcagccacaacaacagtgctaggcaacacaaccgcagcttagctccatgcccgctaatggctccagcttagccagcacagccagctcagcccaagaaagagtttggaagaaagacaggggtctgtttcaactagcgagcccgatcacttcgctcaatataaaaccgggtttttaattaaccgacacctataatatagtaaatatgttgtttttttttcaaaaaggtacctatagtataggtatctattttcctcgagaaacaacacatacaatcatttaaaggtgttgatttttttttcaacatgtgaaggtgggaaaaataatataggtgccggttttaactattccgacacctataacaccaatctatatgtgctttttttatagtgatcccatcgacgatggcgagttgtggtgggaggtgggggaggagcgggatgcgtgtgtgtggtgctgcagcaggagctgaaggagtgcatgactgctttgtggaatctaaagcttcccaaacaaatctctttactctttgggaaaatattgagtgcagattctaagtacatcctttatgtttaagaaatgtttttttaatcgagcacacagttatggacctttccggcatagttttagttgtcactaaccattaaaaaagggtcattctttttaaaagagttggtgcatgcgtttatactaagaaaacacataaggtagggccatgagagcctggaggaaataaagttacacacggtaaggaatttgcaaagtatgatggtttttgaacgggacggcagaatttgaagaaacacaagagggataaggaaacaacgcaacagatacagccatgaagaacaaaacacagcaatttggagtggagttgctccagggcagacaagcttgcaaggaagaattcacgttcacacatctttgtttatccttggaaattttggtgtatctgagaaacatagcatttctatctttttagatttatcttttgtgatgggaacatgtatggagtatagtactgaaatagaaagggctgttttggctttctaccctaccaattcttttgctagagttatgttgtccatgtttcctttgttactaatgggaagccaagctttatattacaatgaagagattgtaattaatgaagaatgagggattaccaactattttgattcaaaccaaaccatcgaatttactatttaagctagcagagaattagtaggacattggcacgaattcaaaacattgtgtgatactgtcttgtatacctcttcgatagcataaccatgaagaacttaagtacgtaattggatttagaagtagcgaaattgttcagaggaagagaattgaacggttcattgagaaagtactaaggtactatattttcaacgtaaaacaaaaaatgatgatccatccgtttaacttttttatataagtaacttaattaagtttggttaaatttatagaaaatattagtaacatctacaacacaaaatcagtttatttaaatttaatattgaatatattttgatagtatggttattttgtgttgaaaatattgttatattcctttaagaacttgataaatttgataagaagaaaaatcaaaccgttttacaatatgaaatgaaaatattatgctatatgtagtactccctccattcacaaatggtcatcatataactttttcaatgttattaaaaaatgattagcatatttgatactcctatatatgacttttcgtttttaggtgcgttattaaatggtcatttgcattcattgttcaatgtactattcaactacttgtaatttgtggtgcgtgcatgcatataaacaagatcattggtgccaattgcccttgatgcttactccctagatcattggtgccaattgcccttgatgcttactccctctgtctcgagaagaataatgtgacccctcctaaattgatgtatgtggacacccctatatccacatacattatcctaggaggagtcacatctccttctaggttgatttattttaggacagaggaagtatgcaagaaataagaaacggtgttgcatgttaatcaatgtaaatttaagtggcatgtgagagtatattgatatcaaccataaagccataaaccatatatgccgatcatttataaatggagggagtactactttagatatagcgaggtgtccgtgttgccttgttaatctcaaaatatatcagtcttttgaagatgcttgtgtgtttacatgagtgagtgtgcgttaactgtgagcgtgtgttgtaccgtgtttaaaatttttttaaaaaaaaggaaaagaaaagaaaagaaaagctttgagaaagataaaataactacggtcggagcagaaaatagccgtgccccctagcgtgtacaacctgccaaactgccaatccccgtcgtctcgtcttccctccgcacaagacaatcccccaaccgaacacccacgccagccgccgcgcgctgccgccccatccgcaatccaccaccccgaacaccaccaaatttccaccgatccccccaccccgaccccattcccccacgccgccgccgcccgcaacgaaaacgagaccaaattcccctcacgcctcctcctcctcctcctcggttatgcggtgatggcgcggtgccccggcgcggcgggcgtggcggagcggtggacggcgcgggcgctggcgggcgccgtcctcgacgtcgcgctcgtctgggcctgcctctgggtcgcggcggccgcctccggcgcggccag

SEQ ID NO: 1359 - DNA, 23593 bp, Oryza sativa
ccgcggcgtcggcggccgaggaggcgatggccatgatcctgcgcctgcagaaggagaagtcggcgctcgagatcgaggcgcgccagcagcgccgcaccgccgacgagcgctgcgccttctacgaggacgaggtggaggagctccgggacatcgtgctcgtgcgggagcgcgagtcccgcgcgctgcagaaggaggtggacgcctaccgccgcctcctcggcctcgccgccgaggacggcgacgacgacgacgatgaggatgatatgatgacgcctcctagcaccatggtggagggcgagccaagcacgtccagatctgtgtataaggatagtagaaatggcgcgatgccgcaattggggaatgactatgggttcagcttgaagacgccgttttcgccccaagaactactgtcacctattaaagtgggtcatatcaaagggatcaatgaggataagctgtctgctgggccatctgagaaaattcccatggttggattgaaaccagaggttgatagctccaaggatgatcgcgtggagacgattgaaatccttccactatctgctcgaagcttagatcaggttggttatggtgaagttgttgctgcagttgatacaaaagctccagagcaactgcctcatgagtttcaggaggagtgtggaggtgtagacaagattggtggtgattctacgggaagtgagaatgatgcgaatatctatgatgtgcatgtggttgatgatatatgcttcccaactgaaggtatgagattgtggataaataaatctcaattggttgattcttatatcaagtatatggcttgtggaatcgtaaacctgttaaattcatttttgggatgtcttcactcttcatagatggcatgcagtatttacgaattactattggtacatgataggtttatttaaacctttctttgcttagtttggataaatgtttcctgttatttgatgagaaattcggtactttatttaccatgccacctggtcactagcactgaaaccagtcctttgtatacagttaaaggcctgatttgccgaagtttctcagatgcaacaatgcaagcagagaagttacaaaacagagttgctgcagatgatctccttgggaaaagtctgaatgccattaaaggtgcacaagacaagataaagcatgcagcaagtgaaagaaagcaatcattacagctgcaactcttagaggacatagctaaccaacttcaggaaatcaaggttgctgcagaagcagggcgacagctgcattgtgcttcccctagaaatttgaagaaaagctaggtcagtgctaattatagttttcctgttacgtacttcgattttttttcctcttttgtaacagatgtatcttacttcagatttaaaatgacatattgccaaagaagcacaggatcatggggcctacattataagtccccccagcttaactcttaggaggtttaaaaactataaatttgcacattaatcagaaaataaaatatatggaaattcccatgttaatcaatgaaaaggaaaacatcgtgagcatccaatctacctaaaagatgtaacaaatagcttggattgtttaaaaggaaaatcttcatgctttgattttgtggaacatgcattctatcaaaggctaatccgagcaaggaattaatgtgagtggaatgtgtaatcacatttcatatcttggtgagcccaacacaaacataactcactcatgcatggacgtatgcattcatgtctgggataagagagtaattagtatagtcccttgcatgtagtgtttggtaagataatattggtgtgttgcaaatagtagtaacccatcactcatgcatgcttgctcatttccacattagatcttaatttggtggacaatgaattaagagacatgcatgccttccatcttccaataaataaatgatgtctgaaaattaatgataaaattggagaatgaaatttaaccacataaacaactgctggaacaaattgccttgtgaaatcgttcctttttggtacccatttttccacacaatgtgttaactattagatagttgtgtaccgtgaaagaaagaaaataagaattagcacttgcacacatctgtgtgtatatatagtcccttgagtgtagtgcatcggatatgggcatatgtttatgttttaagaaatattatatttaattgaatgagaatgtgctgtctaaacataaaacaatgagaatagagttttatagatatttctctaactgtatgtgatggaaaaaggtcgcaaaaaataactataagaataaaatagacttaaaatgtatgcggatgcaaaactgtagtaccaaaagcaatagatttgtaaaatgaaatataaactctttgaataaggttagacaatccccaggagctatttgaataaatctacattcgctcagccgacaataaggattctcatagctcagatttattttgacgattagtattcactcacactggaccaaagaggccagtttacactgggttcaatttacacaaaaagcacaaactatttagtgatgtctcccttggtactatacacaacagtttcttgtacaattccatataatacgtgcctaattaggccaagctgcatgggttttcaacagcctcctactgccctaattcatctgtacttccttatcatttcttttttgtgttctttgtacatactcatgtattgaagcacctgaaacaaatcaattttgttgaattaaagcattacttatcagaaaaacgcttgagccccatcagtaagctccatttgtctaaaccaaaaacagcaattgtggcctgggaatgtctggatgcaaatctgctcttgaattacttaagctttgtcctcgagtttattctgggcagacgtgtctatggagtccaaatacaataagacaaaattcttactgaacaaactaaaaaaaaataacctatgaacaaaaggtcatgggtagctttagataggataaaacatgttcagtttgggtggtacagatcttaaacatgatatagtttggttaaaaaaatgtttataaacaatataacaatgtattgcccccacacattataatccaccagagctactttctattcttccacttataatctttcaaagttcacccataaaattccaaatttacaagattctatacttaacttatactatatttttacaaaacatacatattttaacatcaacaataacacaattaataatatacatatttattttaatttttaatctattaatttcgtaacataattacaatttatttattcttttggttacataattttggtttgttattgatgtacatgtacataaaaggtaatttgtttgttgtttgcaatcctatctgctttaaacgaattacacgtttttaaacgacatctggggatgtagggttaacttcgtaattctgcatccactagaattgagttcctcctttgtaacaggaaaactagatcctatttttactttcagtagcagtagaaactattctgaagacttggcagaagaaatagggtacttggcagaagaacacatagttgatcaataccatacttctcagcaaatgttgaatgcttcaccagattatatatactaatatgcattgtcacagttacagccatttccatgtgtccaaacactatgtaatgatccgaacaaatatgtactattacatcaagtaaaggaagttttcacagtttttgctgatcataaatagcaatcgagcaacaccacagaatggtcctaaccactaacagtttcaaccacaaaagagcaaattacaaagtgtgtggtatgcaaagacaaagaggagactaatcctatcctactcctcctttttggaggtatggatggcagtcactgaggagaccatggaatcaacaccgcacttgttcttgtcatgaggtcccctgcagatcttgtagtaccccttctccccccagttctcgccccacgagttcttgatgatccagtacggcttctccttgaagcggatcggtgcgtatcctgccgatccgtagccaacaaggaggacaccatggtcaaggtgcctcccacagatgaaggggcacgacacgccgccgatgtatgtctgcatgtaggccgcattgattgcaactgcaaaaaacaaaaacatcagcaatagacaaacggatgacagcaatttgttcaaatttttgcaaatgtttgaatcctttacttgcaagagggccatgtttgacgaggttggcagcaatttgatcttcgttgacggagatcacactgaagttctttacttgggcaacgattttggacttgtcgaacttgcaggtgttttctcgtccagcgtacgggtaatctttctcgctctgtaggccaccggatttcatgaggtagctgaagtctgtggtcatcaagccaccgttgcatcctgagtcgcatgcgcgcgattctgatgcatcacactgcaaattttacaagagcatagcatatatattagctgcaccttttgatgaaattaaaaatggtaaagataacatgtggataaggctgtgttcggaaggagatgatgggactctcctttgggcaaggaaaacaggattgcttattagtatataattaattaagtattagctaaaaaacttgaaaataaattaatatggtttttttacaacaatttttctataggaatttttgcaaaaatgtttaataattcaggaagcatgcgtgcggtaaatgagagagtggaggttgggaacctaagaggtaagaatacaaccttaaaatgtgaagtctactacaaaatgtgtaagacgcaatcgaatttatttgggataaatttggttaaataaaataattacttctcatccaaagcaccaaaaaacttgcttcaagtgagaaagaactgagtctccaacttgctttcactctacagtttctgtcgctcaccaaccaggacagaataaaccaagataaggacaacacaacagctagtaagtcataaccagggttggaaatttcggtcatttcggaccccctccgatacgatattatttcggtcgaaattttcaaatattttcatgaattttaataatatttgttcaaattcaattaaattttgttcaaaatttcgaaaatttcggaccgaaaaatttcagcatttcagtgggcaccgatcaaatcggctaaaccgttaggtttaaccctggtcacaacaaagcaacccacgggaatatccctctgcgtcattccttctattctatctactcgaatcaaaattaaaatcaaaccgagttccattaactcatagtcaacgagagctagcaattcgagaagaagaagaagaaacttaagagcttgatgatgatatgcgaggaggaagacgaagacgaaggagagggacatacctcgtggtcgcagtcgaccatctgctgctcgctgagcacctccagcttccccgtggcgaggaagtgcgccccctccagcgcccccgacgtgctgaacgaccagcacgatccgcacgaaccctacacccccaccccccaaatccaccaaccaatcatcatcaaacaactccaacgatttcaaattttcaatccatcccaaattaatccgatggtgtgatccgatcctaacctggtccttgacggggccgacggcgccgtgctcgcgccagtcgaagtcgtcggggaggccgtcggtggggaggatgggggcctcgtgcggctccccgccgacgaggccctccagggatgggcggcggaggccgaggaagcggtcgcggaactcgcccggggtgaggtcggagaacttggtgacgccgtgcgtcgcggtggggtccagccgctggtgccgccgcgcgcggcggaggttggcggcgaacacggacatccggtacgcgcgctcgccggcgtcccggtacgtccgcccgaaccgccgctcgaagctcgcgaagtgcgcctccgcgtccagctgcgcgtcctcctcctccccgccgccgaccacctggtagatgagcgggtcctcctccccctccgccgccgatgacgacagcgcggcggcggaggagaggaggaggaggaggagcgccgcggcggcggcgaggcggtggcggtggcgcgccatggtttggtttttgattggttggttttttttttttgggtgagatttcttgtgtgggtttggctccgttgaattgagcgattatttatagtgcatatgagatcatgagatgagatgattggtttggttgctttgtgattaggttggaattgcttgggggtaatggcgattaagtatgatgagtgcagtgacaaactgacagggatgtccacggcgacgatgacagtgatcggtagcagtgtgaattcagtcatctcattgtgttttctccattttttttaaaaaaaaaacatttagtcctactttgaaaatagccatgtaaaaatcgttttaaaagtagtaaaccatttttacggagcgtcacatcagtgtcaaactgtcaatagtgtacaaggtttacaaaatcgttaaagaggaagtcaccttgctcccgagtggttttgtccataatcatgatttttgttcggttaaaaccaattaaatttggacagtttttttaaaatagaaaaggtaaatttccctgttaatggtgtctagtttacaattgttcagtccgagtctgactgattgcgtcatttaacaaatattctattctcctaatatattgacgtgcaatccttttgcgcgctcgagaaaaattgttcagtccgagtcactctgctctctagcggttttgtcgataattatgattaccgctcagttgcccaacaaacaattaaatttggacaattttatgaaaaaaaataaatttcagtttgatttttctatatagccggtttatcgagtggtttcttaatttgtacgggctcgattataataacaataatcaagcggttaacgtcatactccctcggtcccaatatatagcaactatcctatactaggttgttatatattaggacgaagtatttattaacaccctatccatcaccgtgtcacggttgtttccgactgtgtatgcgtgacatactaatgaagaaaaaattcacagctcacctaaagaagcgacggtaatatttttctagattttatatatgttaagacgtgtcatctagatagctttagtttcctgtagaaacgaaattattcttagagagtttcctgtgtttcaatcataaaaaaaaaaggaacattttgtggtgctcatgattaatgtcaccatttagttacttcctccgtccagaaaaaactcaacgtaaaaggaaatatgaccgttcagattcttttctccaacaaaaagttgaatgaaaatttagatattcatagtatgcttttcaaactatcaaatatcaaataaatataattttcaagtttgtaattattaaaactcaattaattatacattaatatcacctcattttacgtaaaacacttaatttttatctttatctatatgaattttaaacaccacctcaattgagtatttttaggagagaggaaatacgtctcaaattttgtgagtgtacgtatagcattaggtggttagaaccgtggagctgagacttgcacgtcaggttcctaaaatttgcacgtgactgttcaaatagacgttaaaaaggctttttgagcagtgaccatgtggcacgttgacccaatttaagttggtatgtgatagtatatgaaaacgtagatcaattataaaaaatcataatcatagatggtctcaaatggcagtattgtcgtaggctttctagaccttacattatattatatttgagggatgaagtgaataattcaagtcatcaaacaaacataatgaaacatccaacgcctcgagagaagaatattggagacattgctaggcctttagcctgccagtcaacttcagcctgagatgtgcccgtcaaaccactcgaaggcggtgaccacatgtgttacacattcaggagacttgacaaaaatggctaaagatctacatcatctcaaatattcttaactcatactcatgtgaatctagttcccaggatgtgcactagattcacactttcatctcaagcatgattatacatagcaaacacaaataagatgaaagcgattataaactacatctactttagttacattggccgaccggccaaataaatatatagaacagcggaagcttgtctacccaatccacaagcacacagactaggggtttaccccattaagttcaagtcctagaagaagcagttgattacccgcatcactcaaagactaagtctaaaacctgcaagcaaaagattaattcaatagcaagagtcaatacatggcaagcaccaagacaagcctaacaccctatttgcaaggcatataattgtggagattatggatatcccatatctacacggcgaagatatttggactgaatataggataccgaatatagatagaatatcttatgtgtatcctgggtttgtttcctaacttgtacgtcaaggaaacaccctaagatttagtcggtcacgactgtatttgatctgtatctgtgtattctgttagggatatagattatcttttgtaacccggactccttcccatatataaggggggtccgggcgcctctaggggcatatgttgattttccccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagttttgacagttggcgcgccaggtaggggttgcgtcaagcttttcgccgattagtgcaatgggtcccgtctccggcatcgacgaccccgtcttcccacccgggcaggcgtttcggttcggcagcctcgacttcgtcaccaacaacttcggcaagatttctctccttgactcggaatcggaccagtcgggagagaaccggatctcagtcccgtttggattcccaaacgcggctgaaagctacttcaagaccatctcaatcgagtcggcttcaaaccactcggctgagatcgcatcttctccaacatcaccagatcaagatgatggggcttacccaccgatactgatgaaactccccgacgatttggcggccgtctccatcacgacagcgtctccttcccgtaggcctaggcggaagtcggcttcaacaccgatttcgcctagcttcagagaagttggcgtcatcctccaaccactcggctcggtttcgacggatcagctggatgactacaacagctcttccaccgtcgactcgcgtcccactgacatcgtggagtacgacgagtttagctctcgctacaactacgcggatctcgacgacttcgacggaagcctagatgacaattacacccctctctactttggcgtcttcatggccaataacgagacggaggagcaacgccaagcccgggagaccgaagagcgccgccgactggaggaggagcatcaagcacaagaacaagaacggttacggcgtgagcagcaggagagtgagcggaccgcgaaggaggctgaggaccgacggcagcgagctttggaagcagggcgccgggcgcgtgatctcatcggccagcaagatgttgaagggacgccggtttttcgcacccctcaacagaatgcggttgccgcgatcaccctcctcgacaccctactcagggaaaacgagctcaatcaatctgatcacgtcgtcaacatcttgaaccagacgaagaccatgattgcagcttcggtcccagttaactccgagagcgtccacacgccgactggcagccgagtcccccacttccgatctcatgactaccgtcatccaagcctcagcatcaccggcacaggatccaatcgcaggagcaggggacacgacgagcggtccgttcactcacctcccgatcatcatagggagcgccgagtggaacggccccgctcaccacctcgtcgccaccccttcgatcttcgcgacacaatcatacagcgccgagcagctcgaggctatcatcactcgccggaccgccacgacgacgaccttgatggagtagcagccttcaccgacgacctgcgtcgagtggattggccagccggcttcaagccgactggaatagagaagtacgatggtaccactaacccagaatcgtggcttaccgtctatggtctcgcaatccgcgcagtaggaggagacagtaaggctatggcgaactatttaccagtggctttagaggattccgcccgatcttggctccatggattgccccgtggtacgattggatcttgggccgagttacgcgaccacttcatcgccaacttccaaggcaccttcgagcgtcccggcacacaatacgacctctacaacgtcattcagaagtccggggaatcccttcgagattacatccggcgattttctgaacaacgtaacaagatctccgacatcaccgacgacgtcatcatcgccgcattcaccaaagggattcgccacgaagaattggtcggcaagttcgggcgtaagcctcccaggacagtcaagctcatgtttgaaaaagccaacgagtacgccaaagctgaagacgccgtcatcgcatcaaagcagtctggtcccagttggaagccaaaaaaggatacgccggctacgggaggaggtggaagtaacaatcataaggaccgcaagcgtaagcctgcagaacttgttgcaaccgccagtcactcttctcgacagcgttcgcgcgtcaacacgttcgacaagatcatgaactcccaatgcccgcaccatcctaactccaaccacgtggccaaagattgtttcatctacaagcaatttgcggatcaatacaccaagactacacggaagaactccgacgaagaacaaagcacgtcgaagaagaaagacgacggcgacgccccggcaggatttcaagaccaccgcacggagctcaaccatatcttcggcggccctctggcttatgagtctaaaaggaagcaaaagttgaccgaacgggagatcaatgctgttcagcccgacacgccccaatatcttcgatggtcagagatcgcaatcaagtttgaccgcttggatcatcctgaccgagtggtccacccggggcggtaccccctggtactagacccagtggtccgtaatgtcaagcttcgcagaaccctcatcgacggtggcagtgcactcaacatcctcttcgccaagaccctggatgatatgcagattcctcgctccgagctaaaaccaagcaatgcgccttttcacggagtaattccaggattatccgcaactccactcggccagatcaccctcccggtcacttttggcactcgggaaaatttccgcacagagaacatcagctttgaagtcgctgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaatccgcgagatggcgtctgcccgagaggatatccgactggctgcagccacggcgagcgaaggagaaatacctgctaccaagacttcaaaaagtggagaaagcgaagccaagactaagaagattcacctagattcctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcattccttacatgtcaaagaagatgccaagcctatcaaacaacgactccgccgatttgcacaagacaggaaagacgcgatcaaggaggaattaaccaagctgttagcagcaggcttcatcaaagaagtccttcatcccgactggctggcaaacccagttctagttcggaagaaaacagggcaatggcgcatgtgtgttgattataccgacctcaacaaatcctgccctaaagatccttttgggttgcctcgcattgaccaggtagtcgactcgaccgccggctgtgagcttctcagttttttggattgctactcggggtatcatcagatccgactgaaagaatccgactgcttgaagacttcattcatcacgccctttggggcatactgctacgtcaccatgccgttcggactgaaaaacgcaggagcaacttatcaacgcatgatccagagatgcttctcaacacagattggccgcaacgttgaagcctatgtggatgatgtagtcgtcaagaccaagcaaaaggatgatttgatctcggatctagaagaaaccttcgcgagcatccgtgctttcaggatgaaattaaaccctgaaaagtgcaccttcggagtaccgtcagggaagctgcttggttttatggtgtctcataggggcatccaagccaacccggagaaagttaccgctatccttaacatgaaaccgccaagtacccagaaagatgttcagaagctgactggatgcatggcggcgctcagccgatttgtttcaagacttggcgagcgggggatgcccttctttaagctactgaagaaaacagatgatttccagtggggacccgaagcacagaaggccttcgaagatttcaagaaattcctcaccgagccaccagtcttagcctgaccacacccgcaggagccgttgttgttgtatgtatcagccacctcccaggttgtgagcacagttttggtcgttgagcgcgaggaagaaggccatgtccagaaagtccagcgaccaatttactttgtcagcgaggtcctagccgactccaaaacgaggtaccctcaggttcagaagctgttgtatggtattctaattactaccaggaagctatctcactactttcaaggtcactcggtgacggtggtcacatcgtttccactcggtgatatactgcacaatcgcgaagcaaatggacggattgctaagtgggctttggagttgatgtctttggacatatcattcaagccccgaatttcaatcaagtcccaagcgttagctgattttgtcgctgaatggaccgagtgccaggaggatacccccgcagagaagatggagcactggaccatgcattttgacggatcaaagcgactttcaggcactggagcaggagtggttttgatttctccaactggagaaagattaagctatgtgctttggatacatttttcggcgtcccacaacgtcgccgagtatgaggccctccttcatggactgcggattgcaatttccctagggataaagcgtctaatagttcgtggcgattcacagctggttgtcaaccaggttatgaaagagtggtcctgccttgacgacaatatgatggcatatcgacaagaggtacgcaaattggaagacaagttcgatggactcgagctcagtcacgttcttcgacacaacaatgaagccgccgacagacttgccaattttggatccaagcgcgagatggcgccctctgatgttttcgtcgaacacctttatgcgccgacagtacctcacaaagatactactcaagttgcgggcactcatgacgtggctatggttgaagccgactggcgagagcccctcatacgatttttgacttctcaagaactccctcaagacaaagatgaagccgagcggatttcaaggcggagcaaactttatgttatgcatgaagctgagttatacaagaaaagcccttcaggaattctgcaacgctgcgtatctttagaggaagggagacaattgctgaaagacatacattctgggatatgcggaaaccacgctgctgcacgcaccattgtcggcaaagcttaccggcagggttttttctggcctactgcagtgtccgacgccgacaaaattgtgcgcacgtgcgaaggttgccaattttttgccagacaaattcatttaccagctcaagagttgcaaactattccgctgtcttggccgtttgcggtttgggggctcgacatggttggcccgtttaaaaaggcagtcggcggttacacgcatctctttgtggccattgacaaattctccaagtggattgaagctaaaccggttgtcacaatcacggcggataacgctcgagacttcttcatcaacattgtgcacagatttggagtgcccaatcggatcatcactgataatggcacacaattcactggcggagtttttaaagacttttgcgaggactttggaattaagatttgctatgcttcagtagcacaccccatgagcaatggacaggtggagcgagccaatggcatgatacttcaagggattaaagcgcgtgtctttgaccggctaaaaccctatgctggcaaatgggtgcaacagctgccatcggtgctttggtctttgcgaactacacccagtcgggccacaggccaatcaccttttttccttgtctatggggcagaagcaatgttgccgagtgaagttgaattcgaatctttgcgctttcgaaatttccgtgaagaacgttacgaagaggaccgagtggatgacttgcatcgattggaagaagtccgcgaagcagctttgattcgctcggctcgatacttacaagggttgcggcgttatcataatcgcaatgttcgatcccgtgcctttttagtcggcgacctggttttgcggaaaattcaaactacacgggatcggcacaagttatctcctttatgggaggggccatttatcatctctgaagtcacccggccaggctcttatcgactcaagcgcgaagacggtactctcgtcgacaactcttggaacattgaacatcttcgtcgtttctacgcttaagtttatcattgtacttccctatcttgactgtcaacgtcaagttttcttcttgaagttgtcagtcgggggctattatcataatattggggtgtgattttttatcaattcaatttgcttacttggtttatcattgccttgttcgatttttctacttagtctgcgaggactgaaagtttttaatagcttctttgggttttaggctcaacaaagcttgataaaagcttttaagaaatcaaagatttggctagaactatcaagcacagcataaatacaccagtattgtacaaattgagcctccatttgttacattcatactcagtcagagtcagtcctttcatcatcagagttgttgttgttcggctgaaggtcgttgttgcggaattgctctacaacgtcacttgcaattttgtcagccgcattttgagcattgctgataagatcaagagcagcttcttcgcttgtcccgtctgcaaatccatcaatggtgtcgatttcaattctcgggtacaaggatttggtcatcgccaatgccatgctagctcccatacttccagctttcttgatgttcttgaaatatacatctggtgcaactctcagcctgtcaaagatttcggttgcgtcaagtgtactcggaccactgttattaaggaacatagcttggacaagtggtgtagcgacattggcgacttcatctctagctccttcaagcctcttgatcttaccaaccaggacgtcaaactgagcttgagatttgattttacggtctacaaaacatatttataataagaatctgctgcattaaaaagagggaagttcagattgacaactggcagtaccttcgacctccttcaaggccgagtccctttctgcagttagttctgctttgtcttttttcaaggcttcaatctgtttctccatttgagccattctggtggcttgcgctgtttgaaatccaaatggttgaggatatagttatgacagcataaatgggacagatctagagattaccttttgatgaaccactcagctcgtagtttgaatcctggagttgagcgattcggtcccttaactctttctccgttttcttggcatgctccttggcctcgtgtagctggcccctaacggcttcaagagttcccaaatgaggaaccagcttttctaaggttgcggtcttggcctcattgcgaagatggattctctgcacggtggttcatggattagttttgctaacaagaaaacaaagtcatcaaaggcagtcacctagaagacttacattcacaatgcgagtagcttctccaagtactttcttcagccggcacacttcctcatcttctttttggcgatttatgacaatgccggaaacttgagagttctcgtcccaccatttgagtaagataggaggacgagagtcgtcagctgcctttatgcggagaatttcttcttcgtcgccgcctagtggacctgatgtattcccaagacattagacgaacaagctggagttattcagaacggcatcacttgagaagatgagttacctgaggatgtgcctagctgagcgtgaggtgtttcttgctctttatccggagacccaatcaccgagtcattaccaaattctggtccttgagaagttgtctgcacttcagcttcaggaatctcttgatttagatctgcatccgactggtttccagtcgggggctcttgggttgttgcagtttcagtagctgccgactggtttccagtcggcggctggtcactcggattggccttgtcatctgaagcatgggcgccagtcggccggctttcggcagtcggctggctttcggcagtcggctggttttcggcagttggctcagcatctttggataaatttggctctgtcgcagccggatccggatctttcccagttggatctatatcggacggtttcctgcgaagtgttcttttaaccttcaatattattttcatgagagaagcatgccgaaataaaatggtaccaaggggtttatacctggaagatgttctaatctttggcatttgacggccagccagttttttcttgggcatgctacgctttgggagtttattaggcgagtccttgtccccagatttatcgtcgtcgccttcatcattgtcgagcaccagttttctcttgcgagaacctgtctgtccagttggattggaggtttgaggttgcggatctggtctgatttttggccctccacctccctgaacggtgtgctgacgaggcgaccggcgctgagtgattgggggatcagatttcatcaatgcatactcctgaatgagatgtctccacagttagttaactcagcatgaagacaaagatgatgttttggtcatagattgaagatttcagatgcatacctgcggaggcggattgaatgcattatatggcacaactggcagctgatgtgagtagctgacgacaatagcgttcgagaatatcttgtacatcctctccttcatgatcttaaaatccagagaatctgggtcttcacggtttggatcatgtttgccgtcaaactcaaatgctgtacgggatctttctttaattggtgccagccggcatttgatgaaatgccgagtaatctgctctccttgcaagccttgttctttgagttttagcatgcggtccatcaattccaaggcttgagcagcttcatctccgatcggaagagagttccaagtatcttggtacgttggaggaagacaagagtactcgggaagagcaggctcaggattctgaacataaaaccagttcgcatgccaccctttgtttaaggtcttgaagggcatagagaaatatttttggctcagagttcccctcaactgaaatcctgcccctccgactacacatggcttacttttgtttggttggggcttgaggaaaaagattcggcggaacagagcgaagtggggtttaattcccaagaaggcttcacaaacatggacgaaattggcgatatggactatggaatttgggtttaggtgatgcaagttgattccatagaaacttaatattccgcggaaaaatttcgaggtcggaaaagcgaagccgccatagaagaaatgagagaagaccacaatctcgtgtgtatcgggggtcggaaaaatctcaccgcacgctggccgccacccgatgatctccttgacagggagaacgccgtgcgccaccatctccttcaggtgctcttctgttatgtcggacggcgtccattggccttcaaagctttctttctcttccgccattgattctacccgaatgcgctgatttgattcgagggatggcttgggagaggggaggaattgaggcggtggatcgcgggaaggattttgatgaacttttcgaaggcggatttgagtggaatggtgaaccctagtttgccggcgcagctctttactgtagcaaggagtggggaaaatggcgagagttccggcggggaagacgaagcgtcgcttggatctcgggttttcttgttaagggtatcggaggtgcaaatgggcctaggcctgaacagtacctcagcccaatatttttaacagcgtggcccattgtgttccttagggacttaggcattttttgctttggcaatttatgcgcacaatagtgttgcccaatgctgataaaatcctttttatgcggtcatataattctttggaattattgctatgcaaattaaaaggtgcccgacagaaaggtgttatactgtttttgtaagcttttttaggctacaaaagctgtctgggttaacttggaatgacctgtttttatcatagtcatttccttggtatgttatatacctgttttcattatggtaatgaataagtctaatagcctaggctatgactatttaccataatttttataatatttggtgggtaatctttagagtattatactcgcatgcctgtcagttgtgttcattcatgaaccttttagagtgttaaccactcggattccttttattatggctaaaaagcagtcggctggaatgcctctttaggcgccgcgtatgcttttgtcatatgatgcacaattatgctattactttgttctcaactatatgtttagtttgttaactaatcacatagttgggggctacacctaattaggtgcatctattcgatgcaccatattctttatcttttcgccctttacagtcttcgtcttcgctactcggcaggccttggcacgaaaagtttgaagcactcggattattatctttgagaaggctatgatggttgactgcaaaggtctcgggggctactgtggagattatggatatcccatatctacacggcgaagatatttggactgaatataggataccgaatatagatagaatatcttatgtgtatcctgggtttgtttcctaacttgtacgtcaaggaaacaccctaagatttagtcggtcacgactgtatttgatctgtatctgtgtattccgttagggatatagattatcttttgtaacccggactccttcccatatataaggggggtccgggcgcctctaggggcatatgttgattttccccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacaataatcaaggaaggcataatatggttctttttagcataaagtaagttttatttgcataaaacatttctaaatcaggtttactttcaaataaatttcagcaagctagtacttgacatattgggcatcaaggtaggcattaatcatgtataaatatgcacctcattgccttccatggcagaaggagatcattctcaaatctcatcacaatttgaagataaatttcaacatttagaagaataaacacaagtctatactcaatacatatccacacgccactcatgaccgcgagcacggctaatcgattagttttaactctgcagagtttatacactttacctacatgatgcgaaataataatcatgcaagagcatggcacgcgatacataagtacccgatttattacccgcaacaaagcttttcaaaaattcatgatttagccttacactagtacgatacgtgttactccattctaagccatacacgttatatgacctagaaccgttaagtggcgggcccacgccttaaacttaacgccgtggtggcggacacaacgggaacccaccacgtggcacaataccgttgtattggacacgcttagtcacctaaactaccacttcggggtaaataggaagctcctctgaattatacgaactcatacacaccggcctaccagaatgtaaggctaaaccataaataatttactaagcttgggctatcccatactagcacatgtggttgcactgtatatgaaatgaactgacattgagtgaagtccttaggccggtttgggcacactctccccctatcggtacacaactaatcaccatatgtgcaccacttgaggcccaaacctaaaattcatgttttccatcattttatttatcaaaatcacaagtattaaagttctgtccagattatttaaaaatcaatcttcatgtttgtaatgagcccataatgacaaggaataccattctaagcatggctaagcattatagtaacctagtgactccaaaactcatatataaagtggtatagtcatattgttcctaaggttaggaatgagggatatggatatatgtggggtcaaggtgaatgcaaacaataggagtttgtctaacaagtttaacaaaaattttaatttattagtgtacaatcgacatgcaagatttacaaacattttcaataacctccaaaacataggttcaaagtgatcaaagagagggaggtgggacttgccttgaatcagaaaaatgtcagcacctaaatcacttcttcaccatttaagcaatcatctatacaaagtacacgttatgcaattaaacaccgaaatatgcgaaaaatccaaaatgctctaaaatgatgatttgtgcacagtgaatatgtactggtataatatgaatttaggtgaaataatttctattttaactctttttatttgggagttatgaattttagaagtttcctcagtataaggtagtatcacctaggtagtgttataaaatatttctataaagtgatgtttattagttttgacttcacagaggtgtagaggagtgttttctaagactaacacatttggtttcacaatttttggacttaatatgaattctttatatattttacaagttataacgtgttataggtgtatagtgttctataggttcatggctttagaagtttaggtccagaacttgcctcatctagctagtgatgtataaaatgagtattttagttaactaatctaaccttagttcataggcttatggtctttattatcatggttcatattttataaactaggggagctatagtccatgctagcaatttattatatcaacctataaattattatatgagctaagtgccttaagttttggtggatggggatggaactatgcattcactggtctaacaagttttatttgggtttcattatagctagagtgtatttctatataaatttatatatatacatattgcttaatcgatactatgtgattagcacctatactataaatttaaagtttagagctataacctgtacagaaggttccatattttattttactatgttgaagcccactgtttgctggttctatagatatttggttcacttcatttagactaaagatgaattttctacaatttttacaatttaaggttgctctatgttggttattacttacataaagaggcttttatcatacagtaagtatataatttattttataacttggaagtatatgttttgatgattttacagaacttgggtttactcaaaaaggatctaagatgaattttatatgaacttctaaaattcagcttatctaaaactagtcattttaaaggtaatagttttagaggcatttaaaatgagttgagatgtactttatatgcattttataagtttgtgtatgctttatgtatgatttatcttaggcccattttagagacaaggtttgtgctgagggtgccaagcttaatgttaccacattaaagttcatagttttgtgaacctatagaaatttgaatcatctcaaaataagttatatttgattttacatggattttacaagtttaggtgttttgctgttaaaaagtaaaggcttttagtattatcttttacatttttagattttaaactcatggggtccacctgtcggtctcaggccaatatgcaaaaaggcccctagggtttcaggaaatcaaaccgcagtcctatgactgttctgtgtgtcttgagcttttacagaaaggaccctatattaacctaaattcttgtgaggaggtccctggttcgagctgaagcagatcaagccatggctgagctcgatctcaagcttgccagcggcaaacggtggctcgtttgagggtgcgaacaaaagacaaaatgaagatcatgctattgcgattccattcctctacttttctcggtcagtggacatcggagtaacgccggcggcgagtccgagcggcggctgtgcttaggctgctactgcatgttgagttggtgctcgattctatgtgaatgaaatgcatgaatgcaatcctatgggctcaagggtgctcaccgaaccttgaacgaggcgcgggaaagtctggacagcggcagcggtgaagaagatggtccggcgacggtgtagagctccgggaagacggcaacggctcgatccactcatcgaattgacatgcatgtgttttcatggggttattgaggtcccagggatgtgtatacgcgaataatcggacaatggctcaccggaggaggcggaatcgacaatggcgacggcgaccggaggtgaagacgacggtagccgatctccgcacttgctgcgccattgcctaggattttttagggtttttgaggaagacttcaaggagaatgttaggaatttccccagcgatcgctagcaggaaaccagacgaacacaacgcacgcgtactgtggctaaacctgcaaattcgcagaacagaggaaacagagcaaattttgtgcagcgcttaactcagctgcttttctgtttacttccatatataaaggaacgaatacaacggaaacaactaaccaccaagaccacttctcacgccatgctctagatgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaaacggaaacatgcagataactaatcaactaactaaccgtggcacacaagattactgctaacagaactctccgtaagcttgagtattctatagtgtcac

SEQ ID NO: 1360 - DNA, 2905 bp, Oryza sativa
  unsure (1)..(2905): unsure at all n locations
tgcaacgagtgaatcattttctgctctatggaaatttgctcaaatccttcttaattgtctctctgctgtgcatatatagctcatgttactgccttgcttccaagatattgggttcaaatgtaagataacactaataggtatctgttgttccaaccataatctcgatctgtttaactaatgcagactctgtttgcttttataatgctcattttatacatcatatgtttacggaccattaattaggttcacataagtatgtgtctcactagacgctaccttccattgaaatattatttgttcatatcttatctgacatttccatcttataccattttcctttagtttgtcacattttaaacttgctgctgtaagtttgctaactaaccatgtgaaacaggtcaacattccttagtctcaatacttcaatagtgcaggttgcaattcactacctgaaatgctcatttcagctcaaagttttctaggctatcgtctgctacataaaatccaactgatatgtgagagtcctgctcctttaggtgtgtcacgttctgaattcagatcagtaaagttttagcgtctctcaggggtggacccaggcctggggcaacctgggccgcgaaccaggtcgtgggccgtgtagtaatggaccccccacctagatatacctctgaaattttggcccaaggcccactaaatcaacctaaccctaactcccctcctcagttccttagaagcgagagacagagatgggagagcggcggcgtggcgcgacgccttcttgctcgaggctcgctcctacggtcctacccagcacgacagcacgccggcgccgccgcccgcctggcacgccgtctcctcggctcgctcggtcgctccctacctgcctctgccttgctgcctccttactcctcagcctcaactcctctcctcatccggctccctggcggacaggcggacagcaccagtgcgccatcactgggaccggcggtcggcaacgagccgacaacccccaagggccaagggccaaggcgcggctttgtgctcatgagcggagcagcaagtacgggggtaagttttccatctctattttcttctggcaaattggtctttacttcttttctcaaatgcctaagtggctaagtgcctaaaatactgcagtgtctatagatctattgattccaatcaatttatttaacttgcaatagagatcagaagatgaagaggcctaggacttcattgaaatctttttatgccccagcaacacnncaatcaaattcagacccaaatccctccacaaacagcgggaaccggaggtagtaatattcagcaagcagcagctgttgttgaggcagccatagaagaaactggagctagagctagtaacattcaagttcaacatgcccctagtacttgttaggcagcccctagtattgttaaacaatggggaggttaatttccccaacaagaccaaaaccttcccaattaagaagcagtttagcttaatccggctgacaaaggtgctgatcgtgggcttagaaaaaccaattgagcaatttcatatagacattagagatgctgttagaagggaatacttgtcaagaggtccatgccaaccaattggtcataaatatccacagaagttaatgggaaatcgacaaagaagctttcatgactcgtggttcaaaatgcataattggttggagtatagtattgccaaagatgcagcattctgtttttattgttatcttttcaagcaaccaagacctgataattttggtgttgatgctttcacaagtaagggctttactaattggaaacatgcaactggatcttttaatgaacatgttggtaaagtagatagttttcataatagagctagaaaacattgtgaggattcaaaaatcaaagccaaagtgtatcatataagatggatagtggatctaagaagttagagcaccaatattatggtcgtataactatgatattgggtgttgtgagatttcttgtattgcaagcacttgcttttcggggtcaggatgattctcatgaatccagcaataaggggaactttctagagatgatagaatggtaaaaggagaagaataaagatgcccaaaaattacttggaaattctcctgggaatcatctattgacttcaccaaaaatacaaaagcatttgtgcaaggcttgtgcaaataagacaactagagccattctaaaggatattggtgagagaaatttcgccattcttgttgatgagtctcgagatgcatctattaaagagcaaatggctgttattttgaggttagttgctgtcttttgcattttccttgttcttatattttgaaactgaccatattaacaatggtattattctatgttatgtcacataggtacatcaacagcaaagggcaggtgattgagagatttcttggggttgaacatgttcctgatacaacatcagttgcactgaaaatagctttggatgccatgattgttagtcatggtttatctatgcataaagtgagagggcaaggatatgatggcgcatcaaacatgagaggtgaatttcatgggctgcaaagacgggtattggatgaaaacccctatgccttttatattcattgttttgcccatcagttgcagctagtggttgtgtctgttgcaaaatgttgttctcctgtctcagatttctttaactatacccccatgattgttaacactgtcaatggttcttgtaagagacatgatcagctggcccaagaacaccatgataatcttgtgagtagtttagagactggggagatattttcaggaagagggaaaaaccaagcaactaaccttgcaagacctggggatactcggtggggttcacatcacaaaaccttgtgtcgtttgcagcaca

SEQ ID NO: 1361 - DNA, 610 bp, Oryza sativa
gacatttatagctgatgtgagagcagacccacatttcctaagttgcagtgacctggtaatcttgcaatgaagatggttcagagtgatagacatacagtttttcctttggtttatcggctcattgaattggctttgattttgccggtggcaacagcaacagttgaaagggctttttcagctatgaatatcatcaaaactgagttgcggaataaaatggctgatgaatggctcaatcatcgcgtggtctgctatattgagagagacatatttgcaagcattgataatgataagatattaactcattttcaagaattgagaaccagaaagatgaagctacctctccctagtggtatgtcttattcttgttctgaaatttgtgtactgttaactttgattctcattttctcaatccatggatgtaatatgtgattctttttccaataggatcaagatctggagctacaattgaagaattcaatgaggatgatatagactccgaggaagataacacgtagcaaggtatttgaaaatgtatttgtacttctttttcgcaccgcaactaaatttgtaccatacattttgatcgtgcattagtattagtagcaaacta

SEQ ID NO: 1362 - DNA, 2585 bp, Oryza sativa
  unsure (1)..(2585): unsure at all n locations
attattaatgttacatcatttttttctttttttacttttatttgggaacacgcaggagatccgtgcatcattttattaagcaatttctctttttatttgttgtcatttagtatgaataagatgtgcaacatatatagttatgtttatttttgttcatctgttactcagcttacaccaatgccttttatgacaaatccacaaatgctatttctccgcaacgaagtattatgttgcaaagcgtaattaaaggagtgcacttagaacatcagttttgaaaagatgtggctatacattaagctccaacatcatacatgaatatgtgtacatgaagatcataggaccagacactttctctagaagaattgaatctatatctcacatcacacaacctgtacgcaacctgcacagctagctagcccccatctcgctctcttcccttctttttggtcttttctcatttatctcattctattatctttagttntcttttaccagttgtcgaccttgttttttaaactgcatagcatttccagatgaggaaagaacggtacagaagtttttgggcattttaggcccaaactaatgagaaacattgaggtatatctaagctttgtttgggggctcgagatttcgaaaatagagaaactggaaagctgtcttcatgaactatatctgacctatatcttctaattaattttttattctataactacacgaattcttatattttagttttttatttaaattctcataatttagttgagaatctgaattgtttatgaaagttagagcattcgacaaaaacttagctgatagaaactccaccaaacaaagatgctactggtaacaatataacagtaccacaatgctatttttagaatctgattggctgacatttttttttctgcggtttataagtgtttgaagtaacagaaaataattttaggacaatactttactcatctacaatttaacggtttaaaatccaaagttatgttggaaaaaaaacaattacaaacatatagattaattttcaaattaagattttgttagtgatataccctagaggcaatcatagagatgattgtatcacatactatgtttacatatttatccgactttgttccttgaaatagataattaatgaatatgtgattctttcatgagactctttatgttgtgggttgctatttctaaaggatccctgatcaaatatcatatgtagaccaaatatatttagatgatcagcacatgtattaattgatgatcatgtctcatggatcatggtatagagataccaaaattataatgtgaacacatgtaagtgaacatgttattgaatagccccaacataataagacactgcaagagccatatgtgttgtgtcatcagtgatctcatttagtattggtgttgaatccttagacctgagattatcatggttcctaacatgtgtagtagcttacttaggacctgctaaacgctactccgtagttgagtagttataaaagtagttttcgggtatgctatgaaacatgtagtgggatatgaataatcaagatggatttgccccttcttatggagatatatctctgggcccctcgatgttgtagattatgaaagtgcatagccatgccaaaggtgattgaggagtcaatcacaagtttatatattctatttaccaaggttcgagttgaccggtttgaccttgttagaggatgggcacatattctagcctttaagctttaatcgatattcgtgagcgcaaaggggttcatacaagtatacactaaaggttcagccgatatgatctttatgtatgccccgtgggtcaatacactctgctaggggccgctgttgacgcgtgaaccgaaaaggagtttttgggttacagccgagtgtacatgaacctacagagtcgcacgcttaatgggctagaataaggggattggatggagatccaatatgagcttgattcggataaggatccgaataggagtcctacgggccttggaggcccaagtgatggatcctatatattcgtgagaggtgtgaccggcggaggtattgcatcatgtgagaaaccctagccgtcactatcctccctaagcaaaaccctagccgcgcgcgagtgctagcacatttacgcgtggcgttccgtccctatacgtgtggataccggtagaggcgccgctggtttgcggtactgatcagcatgtgaatacggcgaggagaacgcacgaggagaagaagatcgagctggtgcgatcgactacttcctctacatcgacccgctacttcgcgagaattccttcgacttcttagcgccttctttcgctgcgcagcgcgtcgagtggtaacgatctatgatctaatacttgtatggttcctggtttacgcgatagaaaattttaatttatactatcgtagcctacgtgtatcctaacagatttagcctattactgagaaggtcatcaccgatggttcctatatagtaatgccttaacggggtttacctagatggttttgaattatctgataaaatatatgctacttatggttgaaacaagactcatttgtttaca

SEQ ID NO: 1363 - DNA, 325 bp, Oryza sativa
aacaagggcagaggaaaccatggcacgatcattgaggtccaacttcagctgtctgctttcaagacatttctggatcttgccgataatgatcttactgggaaggatttcacggaggcctttgacgcggcatgttttcctcttacactcttctcaaacacctttgaccaaggttgggcatcaggtatctcggcagctgcaatacaaggactcttagagttgttagtagagggtggtgccgataatgtgaaccagtgctttcttgaggctgctcgctatggaagcactgaactcgtgcgcatcttacttcaggtaataataaaaacaa

SEQ ID NO: 1364 - DNA, 977 bp, Oryza sativa
ttttcctttttatttcatactttctgatattttgtctgttggtgcaaatatatcatgaaacattagcagcgttctaacatatctgttgtttgtatcttttttttagattgctcgaaggaatagcttggacatcgatgtggatctagcccttggctttgctgctcactatgggaaactggataccatggggtgcttagttgaggagggtaatgcggttgcctttcttggccctttaatgcgggcagctgaacggggatgccttcaagttgttgaatggttcgtcaaccttggttgtcgggatatggagctttgcttagcccttactgctgcaacctctagtagccaggttgcagttgcagcctatcttctccctctagtcccaaagcatgttcttgcacccctcagcgtcgaaattctcaaggctgctggtgagaggagcaccggttccctgcatggtgtggacttccttctccgctcaaacttcctcaatgacccagctggcacatatgctgtagcagacaacattgcaaaatctgccgatgaggcagtggatgcaaagcttagatctttcatgctcgagcattggtcagaggcagctttttcttgaggattcgcgtctgcgcaagagcactttcgtaacttcatgaggataatgaaaaagggtgagtcgccgatctgcctgagggacctcccacttgagctggtgattgccatggcctacctaccactgtacagggaatgcgtggagtcaggtgggcggctattgccgcagaagctgagagggcagcttgttgaggcggctggtagactcgagggccggcaactcgacagggctagccaaggcacagagctcctggccatcttggagcaccacctcccgtgtttcatgatccagacttgaaaggtcagcttccacatgatctgcattggtcgctgcaagaagcaaagtaacaagggcaatgcaccatcttcagtgt

SEQ ID NO: 1365 - DNA, 1181 bp, Oryza sativa
aaaattctctggtgattcctaaattgttctgcatgaacatgattgcagcctgtttgtgtctggtgatttaccacagggcaggcactgtgtcgttctgatggtttcagggcatcatcaatttggatgttgcaaccatgaaaaccagcaagttaatactcctatgtcaggcatcagacctggaccctagattggtcaggcataaatgttcttgtttagtactagtaactactcctatgtcaggtatcataattccaagggccaattgaacaaaaaataatagacttgatgaatttacatttgagtagcaaagtccaacttttgccataggggaaagcaagcagtgcatctcatcatttttttagtgtattgaatgaatatgaatggtgttctagaggaatatcccttaaaaatgagaaatgaagttaacaaatacttagaaaagcagggaagaaaatggtggttcttgtcaaacttcagagattttttttctttatattggttcaagccttttagttcacaaacaaaaggagaaaaaatatttttgaaggtgcatatgatgtgacatgatattcctttttcagtgcacaagggggtgcgcacaccactaatcatggtgttattctgtagttctactgctaacgaatcaagcatgtgccacatgtcccatgatctggcaattttttagtgtcaagggggataagaatatgttctctggttctatttcacagagagatattataatttaataagaataatgagtgtaaaggaaaacataaagttatataagttctcctaattgaccttaataatagtggattggcgaaagctcattttaggtctctgatctatggttaagtttaaatcgcttaccaggttttgcagttgagggacgtggtttaaactcgatccttggtgagggacccaaagtaaacttttttctatgggattgatgttatgatttcggcccatagggtattgaggcccaacaggtgatagtctgtaaccggaattttggcccattaggcacagcataaaattgtcagctgctctagacatgaccaacacacagtctgcccttactccctaattctctggttccctgatgattttcagaacactgaagccaattaggtgtggcttgactggagaaatattgctttgtcgatttgagatctgaagtt

SEQ ID NO: 1366 - DNA, 2387 bp, Oryza sativa
  unsure (1)..(2387): unsure at all n locations
atgaataaagatccaaattgcactcccatgactacgcatggtacttgaataatgtaaacaaaaatttccggaagaatgaaacatgaataacgtcgtgaacttgaacatgaagtgaaatatgaatatgtagcataataccaaaaccacataattgataatacgaagcttcgaataataattgggtaaatgaaaccaacaaagcaacacggtttatccatcacacaagtccatcttgtacttgccttaacttcttcgataatccaactcaactcctccaacgttggaaccctccacacctgtggagaaaaactacgcataaaccactatatctaatgatagttacaagggacatttactaaaatcgaaacctagaatatataaaaaattttaccgatttatattaaataacctatagctgttcccttactgttttatgcgtaactcacaaaccgtctaacgaaatctatcaaataatataacttcggacatctatacaaaattgtctacaactttcatgttgggcgaaaattccgattatgcctctgcaaatcccagattaaggaaaacgaattgctgtcctgatttccggatccggtcagcagtactgtttctgttgtttctcctaaaccatttatcggaatcaagggaaaccagcggcgttagaaagatatcgacaatggctacaaactttatttagaacaactaacctgaatcccgacggtttaatatcagatttgaaaatacggtttcagcctataatcaataacctcgaaaattgcacaaacgactatcgaataaatttctatttgaatcaaatacttctagagagtagccaaaagtaccgctgcagtgtggatactagaatctgagaacaaacctgctagttgcaaaatcaccgaaatccccaaattccttcttcctcctgctctcctgcgcccttctcctccctaacagcagcagtcagcagcagtcgtcatcagcagaagcagtcagcaccagcagcgatatgaagagaccagatcgcagcacatcaaggcatcaagccatgcattagcagcagcggcaattaaaagatcggatcggcagcagcaacaacaggaatttggcagcagtagctcagcaagaggcagccgagcagggaatcgattggcggcggcggacgacgacggctgtggcgacgccgtcaccagcagcggcggtgcagaggcagggttggggaggacgacgggctagggctagctgctggtgtccttttcttcttgttttttttttcgttggttaaatagagagccgagagcctaatcaatatcgaacgacccatattaatttgatcacctggatttcgttcggactccgattacaataaatttataggctattttgcactactcggcgagctctacgcattcacggtttcttgatgcttattcaaatacagttaaaaagttaaaattttgccgtttggtctatattcttcgaatatactaattcgaattcggggtatacagctaccccatgaagtcacgagccttcataatttattagcttgaatatcagatactggaattgaaaaattaccagaaaatttcgtttaatggtcaatatatggagttcttaaatgggtatcatagtagtgcaaagcacgactacatggctagtatttctcgaatgggtctaacgaaataactgacgaaatagggtggtatctaagccttggtggttccaaaaggttgattaatgataatttaactaatgactaggaaattttaacgaaacagattttcttctanaatttccttttgaaactttgctaaaactcttacgaggcttgctatagctgaagtaattgcattttccatcatgtctttcactaaacctcctttcaactatataaaaccaaatatatgttcctatcagccaaacacgttaacaataacaagaagagaaaattccatgtgtacccctgaaagttcgctcaatcccttctatacccctgagattttctcattcccttccatacccctaaatttcagtttggatcttttctataccccttccatcagttgaccgttaaattcatatcataaagtccattttaacatttggtataaaaaaatataaatttatgaattatattgatggagtttataaatttattgtataagtttattttgtgagatattacttaacaaaaataatttttatctcgcataacaagatttatcttataaaaaattttgtactactataacaaaatatgctatatatacagtttttaatggtaattttttttgttttatctaaaataaattttgtcatagataaaaattatttttgttttcccttcacgaggtaaaactaaaatattacttttgttaaaaatatct

SEQ ID NO: 1367 - DNA, 1260 bp, Oryza sativa
cagtttatgtttcactcataatcccaaaattaggaacataatatcaacatctaagcatcacaacacgttacatgtgcatattgctttgagaactaaagagaacagaaaatatccagcaccaaacatgtcaaactagctaggaatgccaatatctacccatgcctacctccctcggtgtgcccacgggcatgcctgtttaccagccaccacaagtagtgagacaatgttgaaaaaagaagtctgcaagcattataagttcaatacacatgtacgtagcatatataattgagttgtaaagtcatcaccaacaagcccgtaattacaaatattaagtgttcggacctttggaccttacatccacaacacatcacaaatataacaggatgccacactagtggtatggtctgacaatcagaccatatcaaggagatcagagttataagttttacccaaccgaaatctgagcttcaagactgtccattcaccaataccttagttattgccggcaataaaactgatagcaaacaaattccaatagccagccatagcaatcgtggggctaatacggtgtataaaccagttgcaaatgccacagtagttgccatgtatgcaaaccacatgagcttcttagtgaaggacctataatgaagcaagaactgaagatcctcccaccttgctatgatgcaaatgaaggcgacaacaagtgaggaacacattgccaatgtgtttgcgatcaagaatgacaaatgcaaattttcttgccaatgggaaatcccaagtttccagcatcgctgctataccctccaggtaaggtgaaagcagcaacaaatgtaattgtagcaatgattattgcaactaaagaagtgttgctcgtatatgtctgagtcagtgacttagcatctttcattgataatttatttaatttgtccttggccatcttatgaagaatataaacggacattgcactttggggatcaactttgaataaaagcatcaacacttcattctgcatatattaaaagagaggaacaaatgactaaatgtgattggtataacataataaaaagccttgatatctgtgcctttcgagtataagtattagcaaaacatgaaacacctttgtaatttttctttgggaaaagtgagcttgtaaagtcatttagaactcaacacgtggtgcaaagaaaaacctatttatatgcacctacaaatagcgcactatgcatagctaatttgcgaccataggtattatgggacacc

SEQ ID NO: 1368 - DNA, 2758 bp, Oryza sativa
cgatcatttctctagtagtgaacatactctgtagtactccatctgtctcaaaattaatataaccgtatattttaaatttgaattatatggctgcacttattttgagacggatgaggcagcgatttataactcattctttggacttgtggtggccaagtttaagaactatgtgctattattgtttaaaacatagcaatacaaaacagacgaagggagaaaccaacatatacttcttgtgaaggggtaactagaaaggatgattacgtaagacgaagccggcatcatgagaagaaagccgagcaaatagcggagcaagggcatcgtgcacggcatcgatgcagaagacgcagtaagcaacggtgatggtgctatgaaagtagatgcagaaaaggagatatggatttttacgtggaaaacctgtaacgggaaaaaaatcacgagcaccaatcaacaatgatcataatttaggaattgattacgaacatagggtaataacaatatgaacgtcacccccttctcgtatatcttacaagagtatacagaggagatataataaaagactcatgatatggaaagacatatagagttctattaaaaaactatttcaaatatattgtaagtctaaaattcagatcacatattgaacagatggaagagaccatcgtggcattaatatgtggaagccgtggctcaagagattggaacgcaatgcgtacatactacggttgggagagtggcgagcagggtgcaactcagacaccatgaagatggtgtgaggtgcgggcagggttttaggagtggaagcgaacgtctgatattcccttcgtcctataatataagggattttgggtggatgtgaccgtatgtccaaattcattgtactaggaagtgtcatattcatccaaaaggaaaacgtacgaattccgccctgaactattgcgtcagtctgatttaccccccctaaactcgaaaaccagatattttacaccctaaactatgtaaaccgaacatattacccccttaactcaattcgaagtcgttttatcctacgtggcgtacatgtggcggtcaactaatttttattaaaaaagtccatgggccccacatgttagcttgtcccctcttctctctcttttcgccaatgacgagtgccgggtggcggacctccatctctctctgcatcgagaggcaacggcggagagggagccgagaacggcgatgggcagagctcgggcggcgaagcaggagcccgcagctactggtgctcagggcggtgaagctcgggacgcatgtaattgctggcgcacggctcgttgaggcaacagaggggatgcccgcagccgccggagcttgagtggatggagggggctgcgaggtgagctgaagacggcggcgagcgaatctcggggcggcgaagggggcactcacagtcgctggcgcttggggcggtggatggagcggcggagctcgggacgcccgcagccgctgctgcggccgccgcctctctcttggtgcaacgccgcgctcctcaggcgcttaaggtggtggagggggcagcagagctcgggacggcaaagggaccactcacagtcgccggcgcttggggcggtggagggggcggcgaaactcggaacgcccgcaacggctgctggggccgccgcctttctctcggtgcagcgccgcgctctgctggcgcttgaggcagtgcaggggcggcagagcttaggacgggcaaagggggcactcacagtcaccggcgcttggggcggtggagggagcggcggagcttgggatgcccgcaaccgccgccttcctcttggctcagcgccacgcttcgccaaccctttgggcggtggagggggcagcagagctcaggacgcctgggactgccgccttcctccccgccgcagcctcccggctgccctccatgctcgcctcacccacccaatcgcacacaccgttgccggctgtgcggacctgcacctgccacacagagagagaataggaagaggtgaagaggatgtatgacaggtgggtcccacaatttttaaaaggaaaatgctgactggattgccacgcgtacgtcacgtaggacaaaaccgctctagattggatccaggggtaattcgtctggtattaaaagtttaggtgagcaatacctagtttcatgttcagggggtaattcggtcaaccacgataattcggggggtaatttgtactttttcctatccaaaattccttatattacgggacggagggagtactatataagagtattgcattttggcttatttgaatctaaacttggaaaggagaaaagataaaggaatgagtggcaaaggtgtggcgtgcaaggggtacagcgccatcgattttcctacaccacacgcccccaaaccgcctgcctctacctgtctgtctgccgccagaggtcaggcgcgtgcatgcactgaacctgctgccttcttgcttgggtgcgatgcgccatggcccatggatgattcgctccttcttcctttttcttcttctccctcttgctttctcgttgagtttaatgagtttgcgtagaatcctcgctttgctgaatcgaaatgagttgcttccctttttcattattactactgctaactctactcgagtttaaggctgagttggatacagcataactaccgggttttttcacggcacatgaaagaagaggtattatcgaattattaggtaactattataaatttcaaattttgatttatttgatttt

SEQ ID NO: 1369 - DNA, 775 bp, Oryza sativa
gtaaaaatggttatgaaaattcttgatcgaccgatgcttcatttccgatttttaccagccgagcaacatggaaatgattaccgatgaaaacagaaatgaaaatggtaaaaaaacacatggaaatggaaatgattttaccttttttatattatgataattatcgtatttctaaatacactaatatttatggcctatttctttatttgattcatagtttagagcccatcaacttctcaaccaaatccctaactatagttcaaggttaaaagaagacaacttataacttatacatagtgtaaccttgaatttgttatattatagttatgcaaaattaattgtgcgattttacaatccaatgtttccgatatttattatcggctttcgatcaataccaatatgtttatgtctgtatagcctatttctggttttccgatatttccgaatatagcccgcctcctccacttgtcaaacgtgggtcccgcatcctctgtctatctttctcccatctctcttgcttgtaactattatacatgggcctaaagagagagaaaaaggaggaagacactgacatgtactcctctatcctaaaataaattaacctcagatatggtgcatcctagtacgataaatttagatgcccttatgtctagagtcgttgtactagaatgtgtcatatcccgtacaagattggtttatttttggacggagggagtagagcctatataatttggagagtgggatatgaagggattgttggagtaaaaaaaaaaaggat

SEQ ID NO: 1370 - DNA, 721 bp, Oryza sativa
cttcggttgggagtggtattttaacgaagcccactcccaaaattgtatttgagtgaaactcatttttgaagatgacataatatcaattttcttaaatggaagaaacaatgaaaatgacaatgtagcgaatgccagcaggttgagagtggcattcaagcgaatctcaacgataacattctagcgaaaccggtttttaaggatgtcacatgtgaatttctcgctgtaggatggctgcatcccgataggtgggacccacatggcattggcgctgcgccattcgcaaatcaagccaaacagcaagaagattcatcaactttagatagatgcactttacattcagacattcatagtcaaccttagaagattcatcaaatgtcagcagttgacagcatcacttaaccagcgctacatacactttacattctctgaattccaaattaatgcctttggagaaagaaattatttagacaatcaatggagacaaaatgattatattattattattatttctaatgttgctttgaattgccatcatgaacagaaattttaagcgaaggagctaaacagttgtttgttacagaatatcatcgactgagttcgccttgattgatagagtcagcatagcagattcatgtcttcagttgacaggatccttaaccatcatgacagatgacaaccacatactctgaattccaaatcgacgcctttcggcgaagaaaat

SEQ ID NO: 1371 - DNA, 1317 bp, Oryza sativa
  unsure (1)..(1317): unsure at all n locations
ttccccgtccccctcccccgggacggcgcccaagaccgccaagaatgctgtcgctggtgctggtggtggcgcccagcgtcgccgtagcccgctcaccgatctcaactccggtgacgcctcccccgcgcgggcgggtgcttcaggttcctcgtgtcgtccgcgtcgtccgggtccaggtcgaggacccccgtggcgtcccccaaggtgaagaagccccgcccggagatcgggcggcgagcccgggtggtggcggccgcggatccggagtcgaggacccgggtggtggagaagatgatgacaagggggagggcggagacggagacggcgaggaagcatgcgcccccccgagggggctgccgcttctgggcgaggccctgacgccgcagaggaaggcggacgcgggggccacgccggcggtgtccggggcgacgccgccgatccacgcgtcgatctcgcccgaggtgctggcgtgcgggtccgccacgccggcgtgcttcgcggcggggcaccacgtcgtgcctggggtcgccgaccgccgcaagtgccggcccaggggcatcttggccatcgccggggaaggggcgagcgaggagctcgaccccgacccgtccagggcgtcgatccactggctgtcctcaccgtcgggggaggtgcccggaacgtgctcgacgaaatgcaccaacgaggcatccgtcaactggctaccgtcnccgcacaaggagcgcggcgtgattcttctcgacgatgagatctttgtcccgaggtgctctttggagtatgcgttctggcaaatctccccctaatccacggggctgttaagctcacctgtgctcaatggtctattgacctttggcacgccggcatcggaattgtccgagacgacaccgtcatcaggatttcttcccctgcagaagacgccaagcaccggtgacagccttagtcccttctcactcattgtgaagagggcatcacaatcactgtcctctagaggactgaagtccttgtgttcccagcaaggaccaggcagctgcagctatggctcggcagctgatccgacagcgatctccggtgagtcatggagcagcaagtgctcagggctgacgaggacttgcagtcgccctttgacgaaaatggatccggtggtcgaatgtctcgagatgatggctctgtccccaaggcccggggatgccgattattgcggaaatggtgccttgcctgcaccattgcctgaccttagcttccagtttgcaggtgctccaatgtctctggaatccatagacttgacctcttttaagagatcacctgtggcatagaatt

SEQ ID NO: 1372 - DNA, 554 bp, Oryza sativa
gctcgccgtcgcccagacaaggcggagaagaggcggtgggtggacgagcaggtggggcttcacctggcggcgagggtttgggacggctacagctacggcgccggctacggcaagggcggcgccgtcgacgtgagccgctacggcgacatcggcctgaaggcggcgctgggctacgagttcgagcgaaggtggtggttcgccgagatggcgcgcctgctcgccttggtcgacgaggacgacgcggcggcggcgccgtcaggcaacagcggcgacaacacgccggcggcgaagggtgtgtctggaagtagtagtaattaattagttggttcgtccagctattgggtgtctctctctggaggcctaatatgttgttgttaatagtgttcatcttttaggtttctgtcagtatatattttgcagtgttcaattgttcatagttctgtaaaaaaataaaagttgtacgagactacgagtacacttttccaaagcggaactgctatccgactgtcgacagtttttacgagcgaaaactgtcaaattttttagccattgat

SEQ ID NO: 1373 - DNA, 686 bp, Oryza sativa
tcataggatagcagcagtaatcaagcattgccaaggcaccaggcaagaaccctgaacctctctagtactcgtcaccctcatcaccctcgtcaccatcgtcgaactcggagccgacctcctcgtagtccttctccagcgcggcgaggtcctcgcgggcctcggagaactccccctcctccatgccctcgccgacgtaccagtggacgaaggcgcgcttggagtacatgaggtcgaacttgatgtcgatgcgggagaacacctcgacgacgctggtggagttggagatcatgcacacggccctctgcaccttggccaggttcccccccgggaaaactttggcgggttggaagttgatgcccactttaaccccgtggggcaccagtccacgaactggatggtgcgcttcgtcttgatggtggccaccgcggcgttcacgtccttggggaccacgtcgccgcggtacatcaggcagcacgccatgtacttgccgtggcgcgggtcgcacttggccatcatggaggacggctcgaaggcgctgttggtgatctccgccacggagagctgctcgtggtaggccttctcggccgagatcaccggggcgtaggaggaaagcatgaagtggatcctcgggtagggcaccaggttggtttggaactcgttgacatccacattcagagcaccatcga

SEQ ID NO: 1374 - DNA, 742 bp, Oryza sativa
  unsure (1)..(742): unsure at all n locations
catcagggctcacatgtaccgacttctaggatatatttttttccctagttcctgttctagtttctcaatttctctatgtcaaatagttcacgcatttattggacacagggaaactctggtggtccacttgtgaatcttgacggtgaaattgtcggagttaatgtgatgaaagtttgggcagctgatggtttgagctttgcagtaccgattgactctattgtgaaaatagtggagaacttcaagaaaaatgggtatgccttccttctaagttgtatgatgccagttgcattgtactatttattcctagataccattcctgtgtatttcgtcttttcttttgaaatatatntgttcagttcaggttgaggttttttagtgataaagcctgtagttaccaactaggtacttttattaatgtgagaattaaatggaatgccttaattgtttcaacttggttctggggaaaaaaaaatacaagaaaccgtttggggttagtctgttttatgcattgacttttatgaatagttttcttttttttgtgacataaattccacatgcattgcactcttgtacaagaatgaattatgaggacatctagcatcatagtatcatactttcaaatcagcttgtaatatttctgtcaattttgaaataggtatatatctagtatacaccctcaattaccagaagaatccaacttcaacccttcaactacatgaccgtctaagtttcaccctcttga

SEQ ID NO: 1375 - DNA, 754 bp, Oryza sativa
agtagttggcactgctgacaccatatgagtgtcaaccaggttacaccaggatcaccagctgaacatgcaagatttcgtcctggggatgtggtcgttgaatttgatggtaaactggttgagagcatcaaagagggtaactaagctaactaggtgtatcacttacagtattcctttaggaacctagtaattatattgtcctgtcttcaatccaagagccaagagcatgttaacccatatttataaataaaatatttattccagatcattgatatcatgggggacaaggttggagtgccatttaaagttcttgttaaaagggcgaacaatgtacctgtgtctttgacagtaataccagagaaagcagattctagcagatgactcacaattaatcttgcttgaaaggttgagcaaagagtagtattttccagcacaactcatgtatcctatataatttagtttatactccctccgtttcacaatataagtcattctagcatttcccacattcatattgatgtaatgaatctagacatatatatctatctagattcattaacatcaatatgaatgtgggaaatgctagaatgacttacattgtgaaacggagggagtatgccctatgaacgctttgttgagtttttctaaccaggggctacagatgctctcctttccagaagaggaaaacaaggtgcgagcgaattatagtacgatatggagttggagcaacaagtcaattttgccagtggcatatgat

SEQ ID NO: 1376 - DNA, 791 bp, Oryza sativa
cagtcctcacctcatcaatcacggtaggctcaagatcgacgaagacagcacgggggacatgcttcccagcaccagtctcactgaagaaggtgttaaaagcatcatcacctcccccaacggtcttgtcaccgggcatctgtccatcaggctgcataggacaaaacaagatttcaacaaattacgccttaagaattttttttatcacaggatttatcaagacaagacgaacagggagtcacaggtgaaccaatccacataatacagcctttcagatagcgttctaatgacctttaagaatataatagcacctatcttcagatcagatcaaaagattactacgcagaaacgagcactacaaagcatgataccaaagaccatcaaatagttgcccaatctgtctaaatatttttttctgtgcttgctctgaaatagttcttagctcgcagcaatgtacatactacagatccacatactccgtccatacatgtgcctaagttacagatctattcataataagcaacaaattaagtataaacgggagtacaaatctaggtgaacagcagtaaaatatcaagatccatcaaccaaaggggcatttcagcacggatcatggcaatccaaccagatccgcatgccattcctatacaacctaggtagaaaatttgaaaaaacaaacaagcattgatcagatctatccgaaacaaacatacactaaccagatctaccaaaaaggaacagattatcagcagggagacagactaattcagtggatccccatccgaaacccccct

SEQ ID NO: 1377 - DNA, 11541 bp, Oryza sativa
  unsure (1)..(11541): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagacttttgtgctcgacacaacaagtttgaataaaacttttcagatagttcttgatgtgaccatcgatgttttcgatatgatcacttgaggcgatcctcttaattgtccgaaatgtggcgttatgcaacaaaattgaagtactcctactacattcagaagacgagaaattttcattctggagtaacatagtatggctgctttgataatttggatctgacattggtgctacacatcgaccttttcttcgtgaaccttgattttttttaaaggatagagtatgaaaaaaaattactaagattacggatctgatccgtggtcgtgactaggaaaatgaaaaaaatataccactatctacgccccgtcatcaccaacagaaagaccgaatagaatgctagcattagaccagctgtcgctaggccaacaaaagaactacaaccgagatcgcccaaaacccaacccttacaaccaacacaaaccccactctatccatatttatttttgggattgagggagagggggtgacagggaagaagagaactgctctcccctagacccttcgacgtggtcaacttgcataagctagggcgacaacccaaaaagacatgaatttaaagcgagcttgcactagatgtttgggaggtttcggcaagaggttacctagacgacgtctccaaggagagaagcgacgaaagagccgccaccactgccgtcgaggtctcaaaaagaatgcaaactgggatttcacccggcagtcccactacaggggatgagacggcacaccaacaccctcaagagggggagtgatgctcgaaaatgccaccattgttgacccgcccaaagccgggctaggtttcccctgccgctagccgacagcctatccatagttgacgtaccattgctccaatgccatctaacttccaccggcgcatgggcaccgctgcaccagagcccaccgctttgccagtctcctcgtggtgtcacccttgtcgcattgacctccgccatcgccggcgcacctcctcacaccgcgtcagccttcaccgccacctgtcgcgcctcctcgtgcatgctgtattggcatctgtcgccgccgtcgccgtgagctccgccgctatcggaaccacccttcgccgcgacgtcggcctcctactccactggtcacaaccaccgtgccaccccgcgcctcactgggttgcgccataggtctgcctcagggaaggggggatccaccccgttgactactccagccattgcctcccgtcggatctagccattgccaccgccgaccactcccgctaccgccacctctccaactcgatctggccaggggggaccagatccgccatcgggcgaggcggatctacctccgacgtggctggatccgccgcgcttaccacctgaccactgcctcccgcgacctgccgctactgggattactcgtggggagagcgtcccgccaccaccgtccttgcggtcagcaacgtgacgaaggacgaacggtcaaacatatgctaaaaagtcaacggcgtcaaatatttcgggacggagcgagtatcatgttctacaaaatggcttagaggctattgttcgctaagagtactgctgcatgtattgtttacttagataccggtcataaaattactgaacacataatttattatatctctaaatacatgaattaaaaaattatcgtgaagaaaaactatttgcgtaactgctcctcgactcctcgtttgatagatccgcatatttcgcaaaaaatgaagaaaacatcccgtataatacgctcgcttccacaggaaaaacggaaggagcagtaacttccccgcaaaacaattgaccgtggggtaaaaaagtaaaaaccgatgtgagcgtcgtctcgtgtcgctccaggaagacaaccaccaaaggctcctccgtccgcggcgatcctacttcgccgccggtatgcgatcgccggagtcgccgtgctcggccccgaccctggcgccaccctctccatcatctgcttccgccgccttgcccgtcgcttcgcgcttgcgtagcggcggcggcggccgcggcggcgatggtgatgtgccgacgacgtcgtcggcgtgccatggccgccgcacctgcgaggaggagtcgatcccactgaggagcgtggaggcggcacggtttcgtgctccgcagccggcgaatctggcgaccccgagtcgatcgatggtttacacccatgtgagccccccccccccccccccacaaacccccatttcagatccattttattgatagcagttgtgcatcggagtcattccaatctattttgcacagtcggatccattttaggcctagttatccatccccatgaggaagggattggaggggattagttaggaaattaatccccttcgaatccttttcaatccccttgggtgagggattaaatgaacaaggccttactgaaagcaattaagcattgttttgtttagtctgttagcgtgaagtttcaccgtatgcatgattgtaaaaatttgactactggcagggacctggggttagttctgacttggtgccgaaggaggggatggtgttcgaatcgtttgatcacgcgtacgatttctatgagaaatacgcatgccatgcaggttttgatgtcaggaaaagcagattgaagcggacgatacgggagatatgctgcgcaagggaggggaggcacaaatacaggggcgatgaggcgaacagggagaggaaacggacatcgaagaggactggctgcaaagcatatgttaaaatcaagaatgtcacaactgacggcaaattgtcatctgtagtttttgacgtcgtcgttatagggcacaaccacccgttgacgccatcgccatcgccatcagctgtcaaacaaatgaggtcgcataggaacagagctgacacggtgcaagagtgtcgtgttacccaaaacatgcatgaaggtcaggaaaatgtcccattcacatcaccggacgtggaaatcaggtattatatggtgctgttgaagtgcataggaacagagctgacacggtgcaagagtgtcgtgttacccaaaacatgcatgaaggtcaggaaaatgtcccattcacatcaccggacgtggaaatcaggtattatatggtgctgttgaagtgctgaatatttttttttgtcacttcgcatgttgtgttggtgcatcagtaaccccctacagtttcatattgaatctgtgatatttatttacacaggagggctgctaacaaacgcgcggagatggcggatgatatcaacaaactgttcgctttcttcagtgaatgcaagatgcagaactctaaattttactgggacatgcagctcgatgaggatggtgtggtgaagaacattttttggagccatgctagcagtcaggccgagtatgcggactttggtgatgcagtcactctggacacgacatacaagacgaacatatatgggatgtccttggcgatgttcgttggagcaagccaccatatacaagacactctgtttggttgtgcactactgcgagacaagaagatagaatcattcgaatggctattcaaaacgttcaaaaactgtatggaggattgcccctcgcctagatgcgtgctaacaggcaagtaattccttcaatgtttatgtcaacaatagctcatggttcagcagtaaacacattgtgaactgataagataagtattcactaatcttgtgtatctgcagaccaggacaatgtgatcgcggtggccataacaaatgtctttccgaagacaatacataggctgtgcaggtggctcatactgaagaatcactctgaggcactcaacattctatatgcaagggacgatcgcattgaatcggaattgttgttgtgcgtgaaccagacatacaccccacaggagtttgaaaatgcgtggtcgtggttcattgatgagtttgatttgcaggatagtgtgaccctgcaaaacttgtacgaaataaggcacagatggatcccagcgctcttcaagaaggactactgtggcaggatgacatctactcagcagagtgagagtgtgaacaaactagctaagagaaatttcgtcgatcaccaaaccaatctgcacagttttgcgcgtaggatgcttgatatcataatttcacgggaagcgaaggaggctgctgagaccagggcttgtttggtatgtatatcgttgcctatttttgcattccctgctgactagtgggccactttgtttttaataccatcgcatatgcagggcatgccgataacaaagacaaggtggtcattcgtggtgcagatgtcaagggtgtacacaagagctgtgttcaagttgttcgaggaggcattggatgattgcacagctttcaggatcgacatggacattggcaacacaaacaggtggattgtgttggacatggagcattctgagaagcatgattggtgccaactacaatttaaagtgttagcggacgttcagaaaggtcgttatgaatgtgagtgcaagcagtgggaacatactggtaagaacaaaactcttctgattccagtccgagatacataataacaaatttagcttgctgaattgtttgtttctgctggtaaattgcttatttgtgttaggtttattatgcacgcaccttcttcggacattcatccatgctcaggtcgagaagataccacctcagtatgtgctctgacgctacacgatgaaagccagaagtgacatgtcatttgacaggcgtgaccgtgttacagctggacctgacagtgtggaagaaagttaccgacaaaagacactgctagctgaggcaatggctattgtacggttaggtagtaagtcaagggttgcatttgaaatagccatggccgcccttaaagtgctgcgaaaggaaaagagatgcttccagacagcgtggcatgtagggatgatatcgttgcacgcaacaatggtgcgggcacatcagctgaagtcataagccaagaaccaccacccaaaccaaagactaaagagcggacagtaggtccagaagagaatgtatcacttggtgcaagggggaagaagctctgtactagggtgtgcagctggtgtggactgagggatggccattacacaactacctgcccaaaaaatcccgcaaacttcgaaaaggtaaggaaggcaatgagcaggggtagagggaggagagggagaccacgtggaagtggaaggggtggcggtcgcggcatggcctgtgtaggtaggagccttatggatgaattggagagggagggcattactgaacaggacagcaacgacgacatggtagaatctgatgcggaatgagctgcaatgcagtgatatgtcgtagtggaataggtttcaaggctgaatacagccgatgtctatagccaaaactgtttggatcaatttcagtaacgtgtgtttgaaaatttggatgttagtgatatggtgtactgttggccatttgattgttgctggagattcaaaatatatgcgcgaggccaattgctgaccgaaaaaatatcgcttgacccttgaattcatgttttagagatttatgtatatgtgcaaatcattatacgtaggttagaacaaagcatttagtttaaagataatccattccatgctatcgacaaagcgtgggttctaaaatattgccactgataaagttttattctacaaaataccatcaaacaactcatttactatgttttcgctattctcctctgtttctctctgttcatctcaaccaatctcaggtcataacaatccatcacaaccgtagccaccctatgttgttccagattctcaccaatcctgtcacgagtggaagagaggacaaacaaagaaccaagaaaaattcagacaaaccacaattgtatagtggcttttgaagatcataatattcgtacatccgaaataatagatccatagaacccctaagtaaacattagagaggctgtgctccaatcccgaactagatttgttcctacgccaccatctgtcaacgcaaccacaatctttataagccattcaccatttatcagatggcccaccagtgaagcaaagaaaaatcctaaggaccaattttctaaagaacaccatcatcgtctctacccatgtaacgacgccatgtacacgaagcccatagccagtcatacacctgtggatgaaagaaactacggagacaagatggccatatgaccacgaagatccgtcttgagtatactaataatggattattataaattagtaacaaaatgttttaagataaatctccaatccaacaaggcgtcgccctatctcctctgaaaagcctacccataacatacccaagaattcaacctttgagctgtgtaagtggtaagcccatactctatcctgatgtgagttaaataaaaagataatctctttaaaaggatggagtccaaggatataagtgtatccattcatgtcccatcgtaccatatcttccgtataaacaacgatgctatcatcctcagagtcccaaccaggagattcatcttctgatatttcttcattattcttgttctcgccacggtacgtattatgtttgatccatggcttaacagcttcaggattccagcggaaatctgccatgatctgctcgagactgacgtcgtgtatcagcatccactccatctgaccaccaccaagcagtacttcgtgcagcagccaaacctgaagacgctgatgttgtttgtcatcaattgatgcacagcatacccccttctttgatcttccaaggtaaatataaggatgattgtttagattgatatcgcttggtgacttgatcacttgatacttgtcatctaacaaggttattctgcaaaaccaacaaattagcaaatacttcccccgtttcgaaatgtttgacaccgttgactttttagtacatgtttgaccgttcatcttattcaaaaacttttgtgaaatatgtaaaattatatgcctacataaaatatatttaacaataaatcaaatgataggaaaagaattaataattacttaaagcaaaagataaatcaatttgctctttgttttctcaaactgattgtatgtttttatttaatttatttttattccttgagtttaaaaacgatgagcaaataattaatgagcttgagtgagtgcttgctctcttgttaagaaattcgatcaaacctgaataagtttaacttgaaaagaaaagtcaaagcgatgatctataatataaaacggaggaagctaataccttataacatcgttatttttcatctgaacgtgaagtgcaccccgccaataaacgccgtagaggtggtgacttgccatccaagatgagtagtgcacatcagcaatggtcccggcggcctcccctcgccggacgagcgaccttttctcccacctccccgtcgccgacgaatagacttgcacgacaaatggcgatggcggccactcatgctgtcttaccaccgattcggcattgtctttgtcatcacctctgcagaagacaagctcggggatggagaacacctcgtagtgcggcgagacggttgggtcaaacacgaggtactcctcgcgacatgagtcggtgaccaccgcctccaagtccgatcccgcggggctccactccggcgtcgggggcagccgtgcccaccgccgcgtggccgggttgacgatgtactcttgcattaggaggaggccgttgcagtggtcgatggcctccagcttggagatgggtgcgtcgtcgaggtagtcgagcttggggaagatccggtcgcagtgatggtgcccccgccgtgcgaagaaccccggtaggtactcatgtgcgaagtagaagccggagaagaagatgccggcgagggagagcgggaggaggtccgggcgcgggggcgggcaccgggtgtcgacggcggcgcgccaggccttgcagacgacgcggcacgcggcgaggctgcgcggcgacggggcgaggcggcggaggatctcctccagcacgtcgtccggtaggaggtcggccgccgccatgatgattcaaattccaacacctacagtgatatatgtacgtgtatataccgatctagcaggctagttgttcgttcatcgacttggcgcgtctggtccaacatgcattgtggaagatgattcggagaagaaaaacgagataagatcgatcgaactgccaaaaagcgaaacacaacgcggcgcacatcatatatatatatatatatatatatatatatatatatatatatatatatatatataaatgcccgtgcgttgcaactggtgaatgctattttaatcttattatacattaactgtgagaattcgcttggatatatatttttctagaaaatcatgtcaggttagtatgcaagtttttcttttcaagagattaaatcatgttaagttagcatgcgagtttttttcaagagattttttatacgactccttatgtattttcaaaagcgaacgaaattaaaacctagctcaaatatagatctggatttctaaaagcgaacgaactgtatttttcaatacggttaaaaaccaacacatacacggatgacgtaccagagtaccggtaaaattatcttcaatttttataatagtagaaaagttttggtgattttggtgtcagcaatctctactacttcaaaattttcaaaacgtttccttcgtccgtcaaaataaaaaaatagtgaaaaagcaaaaaaaaaaagtccgactaccctaaaaagtggaaaaaaaaccgtagatccgattccccctaaaaaaggaaaaaatagcgaaaaacaactaaaaaaatccggttccacaaagtggcaaaaaaaccataggtccgaacgtgaaaaaatccgattcctataaaggtgaaaaaaagtgaaaaaaagctagatccgattcccataaaaatagaaaaatgtctgattcctataaaagacgaaaaataaaaaaaatctaaaaaacatgtaaaaaaaagttcatccgatttcctaagaaagtggtgaaaaaatggctcgtataaataaaaaaacacgcatgaaaaaaaataaaaagagcggaaaaaaagcatggaaaagaagtccgatttctgttcgttttagtagacagtatatatctcttctctaattctaatctaatataactacttaaaaagagaagttttcattctacaactaaaaaaacatgagaaaataaaaacgattaaaaatgcgtgagaaaaaagtcagaaaaagcgttaaaataatgttttctgtcttttgtaaaaaataaaaaatgcgtgagaaaaaatgtatttccatcgtccgtaaaaaaattaaataaaaacatgcgagattacattgaagatgttccaattttcttattgtcttagctacaaacgatccatacaaatattgttattgacatggttattcgtgaaaaacgtatgttatgattaaatatttttttcacccgttataacgcacgagtattttcactagtaaaaaataataattaaagaaaacaacactaagtatatatgtgtatctcaacccactgtaatttttcagcggaattcaattcaatgaatagcatatctaggtcgtagatttcattttagtataagaaaacagaagctggtacagtactttactgagaaaatatcgtgaatgtttctaatcaaagaaccttatctctatccaccctctctcgtttactctctctctctttccccatctctctcctgtcaccagccacacatcctctcctctcctctctagttctccacgcctcctctctccctctacccacgacccgccgtcccgcggcaatgatgcctagagagtagagagcaggagcagcggtgcgcaacgagctggggagcagcaccggcaagctactcctcggcgtccgcggctctccttccgcgcagcgacgcctctccgtccctcgcctcctctccctcgccatggggccgcgggagggctcgatgctgatgggtggtggcaggcggtggcgccctcccttctggcgggaggggaggcggcggtggtccggcgtcccagatccgtcctcttctgctccatctcctcctcttcctgcactcacccttcccggcaagggcacgacgactcgaggcggcggcgacggcgactcggtcttccggactcctcccgccgccggctacggcatcaaccggcgacgacctccatggtaacgagctgacggtgacagcgggctgcaggtgcgacaaatgcccttcttctcctctctttctcttctactttcctctggtggcttggccgatccattggtgttggaggtcagagatgggctgatctaggaggtgcgatggtgacgccaccccctcctgttcttcctcccacaccagaagcagaagcagtgacgaaggcgatgataatgaattactcgtgtgatttgttcatgtttattcatgcttttttttatcttgaggatttgtatgtgttgttcatatgttgaaataaggatatggggattattgtttgttgttcgtatattcatcttcaatttggggatgggcattgaagtactcaatgaagaaaattggatcgatttgagccggtcgtgggctttttttttgtgcgatttttttatttgtgcagtttttttattcttcttgtttcattttctttttctctatattctatgtccgattggattttgtatcgatatttgaatttgtgcaacatccgccttatgtggtactggcgctgtggtgcgacacgagtgggaacggggagggagtcggactggaaaataacacggaaaaatcgcaaaaaaaagatcacggggagggaatcggacaacgtacgaaaaattcttggcaaaaatatcttaaacttttataataggtaaagatatatactagaaaaaatacccgtgcgtagctacggaaaactaaaattatgatactttcatcatccaagcgctttaagagaatattcttcatgttgtgcgtgaacacaattttttgtcaatgtctagatagaaggtaccaccactgaaatatcacggtcgtctgaattaccccctaaaccacaaaaccggatattcttcaaccctaactatgcaaaccggacgaattacccccctcgacccaatccgcggtagttttggtctatgtggcgtacgcgtggcactctagttagtattctatttataaaaaaatgtaggacccacctatcatatcgtcttccactattcctctctattatctctctcactacctgtctcactcttcccctctctctctcacgcgcacggcagcatgc

SEQ ID NO: 1378 - DNA, 10755 bp, Oryza sativa
gcggattaggtcaaggaaggtaattcgtccggtttacatagttggggttaaataatgtctggttttgtggttcatgggggtaattcggacgaccgcaataattcgggagtaattcgtactttttcctttttttttcaaaacagcctatttcacattaaccaaacacacggacttcgtgtcacactacacgaacgtaatctcgatcggatatagagaaaaagttacaacttcaatgtacaagtccggcccagcaaagattatcaatgaaattcactctacaaactaaactcaacggcaaacaaaatctaaccattgaataacttcaccatcgaggcaactctttgcattgcaggtctagaagcgattcgaattgataacgcaggcacacgcggcttcttccaaatcatgagatacagagtatctttctagccgtagaacggcagcacgagctagcttgatgccgcgtgggcagtccggcccaagctcggcatagagaagcttggctctgagattcgtgcgggacatgtgtcgcttagatgaatcaagtctttcggatgagagtaaaagactacagttatacgtatacatttttcttcctgacgcggagccgagagaagacgcggtcacgcgcgtctcgattcttcgcctgaccttatctctttccttcttttttttccctctcggacttctttcctccgcctgcccaccttatctccttttctcctccgctgcgcttccttctcctccagccagcggcgccctcagtccctcattgccgctgcccctccctcactccgaaccagcggcgcggcgccgctccccctcctccccggcagcgataccgcttccccaacccctcagccagctcgccctccctctccgccgatgccactccctctcccccaactggcggcgccgcttcccctcctccccccaccggcgacgccgcttctcttggcagccggcatctcagctgtggtgccctcacactgccccccctcccggcctgtggtgtccttttccctgcggacggcgtcttctcctcggccggtgatagcaccctcctcgcgatgcacggtggcgcggccgccaagctaccacggcctcaaggcagcggcgtccttggctcccatgagcagtggcgtcgatgatttagtttcttttatttaatttttttttgatgattttggatttgtgatttcgtgattaagtatatttatgattcattttctattgtttaatgtattatgttggctcagatggatcggattgggtgattaggtttctttggatcaaattctagattaaatttggtatttcgtgctgtttttggttggttgattgatttgggtatctagcacgggaatttttctagacggactcggactcaaacgacagaaacggaacccttatgaattttttgatacggtgatctgggaggaatcgggcacactaaggggagggaatcggacaagcgacgacgtacaaaattgcttggaaaaaacatcttaaacttttataataggtatatatatatatatgtatatatatatatgtatatatatatatatatacatgtatatgtatatatatatatatatatatatatgtgtatacgtgtatatacatgtgtgtatatatatatatatatatatatatatatatatatatatatatatatatatatatatatatatatatatatatatatatatatattttcgggaggcatctcgatttagacttaacgagcaacgcgggcaattacgtgagaagtactggtagcgttacagacatgcatgcaagtagtttttgctattaggttgtgcatatttttttttcttcttatgaaattttctcttaaattacttatccaatctataatccgattacatcgttgtgttcgttacaattaaatatttacaataaaatctcacatgattatattttgatgaaaaatcacaaattacttttatgatatgtctaaattacttttagattttactaagttactccttagacatacaaaagtaatttagacttttgtatgtctaagaagtaacttagtgaaatctaaaagtaatttgtgatttttcatcaaaatataattatgtgagatcttgttgtaaagatttaattgttatgaacataacggtgtaatcggatcgtagattggatgaatagtttaagagaaaattgcatttaaagtatgggactgcctatacatcatataacagattttctagcctcctatcatacagatttttgaagccatagaataaacatctaacagctaaatttaatctcatctatttaaatttagggagtacctatgatatgatgtcataatatttaacaaaaaaaaaagtcagcatgtatttacattgtaagttccaaaaattacatatgtaattttagtgtatttatgatgtaagtaataaaattacatatgtaattttagtatatttacgatgtaagtcacaaaattacatatgtaattttagtgtaattacgatgtaattagtaagtgtgggatcataaacaaagtagcaataaaaaacactgctcaaatgcgaggaaaaaaaacaggcgtgtgtttcgaaattgaaccgtaaatatgtgagacccacagaacacaacaacaaagtctagcaaaagcccaatccatctcaaagtccacaaccgtgcctgactttgctcaatccattgaatccaaatgcagcacgaattttaaacaaagatgaatggtaaaaaagtgacagatttagcaccctattttctgtcaacagaccattagcaattccgttaaagtataggtggatagtttctcttatagatagagtggtatataaaccagctaccactagctgtgttgtcacgttatatatatatatatatatatatatatatatctcatcactccacaaatgaaacggactggatctagtgttcgatcggatccccgcgcgcgcatcgatctcctctggccgcctcacccagtcatcctcagaggggtgcggaatgtactttctccttctaaaagcagcgcgtgaactcgttgggcttggcctggaactatacgaagctaccggacgatgggctaggtatataggtactattgggcctgtgggctgtttgtgtcgggaaaaagtacaccgagggtccctcaacttgtcatcgggataaaaaaacatcatcaaaccacaaaaccaaatatacggggtcccttaactatacaaaaccggtcacccgagatcctttggtagttttaaccctggttttaatctatgtaacggctaagtcagcatgggaccaacgtgggcccacatgtcagggttatccacgttagccttctctcctctctttcccctcttctctcccttcgtcatctctctcactcctcctcgccattagccggttcgtcgccggctgcaccaccgtcgactcgacggggacggtcgaggtgcccgccgccgacatggtcgccgacgtgctctcgccgcccggagggccgctgcagaggcctcgagaaaaaggtgaagttcgtgacgccggcgtcggcgcttgtgcgagcctgctaggcggcggacgcggacgggacgacagtgccgtgggagaaggagcaggggtctctggtctccgcggcgggcggcgggaggtggtcggagaagccggagctgagcaaggcggcgcagttgttgggaggcagcggcgcagtactcgggaggcagcggcgccgtgtcagcgttggcgtcgtccacggcagggtaatgcaaccacggcacggcgtcgtcgtggccggcgccccgccgcatgagattcttgatgaagaggtcgtgtgccgacggcatgggtggcgatccgagttttttggcgtcgctatgcatataattctatgcatgtctcaaactgattgtatgtttttatttaatttatttttattccttgagtttaaaaacgatgagcaaataattaatgagcttgagtgagtgcttgctctcttgttaagaaattcgatcaaacctgagcaaaagataaaattatatgcctgcaatgctcgatctcattctatatgtttgttttgtttcattttgtaatttttatacaagtcatacatagacttttctcttagcatgttagtttgaataattatatacatcttaattagctgtggcaaagatatagtgaaagattatattgacattgcttgctgcacatgcaggccttggtactggagcagtagaggagcatgtaccagagccgacggatggtttgttggatcattgatcagtagaggaatgcatatcctgtgttacaaacatacaaatgtagacttgttggatccagcctttcttatttgcttatgattttacctcaatatcctacaatgctgggtttttttggctagccactgaagacctcaaggctaataacatgtaagttggtactcctgttatagggcttgttcactttgatgctatttttaaccttatcaaattttggtaaagttatcaaaaaaaaagtggttacatttagtttgttaccaaattttggtaaccatataagaaatcctgccaaaattttggcaagttaccaaaattttgacaactttactaaaattttggcaatgccaaaatttggtcagtttttttttttttatcaaagtgaacagaccaatagttacttaaccagtaggaaagataagaaccttcttagtctcgatccatttagctacttgtacataccattatatattccctcttctaatagaagtgaaaatttgatggcagtcagaaccttgctaaatgtcagagaaggcctcttagaaggttcgagtcaccactgacgaaaccgatgatatgaaggctcatatgccatgtaagtcagcacgctgtcatagtttgagcaaaatattgggtatcagaaattgtattttgtttattcttgggggactcctttctttttcttataaattattgagacatacccctatatatcttgtatctgttattcagtctttggggaatatgagaacttctttcatggctgtagtgttgtttctagttaagctttactctattctttggttctacttttgcttatgagctacatttgagcttctgcctatatatttgaaaggctacttgataactttacatgcattgtatatatattacatcaactacccaagtcaagttcaaataaaaaaaaaaactacccaagtcaagttccactacatactagtgaactcattttctgcttatatcaatccctttgttagaaacatgcatgtacactgtatatggacttagtttttactcgtagaatatgccatcttagtataattatttacgtaaattcccttggttgttctgtgcaaaggaggtgcttaggtggttgtctgcccttagtgagtagtcatagtataatttgaaacagtacgtcttcaggcaacagattttttttttatccatgttacttatgagaatgtcagctaagtacattacgggcagttttggattgctaccaaaatttgccctaccaatattttggtagcctaaataatatccaccatttgtttggattgatgccaacattttttaatacccatcccaaatttggtagcaatctagaacttttttttattatggtatcacaatttagctatattttggtagcaaaccaaataagatgaatacaaatttattctaccaaataattggcagtgccaaaacttgcctatgttttggcactaccaaagaattggtagggcattgatccaaacaagccctacaattctaatataagttgtcatttgctagtgagagcacaactggagtacttcacgtctttttatttatttaatatactccctccatttcaaattatagggcgtcactttttaaggaaaatcaaactcggtagcttttgactaataatcatactacctatatttatactaagtattatgcatgttatatcactagatttatattttaaaatacattcatctgatgctaatttcatatttattgggatcatagaatgaaataaaatactgatcaaagtatgttattgaaaaccgtgtaaaaaaatataggccttataatttgggacagaggaagtatatgatttgtaacttgtgggcagtcacctccttgttgtagtgccaaagaagggtacctcaatgatttagatcaccactgataacttcatgcaccatgtaaatcaatatgctccctagtttgtgagataaagataaattgcatctcttctttataattgaatctatagtacgtctatacgtttcactggtatagatctttccatctgtgacggcccataacaaaattggaatttgccggccgtcacaaggaagtaatctcaatcgggcgaacttcggcccaattgagatatggtcacacagccatggtatatcggcataaaactaaaagcccgtcacggatgccacttatctgtgacgggctatagttgaggcctgattgagataagggttccatatctcaatcgggccctaaaagaagcccgtcacagatgagggtcatctgtgacgggctccaactagaggcccgattgagataagtttagtgcccgtcacagatgacactcttttttgacggccttttattaaggcccgatagagattacttgtatgcccgtcacggttgattgttttagggccgttacagatatttgttgcacagtataaataccccccaccacctagtgtaactgtatcccattgttcactattttggtggaaggctgtagggggcgattttttgtccttttttcaaggaaaacagaaattaaattcctgtaggtgatcaaaatggatcaatcaagtgagtaatattaatcattaattgagcaatttcatcacgtcttacttttgcaataatgatcttataatatgtgcctctaatttgtttttttattttgtagcaattgatcgaagttggatgtatgcgaaaaatttgaaacgccgttctacggagtacagaaagggcgtaataaattttatgaacgctgcggaggaggatcggataagaagaaacagtgattacatgtgttgtccatgtgcagattgcaagaatgggaatatgtttgatagcggagaggacgtacacagtcatctgatataacgaggattcatggagggctttacatgttgggtgaagcatggagagcaagaatcaggaagtggagcagcagcagacagaagtggtgcgcataattaggaagatgaagatgagcatgacatgtttatacattctccattgggcggtgaaatggttgatgtggatcacgatctgctgcaagacatgttacgtgacattcaggacctagcctagaatgagagagatggaatgaagttcagcaggttggtaagtgattacaagacgcctttgtacgctggatgcaaagcaaaacacactaagttgtcagttaccttggacctaatgaagctgaaggcaagtagtggatggacagacaagagtttcacagatcttttaggaattttgaaggctatgcttcctgttgagaacacattgcccgagacgacatacgaagcaaagcaggttctgtgtccactggggttagaggtccgtagaattcacgcttgtcccaacgactgcatattgtaccacaagcaatatgcggacttggatgcttgtcctgtctgcaaggcttctcgatacaagcgaaagaaaagtgctgacgaaggaaataagtcaaagaggggtggtccggcaaatgttgtgtggtatctacctatcattgatcgtttcaagagaatctttgccaacccgaacgaagcaaagttagtacgttggcacgccacggagagaaggaatgacggtatgcttagacacccagcggattcgattgaatggaggaatatcgatcgaaaacacaaagactttgctgccgaccctagaaacatgaggatatgtctgtgtacggatggcatgaatcctttcgatgacatgagtagtactcacagcacttggccagttcttattgcgaactataacctcccactatggttatgctttaaacggaaatatattttgttgtgcttgttaatccaaggtccaaggcaacccggcaatgatatcgatgtatttctagagcctgttattgacgatctggagattcgttggaaagaaagtgtggaaacatgggatgcatatggtcgggagaacttcaagctaagagttctattgttctgcaccattaatgactaccctgcactcggtaatctttccggacaaactataaaaggaaagaaggcatgctccgattgcaaggaacatacacgaagccggtggctgaagaaatcacaaaagatggtatacatgggtcaccagaggtggctcccgctacgttacgcatttagaagaaagaagaaaatttttaacggtaagagagaacttcagcctgctaccaaagatttgtccagagatgaggtccacaatatggtcaaggacataagcaatgagtttgggaagaaaagaaaacgtagcaagacaaaggagaagggtatgtggaagaaaaaatccatattttggcggctaccttactggaaagatcttgatgtccgtcattgcattgatctcatgcatgtagaaaagaatgtgtgtgagagtttggttggcctgatgttgaatattcccgggaagacaaaggacgggtttgaacgcgagccatgatctacaggacatgaatattcgcagtgaactccagcccatacaagatgcagagacaggtaaagtgtacatccctccagcctgccacacactgtcgaaggatgagaagatcgcaatgttatcatgcttgaaggatattaaagttccatcgggctattcagcgaggataagtaagtatgttaaattggacgatctaaaacttgttggaatgaagtctcacgactgccacgtgctaatcacacaaatcttgccagttgctatcagaggcattctaccaccgaaagtgcgtcacacgatccaacgtctgtgtgccttcttcaatgcaattggacagaaggttatagatccataagatctagttgggctgcagaccaatattgtgaataccctctgtcatctggagatgttttttccactgtctttctttgatataatggttcatctccctgttcatctggtgaagcaaacaaaactatgtggcccggcttttctaagggaaatgtggccgtttgaaaggtacatgggagttctgaagtcgtacgttcgtaacagagctaaacctgaggggagcatcattgaaggttacacgaccgaggaggctattgagttctgtgtcaattacatgtccgatgccgatcctatcggagttcccgcgtctcgtcacgagggaaggttgtcaggtgttggcacaatcggaaggaaaagaattaggcccgatcaagcgtcgtacacgtatgcttattacgctgtgctccaacatatggcagaagttggcccatactttgaggagcacttagcgaaaatccgagatgagaacttggggcgatctgatgcatggattaacagagaacataattctcggttcaacgaatggttcaagaatcgtgtgacaatgtccacggatgtcccaaatgagacagtacagttgttggggatgggaccgtcttggaccgtagacacatggcaaggatacaatataaatggatacacattttagaccgtcaaacaagatgacaaaagcacagtgcaaaacaggagtgtccgtatagatgcattccaggatcaagttgggtcaaacacatactacggccgcattgaggagatatgggagctaaactacgtcaagttcaaggttcctttgttccgctgccgttgggttaatctacgcactggtgtcaaagccgacaagaaaggtttcactttagtagatctatctaaggtgggatacgccgatgaaccatttgtacttgcgaaacaggtcgagcagatattctacataaaagacccttcaaacaagaagatgcacatagtgagggatggaaagcgccgaattgtaggagttgacaacgtcgttgatgaagaagaatacaaccataatcttcatgtaagacctcacattgaccttgacgatgatccccaagagcctgtggcatatgctcgttcagatgatacggaaggcataaccttgtgactgatgcatttgtacttatctattgtaatgaatgaagtattttgttttattgcaaagacttgatatgtgtagtcattaatatggctaattttgttttattacaaatgaccaaaataaaagttgtagatcctgatgagaggatcaactctgttgttgaccatatttccatttgaaatcatttagtatttacaaatgctgtttagatttgtcatattgtcaaaatcaatttcaagctgttgggaaaaaaattatatagaaaaatgaccaaaataaaaccagtagatcttgaaaggctctacaactttgttgttgaccatatttccatttgaaatcatttactatccgaaaatgtattatgactaataaaatgaattattacacagcagctatatattttgcactcacaacaaatgaaagatggaaaatgagtcatcgttgacgggccaacgtttacggccgatagagattaatctatctcaatcgggctttgccgtagggctcgtcacagatgactcatcggtgacgggctccatactaatgcccaattga

SEQ ID NO: 1379 - DNA, 7046 bp, Oryza sativa
  unsure (1)..(7046): unsure at all n locations
aaagtggatcctctcatcaggatctacaacttttggtcaaaaacaaagttattttggtcacttcttcatccgacaaagttgtttagatttgtaaataaaagttgtagatcctcatgagaagatcaactttgtttttgaccatatttccatttgaaatcatttagtatttacaaatgctgtttagatttgtcatattgtcaaaatcaatttcaagctgttggaaacaaagttatatagacaaatgaccaaaataaaagttgtagatcttgataacctctacaattttgttgttgaccatatttccatttgaaatcatttactatccgaaaatgtattatgactaataaaataaattaatatacagcagctatatattttgtactcacaaatataaagacttatctggaaaaatggaaaaatagtcatcggtgacgggccttagttcaagcccgatagagattaatctatctctatcgggcattatctttgggccggtcacagatgactcatccgtgacgggcctgaatgtcatctcaatcgggcattagtatgtagcccgtcaccgatgagtcatctgtgacgggccctacggcaaagcccgattgagatgactcatcactctactatatctagggtttctcagatcggatcgaaaatttttctaagtcccactacagtttcccgcctccttagaaccctaactcttacttcgccgccgtcgtcctccctcgccgccaccgccaccgagaccgccaccgccgccaccgagcccgccgccgccaccaccgagcccgcctcctccaccgagcccggcgccgcctccaccgaccggcgacgccctccaccgagccaggcgccgccaccaccgagcccgccgccaccgccgtcgtcctcccacgagcctctacactgaccggacaggtgttggccttccttgtcgtcgccgcccgcgtcctcaccgacgcacgtcgccgacccccaccgagcccgatgccgcccgcccggcgccgacctacccgaccggcatctccaccgaccggcgccgccctccaccgagcccggtgccgccgccgcaaactcctcctttgccgagcccgccgccgccgccatcgagaccgctgcctccaccgagcccaacgccgcctccaccgaccggcgacgccctccaccgagcccggcgccgccgccaccgagccccaccgaccgtccttaggtgagccctccatcgcgccgccctatgctaactgtgaatgacatgtcattcaaatgtggatgtggatgatatgtgattgaactgtgagtgagatatgtcgatgttgggatgaaatgtggtgcatttatgaattttgtgatagatgattgtagtgattgatgaaatgtggttcatttaactttatttatacgcaatgcggttcatattgggatgaaatgtggtttatttatgttgggatgaaatgtggttttttatgttgggatgaaatgtggtttatttatgttgggatgaaatatggtgcattaatgaaactattgtgaaatgtggttaattttattactgtgagatgtgcaatttcgtttatttatacatggtgcattaatgaatttagtaaatagatgaaatgtggttcgttttattactgtgagatgcgcaatttagtttatttatatgtttcatttatttttctaagtgacattaaattcattgtaatagattgtagcactcaattgtgtatttttgttatttaaaaaaaaagaagacgatgtctcagcaaggcaaaccaatatcgacgacaactagtgggtcctcaagggcacgtactcctaggacagggaacaaaatccctaaggaacggttccgcataatagcggtggacgccgtagggttgccgacatctccaaggaaaatattgagccgatttaggtctatctgcggggtcatagggaggcagaaattcagtattctgcaagatgacatcaagctcgtgccggccgcagagaaggacattgcttggctaacgttcaaggagagctttgattatcctgcggagcatgaggactatctcaggcgggctgctttcaaggttatgggcaatgcttggaagaacttcaagactaagctagtcggcgagttcgtctacaacccggcgaatccagatccaagagagaaatttccttggatcacggaataggtctgggaggaattccatgcgaagaagttgacccccgagtctagagctagaagcgaggcatatcgcttgctccagaccaggaaccagcatccgcaccggcttggcaccgccggatatgctggtaaggaagaggaatggcagcgtgaggatgaagaagcggaggaatcgtgcacaccactcgtgtttggcgatatcccacaccctcgggctaggaactgggccagggccaggtaccagaagaatgatgatggcacaatcttcatgccaaatgcagaagatcaacgagtatacgaagctacagtaagtgtctagtcaaactagatgttcgcattgtttcccatcgtgcagtttatttaaccccactaaattgtaatgcagaaggagttggttgtcgagcaacaagtctcgcaagaggcctgctctcaaagacgcgaggacgacctcctcacgaaagcgttgggcaacaaggaacactatggacggacacggggcgttgggtcttctgttccctggaagtatggatttccagactacgcgtggcagtacaagaagcggacttccaacaaggcggagaaagatgcacgccttgaagccaagatccgggcgtcaataagagctgagttgacatctgaattcgacgaaaagctcaagtcgatgagggccaagattaggcaagagatccgagaagagcaacagaacccctaggccgccgctgctgctgcgcacgaagagttaggaagtcccacctaaaaacgcagcagttgtgcatcaactgagttggcggaaaatccaacatcggtcgacagcgccgtcgaccacataacggtaactgtgaacttactcaatacatgaaagacttaacgaatccatatgatatataatattctaaaaaaattgattaatctatcgcaggaaccaacgagctgcaccctcacagttagggtgatgccgaccttcacggttccagcagccgagggacttgcgtacaagccgaccccagagacaagagtgcatggagcgcaactcagggccgactgtgcaaaagttcaagtcgattcggtgaagcccgaatacgagctgttccctctgaagtatccaccgaacgacgaggtcctctcactaggaaatgcccgtggtaccttcatccaatggcccaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacacggattttggggaggaccgaacggaggccgacagcaaggcgattcatgaacccccaccgatgaagaagagcaggaaggcacactcttccccttagagaattactctcgataaacccgaagcaaaggggagaggaaggggaggaaaggtgcaggcctcgcttctagctccaaggaagctagatctgggcaagggctaggaaaagactaagggcaaagaggtcaagaagaaatacatcgctccacaggagttccaactaggcatgccattggttggagatgacgtgcttgccgcaatgggcaccgcttgcaaggaccttcacttatactacatggagaaatctaacgccaggaagccaagtaaagttaccgatatccttggagagcacgatggaaagccattccttggtccaacaaattatatcgtggtcgacttcaaggatcttttcgacctctacaggctccgagcggtggacacaagcctccttaagtgctactccttgtaagtattgtcgcccaactcaatctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgcgcctataatcaatagtaagtgtgttaactaaatatacacaacagcatgacacattccttgagtacttaattaagtttcactatattaatgccgtagtgcccattggatccttctggtcataacacctaagtggagtacatgtcactacctgaactccagaattgataagaacgcatatgattggaccccaattaaactagcgatagatgaagcgtgggcccaatacgtgcaaagaggaggcctcaggaagacaggacatgacaccctcatccacaaaaaagacttcccggtgaagcaacaaataggtgaccagtgcggattctatgtgtgccacaacatgcgcctcctgtatagagaaaaggtgaagactttggctgagtttgaggtcggtggtctcaattgtgatagactaactacattttagtacttatatatgatcgatcaactaatctggaattatgacaatgtagggcacaataaccaagtctctgcctaccagctttgaggacgttcgcgaggagatagctagcttcatcctctgcgaaataattaaccccaaaggaatgtttaggcttaaactaaaatgatgaacaatgttgaacttttatgtttaggcaatgatgaacacttgttatgcaactgtgatgatgtaactgtgatgtttatatttatgtatatatttcatatgtttatgttacgacttgctaaataaatatttgatccaattaactcggttttgcaggtgaaacatgataaatatttgaatggatgtgaaatatgtgaatggatgtgaaatatgagatggctgtgaatgtgtggttgtgtgaaatatgttgatgtctatgtatgtgaatgcatatgtatatgaatgggtgatgctggggagctggggatattagatatctgtgtttgtttctgtcatttttgcagcgggcatggctagcaaaagcctaaggctagccaaaaaacaaaatttattttttttttgtattatagtcatctgtgacgggtcataactaaatgcctgattgagatgagatcatttgtgacgggctctagtttagccccgattgaggtcagtagtcatctttgacgggctatagtttaggcccgattgagatgagtatcatctgtgacggggtctagtttaggcccgataaaggttagtagtcatctgtgacgggcgctagttgtggcccgatagagataggtcatctgtgacgggctgtagtttgactggtcgtctgggacaaagctatctgtgacgggctttactcagggcccgattgagatatattcattcgtgacggccgtttgcccgattgagataactcttcacatcagtgacttctagcctgtgacggacgctgtgcccgattgagatggggcttaccgctcgattgagatgagggtatccgttctagtggttgtaattatgttgcttcaatgtcaatttctcatcgaatggaacttggtagtttaatattgaaggactatatctcaactatgctacagattgaattaaatggggtaactgcacacggacactttacctgcacatttgacattgactcttaattctgaagtagttggtgttgcatagtttacttatcattttataaagtagtatagtccatatttccggctctacaatattattgtcttattgataatttgactcaattttttttttgctgatgctgaatatatcatggcgatcacaagatattttggtgtcatttctgtacaaaggaaatgctccttgcataagtagatttgccatctttttgtgtcatcaggtagaatgtacggttcctcttttgtaagtggattgtatagctatcctatatatgtactatacatggcatttccaattagatggagatggtatattgtcgaaacaagaattcggcaataataaaaggggtagcgcacaagacctgaaagtggatggatgcggagacaaggatttagacaggttcaggccctctcgataagaggtaataccctactcctgtttggagatttgaatccgccgggtgtattatagatctgatgatctagttgtgtatcatgccctctagagggcttcctgcccaccttatataagatgggggtcaggattacaagatagaaaccttaaccaatatggtatcggttttctaaatctactttacaatattatcaaaccaggactttaggccgttccataatacataaggaaacgtaatacctaagtcatgatccgttatatttcatagatataagttatcccctataactagtcggataaccacgccgtgtgggtatggggtacctataatctccacggtagcccctgagaccttcaccgtcgaaaagataatcttctctcgaactagattactccaaagccgagtgcttcaatcatcttcgccatggtttcctgagtacttttaccaaatccgaagactatggagggctgaaaaatagctgaatgtaaacttaggtgcatcgactagatgcacctaataggtttagcccccgactatacggttagttgagcaaactgaacatatagtcaaggagtaaataatccaaccaactgagtggtttttgataattatagtcaactaggtgatttgatagcatatgcaggtgtgaatcctcgaataacatgatccaagtgatataccgactgctttgtaaaatatgacgtgtaacctaaagttgacttcatcattgaaaatccacatagcaacccagctataaagnnnnnnnnnnnnnnnnnnnnnnnnnnnnnnnnnnnnnnnnnnnnnnnnnnnnnnnnnnnnnnnnnnnnnnnnn

SEQ ID NO: 1380 - DNA, 156 bp, Oryza sativa
cacttgtcatatcttcttcctctattcctctctctctcttctttctctctcacacgcacgtcagcaggcggggatagcggcggcggcgcgcacgcacgccgaccagggccggaggcggcggcatggccgagatgcgcatggcagcgaggacggcgg

SEQ ID NO: 1381 - DNA, 330 bp, Oryza sativa
cggctgtgttattggttgccctgaagttgaggtgaattgcatgcttgaattgatctcccgaaggtgatgtcaagatgaatcctgcccctgctcccttgctgttgagtgcgccgtcgaatgccatggtccacgtttcattgtcgatttggttgtctgacctgttatcgggcatggtccaatcggctacgaaatcggcgagtacctgggacttgatggctgttcgtggcacgaagtggatatcaaattggcttagctcgactacccatttggcaatgcggctgacaacatctttatttctcatgacttcaccgagagggaaggaggagacaa

SEQ ID NO: 1382 - DNA, 322 bp, Oryza sativa
tcgaatctccattctacaacgatgaaaggaaagtattattgcttacatatatgccaggagctaattattgaacgaaacaaatcgaactcaaagatactcacaaaatccatgcgctcagaagagagacgtcgagggcgtccaactggtacagatcgaagagatccttgaaatggatccagagaacatcttctccttgcaagaagtcggggtttctgatcctcgctccgaacatctctctacccttggcgctcatttccatgtaccgttcatggaatttgtacatctgtgtcggtagggactgcagctgttcaggtttgacaag

SEQ ID NO: 1383 - DNA, 772 bp, Oryza sativa
ctccacgaatataaagcgaataataagcacgaaggagaagaagttcacaaatctaaagtctcatgactgtcacgtgttgatgacacagctgctaccagttgtaataaggggtatcctcccagacaatgtccgggcaacaataacaaagctatgtgctttcatgaacgcaatttcgcagaaggtcatcgatcctgatagattaaaagccctgcagaatgatgtggtgcaatgtcttgtcagctttgagttgatatttccaccttcatttttcaatataatgacgcatctgctttgtcaccttgtcaaagagatcggtattctcggtcctttgtacctacacaacatgtttcctttcgagaggtacatgggcgttctgaagaagtatgttcgtaaccgtgctagtccagaggcaagcatcgctaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttctgcaacaatcttcattggtggctccttacatcgaggagcacttggctctagttcgcgcaagaaacatcggtaagtctgatgcatggattactaggcatcacattgatactttctccacgtggctgcgacaacatctcatgggtaacgagacgattaaccaacaactggccttc

SEQ ID NO: 1384 - DNA, 758 bp, Oryza sativa
gtatcagagcttccttgaccctaggttatgccaaatggttacccatagaagccctctaaaaatgttggaaaaatagaactgttctcctccctttctcttttaattaaaccaaactaatagcacatgcacttcataatctgttttaatggttctcgttcaaaaatttattccagtgttattagtactgtacatctattactgtactaatggctcattttaccagcaaaagttttacaatattgttttatttaatcttgctgcaataaaataaatttaacatgttgattttataactttcttttatttcttttggaacctgatgttcaaaagtacaaaattcatttccaactgtttcaacttatcttgcaagcttggtttactttatttaattaccttttactttgatcttctaaactttattcaaattaatcccaaaacttgtgctattaattggataaatgtcttaactccctcttttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgcgagtcaaagtcaccttgaacagtaatagtgaagatatcccctcagtgatgttcgaagctggaggaagaaactacatccatgcaagtcaggaggtggcaaggatcgccataggagagctccgcgatcgtt

SEQ ID NO: 1385 - DNA, 478 bp, Oryza sativa
cttgtctagatttgtagtaatatgaagtgtcccatccctctaaaatctcttatattttaagatggatggagtatattataggacggaagagtataaaaaaatataacaaacataaaagtatactaagacataaatttatatatgcggaatcggtagccaagtcttaattttgttcaactttagatgacgaaatatctatataattacctgccacgataaaaaaaatggtttctctgtttcctttttgttttttatttttgaaaattgaaaaagaactctacggaagcaaatagtgcgtgtggggccaggctgcaggcagcaagaagtggcgcatgatcgatcagcctgtccaggtgaagccttgtcgtacgtgcgtgtcggtggttggagtttctgcccattatcaggtggtaataatggcgaatttatattagttatatctaactattaactgatatatttcgccagtccctgaata

SEQ ID NO: 1386 - DNA, 604 bp, Oryza sativa
tgattgctgcccttatagcaccatcctgatcagtaattattgtctttggttgctttccattcattgctttcaaaaaagctctgaagagccactcaaaagtttcagttgtttcatcatgtataaaagcacaaccaaatagtattgtgttcccatgtccagatactctaacaaatggtgcaaaaggcagattatatctgtttgtcaaaaaagttgtgtcaaaacttatacaatcgccaaatttgtagtaccactccctagatcttccatcagtccaaaaaaaattcttcacttttctattctcatcaagatcaaactcatagaagaaattgggatcttcttcctgctttttcttcaaaaaattcaaacattgcatcaaatcattactgcttgtttctctgtttattgatgttctgacattgcttatatcctttttagtgtaaggcaaagaagttagaccacctcttagaacagataatattacaatcatatttcttgttggaatatggcattctttcaaagtcctgattagaatcttttcttctgtcgacatgtatttgtgagatcttagaaatctagctcatctggaggactgagctcatgattg

SEQ ID NO: 1387 - DNA, 1358 bp, Oryza sativa
  unsure (1)..(1358): unsure at all n locations
aattaaatatagatttgcaaagtctagtcattcatatcatacaaaacataaagtagaacatctcaatcataccatattactgcacaatattttcatctgaacagtcaggttaaaaagcacaaaaacggtataattatccttcactcaacagcacaaactgtactttactatacttatttcagtactcttcactatacaactgacaaataaaatattaaactgtttgaaaaaaacagtaacatgcagtttcaaacatatacaatataaacaatagctaattaaaatgaggagaaacaatatcaaaccaaaaaaaaagatttgaaaagaaaattggtaagcaaaaataaagacatataatcaaacctattattctgttttggcacaggaggataaatcactgagaatctgttgaaatcaatagagtgatcttgaacataaaggttccaggcaagactaaaatttgaaatctacaaaaaaaatattaatagaagttaaattttgtagatgaataaaaaagctgttatgaaatatttacaaattcataaatgtatataaaactaagtataccagtttaggtcttaattcagcatgatagaagctctcctcatcatacaatgaatccagaaaaacaaatctttcagatttcaaatcaatgacaaatacgaaccagtgacgactcttgacaattgggaaaaagagctgaatgaaaacaaaaaaatacatgaaaaagaatttaagttatataatgcaaaatttagagaaaaaaagtaagaaaataaaccaggtcacatgtgtgaacatgtcttgctagtgaagctccatcaaaacacttctttacagccgagatatttgtcatagaacggtccttaaggagatcatcctaacattaacaaaagaaaaaaaatgagactgatattatttgttaatgtcaattatttataaagatcaatatagaaaacaactacacaactacagtttctgtcatattaacttgcactacaatggtattatttcataagaaaaaaattaatactaaataaaataaattacagtcaatttctattgcaattacagaaaacaaaaactgtaattacagagataaaaaaatgtaactgatagcagtatatgtactaatgtaattaaatatggatttgcaaaagtctagtcattgagatcatacaaatcataaagtagaaaaactcaattgtaccatataacagcaaaaaaatattttcctcttgacagtcagggtaaaaatcataaaaacaatttaattatccttcactaaacagtacanaaactgtactatactatacttattttagtactctttacaatacatctgacanataaaatat

SEQ ID NO: 1388 - DNA, 26932 bp, Oryza sativa
atatttatcatcatctggcgaaaagaaaattaaaataatgaaccaaaaaaaatacaaaaattatctacactgtagtacaaaaagacattagaaaaatcaattgactatcaatcaccactaatgttgtaacaagagtgcagaaaaggggttcaaatggaagtttttcattgtgtgattagtaagtaaaagtctaaacatctaatatgataagcaataaaaattgtaattcttggttgatgaagcagaagaagaagatggagagaaacacatcatatataataaattacagtcaatttatatggaaattacataaagcaaaaaccgtaattacagtaatacatttcggtaactgggaattaactatagattaatgtataaaaatgaactgttaacaaaatttgaatattgatttgcaatgtctactaaatcagatcatacaactcaaccaatataactactaaaacaaacatagaaaataagaagttattttacttagaagggcatgtttccttgcttcaagttaagaaattctttctttttgatttccatgagaccagcagggatgtgagcagacctgaatccctcacggaaaatagtccaagtgattggctcgtcaggaggaatgagagttttgtatgtctcccaccaagcagctgctgcaccttgcaggtagtaagcagcaaaggtagccttctctacaggatcacaccggcaaaggttcagcttgatttcaatatcacgaagccaatcatctgctgcgagtggatcagccgcaaaggagaaatgaggtggatgtgttcgttgaacatctgctagcttggagggtgcttgattggcctgctgtgccatggcagcccccatgttttcagagttcgctaccatcctttcaaaaagtcggttttgattagccaggagttgagcaagagatggttcatcatcatgctgttctgcagtggcagcacggcgactacccccggcacgtccagaagaatgtaggccagtgcgaggctgactcgctccctcaccattggcatcatcagtaagagcagccatagagcgagtatgtgtcatcctgcactcaaagtacaaaagtacatgagctgcttgagcatagaattggcatatacattaccctaaataggtagcatacaggaatgatttcttatagccgaatttacaagtcatccatcatatatttgcatgaaacaaatttctggacagcaagcaatccattccaaaaggagcataagttcattccagtacattagttttaaaggatctaagtgatcacagatacataggagtggataatggtcataagaaaccaagttcatgccttggtgttacaaaattttgaccgttaaaaagattacatattagggtgtcatctcatacatcttaaagaaaagaaatgaaagttacaccccatacatattctttttccagtacaccattctatggaacttcggagaatccgatgggaggttgaggcactgtggttgacggagtggccatagtcaaacggtattgtctcccattccgctcgaactcatagaatggccccagcagcaccggatattatcaattaataatcaaatagacaaatattagattaaaaaaagaaactacactatttttagatacttactcttgaaaattactcttgctgatcttgcaaacaacattataaacttgtctatcatattgtgtcactggaaaagaatgtctctcagggctgtatggatctgtatagtatctagctggttgtaaaattcttctgagatcatgttttggtttttgacttgtgctgcactgtccaacagatttatcaacattgcacaacagaatcctctcaggactgcctgtagacatcttcaacttcttgtctagtttaactacaaatgtgttgatcttattgtacaaaacattagtcttcgaagttatgtcaaaacaattgtctggacattgtttttctccaagaaatatgacatcaggtgaatcctaaataaaaatagaagaaaaaatgagaaaaaaatgtatttattaattttaaacattgttcttgaaccaaaacataatccactacatttcatttcaaggtaaaaacagaattacatagcttcaaatggcagaaacaaaattttcaggaaagcacttttgacagcacaaatcaaacagaaaaaaaatttcaggaacacacttttgacaggcacaaatcaagcaaaaaaacaatcttcaagagcgcacatttgacaggcacaaatcaagcagaaacataatcttcaagaatgcacatttgacaaaaaaagataaattcataatatattagtaaaacaaaaaaaaataaaaataagaaaacatacctttttctgtagttgttcaatgttcaagttttcctcttcattatgttgagtcaagatttcagtatcggtatcctccaaagttatcattactaacttgtcctgtgaaatattaaaaaataaattttaaaaaagtattataaatgtaaagctttgtacaatttagaaagttacctcattagttgaatcgttcaattggctttgtgaatcatcatcgaaatcttgtgacaggtcctttggaatgatctggattaacataaaaaaaattttgagatgaaaaaaacagataaaaaaacatataaaaacatacaaacaggacaaaaaagaataaggaaccattacatttgaattgtcttgatgtttgggtgttacttgagtcctgaaatgtttttcttcatttggaaaatcatcatctgaatcccagattttaaagctaggcttctcatgacccaagaatattgattttctttcattgaaaccaacaatgcttgatattgctttctttggagaagtattactgagtcctgtttccaaatttagaagtaatataactgagattgataatttgggaaaaaaataatcatcaagaaatttaaatttaaaaacaaaatatataaaatagaaaattgaagagaaactaaaatttacctggcttggaaagctttttcataattccatcaacaacagctattttatcctaaaaaaacaaaaaataaggcatatttaatcaatatgctgacataaagaaaatctaagccagcaacgtattgaagtttatattatgttttgcttttcacaaaaatttaaataaagattataactaaattggaatgttcatatcaactaattaggggcaaagctagaagttcataggaaaaattaaattatatattcttaaagaattacaatctaaaatatgtactaaaagcatttttaaaagaatctacaaaatttcaaaaatcatattacttcaacgagactaaactagcaaacccatcaaaagtagatattgtacggttagaattcagaaatattgaaagcaaaatattatacagttagaattacctttggagaagatgatattttcataggagtttgctcatttccaattgcattatcattacaggtattctggtcttttaccattgaactatcatcattgaatttactcttgtcatcttcattcagattaacatctacataatttaaaagacaaatgtatatatttatgagttgtaagttagacaaaattgaaactaaaagttctgttgttgctggtactaaaagtaaaaatgcagcgattaagaagaaagaatatataatgataaataaatattgaacagtaaacaaaatcatattcaaaatttaaaaacttactagtgttttcaggaacaattggcttgctattagataaaagaacaaagacatctacaagaagattctttgctctttcatcaatgcagttctcatcaggaccaaaatgttgaataagcaattcattgatcttgtttttcatatcttgagttaaatcagcaccaactgaagaatcaagcatatctagaaagcttctctcaataggtttaacaggaacattttcttttacatcatcacttccaatctaaaaaaaagagagataacataaaatttaaaacatgaaacaattatattttttaaaaaataagaaatagatttataagtttaccattttgtaacagcactcagaaaaatctttaactggtcttttgccatagacacctttgctgattttatcaaactttgaaatttttttgatcattgaccctttccatacttttattcttggaacatgtttcagtactaatcgcataccaaaattcagaaaatccaaataattcacctattacaataaaaattaaaatgaataagtaactggcagaaaaaatagttttaacaaataattgaaaaaagagagagaaataatactaaccaccagacaatagaagcaacctccaaaagtttttgacttgtcaagcttgctcagatgtttcattaaccaatcaaagacaagactgctccaatccaaattgtcaatacaactaagatcttcaaaaacactcagatatttcgtgctaggttgaagagaagaatttgggcacaggaagcaattcaaggatacaatcatgaaacacattaagatttgttcatcagacattgtttcatttttgataagcttctctccaaaatatttgacagagggcaaagaagagaggccgaaagagtcaagaaggatctgtttgccaacttcaaaatctgaactaatcggtaaacctccaacatgcaaacccaaaacaatatgaactgattctttggaaagtggaatgactttatctctaacgatgatatcacaagaggtgacatcaactctttgtgccacccataaagcaaatttatatggcacgggacatttttcaaagagtaagagagttttgaaacaggttttggaaataatctctctctaatgttcagacaatgaagctagcacatgagaaaagtatttcacagaaaaccttgtcagtttagtatctaaagttgcagcactcttcattggatttttctgcaaaagaaaagatattttcattaaaaagtttttacataaattttgaaaataataaagacaactaataacatcaaactaatttaccttgcttttatgagaatagagtttccttttcattccatttagaacattatctctatatatctcaagcaaggctgaatccaacttatttttgaaatcaacatctactgtttcggtttattttctctatcaaaaataagagaatgcaaaattaattttttaaaaaaggagcaagacaataaaaggggtaataaagaagagagaaatacaaaaaaagtatgagaaatgcacaagatctaatatgattaagattctacattattggaattgttgtatagaaaatgacatgtttcaaagttcatcagcagatatcaaattcaaaaactaaaaataaaatgcttctacctttagacaagcagataatgtatcccaattaaaactctacaaaccacatttatgtggagtgccctttttacattattttctcaaaaatcaacagcaagacaagtactagaaaaactgaatgtgagcacatattgacaattaatgacataattgcagcaatgctctaagaatgtagaattgatattgcaaatttcaagtattgaaaagaataagaaaaaaagttaaaggtatagctaagggatataaaacagaaagcaaaagccaaattacagtcaattacagtgaatttatatggcaattacataaatcaaaaactgtaattacagaaaaaaaattatgtaatagagagaagtctaaaatttaatgtataaaaaagcaatgataggaaattataatagaacatataacttaaactaaacatagtgttgtaaacaaaaaatgcaataatattttgttaccttggaagtgccttcatcagtatttttcttcttactcaactttcttttcaaagagttcaaaagttcatccttagaaattccaacataactagattcggagtcctacaaagaaaattaatgaaatctaagaatattcttacaaacaatgttaaaaaattatttcataaaaacaaacctcattgtcacaaaattcatcatcatttggagaactttcatattcagaagaaatagaatcaccaaaaagatctttaatatcattaggattacccatctattaaaaaacaaaaaaattgaattaaaataagatagagaaatacacaaagcatgcatatcagaaatcatatatacagtcacaggttcacatcacagtttcacaactcaaggttaaaaaaatgtacagattttaacagtaacatgcagttgcaaatatatctaatttgcaaagtctagtcagaagcacaacataagagctaaatcaaagcctatattgcatataaactaaaaaagagggtgattcgtcaacattcgcacaaaaaatacagactacaacactacaagaccttcgcaatcttgagctcaaatcacaataatggcacctccaattcgaccacatccacttagtgaatcaccaaaaccacccccacgacaaacaccacaaaacgacagtcactagaggccaggataaatcactaatgaatcattgctgaataaatcattcaaataaataactactgaatcgcttgcaagagctcaagagggttattgagtggattagtgagttaacacaagaaacagtatccattaacagattcaagcaaaatgctgcatttgttaattcataaacaaaataacattaggaactagtagtttttggtcatgaatgcaaatgcaagtatctctggaaaatatgtatgaaaaacagataaacatgcgctgcagttcttaatgaacatcataacaaataggctaaaattctaaattaacggcagaacaaacagattctgcacaacatatgagaacacactaagaaaaaatctggatgacttgtgaatgacaggaaggaattggatactcaaacaaaaaaggggaataatgccattgacaaaatgacttgtaaatgacagtagactagatcttattttgtatgaacaattagatctacacctaacaacctaaaaatatcattaacatctaagccataagtgcaaaattagcttctgaatattggatcaaatgaaccatgtcactgatttggattaaaaagtacttctctaccttaaaacagaaataaaacaaacaacaacaattgtaactcaatgtctcataacacattcagtaactggatcaataaactacatgattcacaaaataacagatccactgaatccaaacactcaaaactcacctaagataccagcttcaaatctaagcctcagccaaaagtaacctacaatccaaaacaaaatagagattaaacctaaaaacaccacagaaaaaacaaaaacacaggggaaaaacctaaaacgttgtagagctgaccagatctgagactcgaaacaaaaataaaacgaaatcctcacgagacaatcacgagttcatcacgagttcatcacctactgcacatgctacgactacacaactcatggagttcatcacgtactgcacaagctacgcatgttccaaaccctaacccgtgttgtccgatcaaacaacaacagtgaaatcctaaaaaacaaaaataaaacgaacaaatcaaactaaatcctcacgaaacaatcacgagttcgtcacgagttcgtcacctactgcaaatgctacgactacacagctcatggagttcatcacgtactgcacaacaacagcaaaaacacgagaaggatggggaaggagacggtgaagagcaagagagaagaaaggaaaaactcacgaatcaaatagaggtcaacgagcagctctacatcagcagaaaaaggacgacgaactctccggcgaaaatcctcaacaccggctagatctacgccggcgaaatcgccgtggcggcgaaatcgtctcatcacaacggcgaccttgccgaagcctctctgtctctgtgtgtctctctctcccccagcgagtgagtgattaggggagaaatatcaggacaaaagtgggacccacaaaaatcacggagaaagaaatgcaggcgcggagatcaaaatttgaaaagtacaggtgggacccacaaagactgaaaatgttaggtgcgtctctggaaaaatcaagtgggacccacaacagcccaaaaaaaacaggcccaacaacccagtcaacccagaccacgaacgcaaaaaaaagcccatatgaagtaaagaagtccatctctcagcacgaatcttgaacagatcaatggcccaaaaaacgacagattcagcccaaagaaaactgtcgacagaggaatagcagttccgaataaaaaagggcgaaaatttacagcagccgacgacggggcctctcgaaaacaaagagaaaaatgtctcaaatttgggtggaatacggtcttgaaaaatatctcagattcactgtgctactacttactcctacaggaaattggattattattgtgatgaaaagaagcgagaaacctaattcgcgcgtacgcgttgccgccgcgcacgccggcccactaaggcccatgcacgtaagcgcttgtgcttctttctttatttctcttttttttacaccgccgtttcttcctttttctttattttttcgctgattgttattcctaccgtacagatagattagtctcctatttttactagcgattagtttactagtaatttttaaatcttaactttaaaatttttaaatttggatatgaaagttttcaaatctcgagttgaaagttttcaaatctcaagttgaaagttttcaagattttcaaatctagacttgaaagttttttaatcgagttgaaagttttcaaatcttgagttgaaaatttttaaatcttaagttgaaatttttcaaaattttcaaatctggacctgaaagttttcaaatctcgagttgaaagttttcaaatatcaagttgaaagttttcaaaactttcgaatctggacttgaaagttttcaaatccgagtgaaaagttttcaaaatttgactttaaaatttaaatcttaaaacaaaagttttcaaatctaacttaaaattttttaatctattagtaaaaaaatctccgaatttttttttgagaatcttccctaattactcgtcattaatgttaagtgtatgttaactaatactatagagtagttaggaaggtaatacagagtagttagggaggtgctcgctgctggcgcgcacgcgccagctagcagccgcagaagatgcagatttggatcgagcctgagaacatataccacatgggccgcaagattccgtggcccgtgggcctctgatgatagcctactactgtagtactgtatattgcccaatcaagacagtagtgtcggaatttttttcatttttaaatttttttcttttaatatttacagaaataatctatcggcgcaaaaaattacagaaataggccctgccgccctagtggagggcgacaagctgacgtggcagacggcggctcgacaacgccgtctgccgccgtctgcgaaaattgcatttagcctagggcggcaaggggctaaatgcatttttcgcagccctaaagagcatttggctcatacttttttgcatctgggtcccttgccgccctagatgcaaaaagtaccagccaaaaagtactaggcctaggctggcggcaagggttttcgtgcaaaaaaaaacctccctctcccgtctgtcgtcaccgcccgtcttttccccgtttgccacgtaagcttgccgccctagtggagcgcggcagggtctatttttataattttttgcgccgatggattatttctgtaaatattaaaagaaaaaaatttaaaaatgaaaaaaattcgtagtgtcgtcgtgcaaagcctgtaagatttgtcggtttggaagttgcaacaacttttgcagtgagctgccaaacaacctgtctcaaaacaacatatgcatccttcatccagttgcaccacctatctcccagttgcctatactactactgtactgtatattctactatgactctggtatctgctattctgttacacatcgctaatgctcagcacgtatctactctatcgatctgacaattataaaaaaaaaagataggcaggaaaaaaaccatcgtatcatataaacaaacaaaaaaaactcaatcatatcggtcgagaaaaggcaagaaccctaccttttcacaccgtcacacgagtactcatcccttaggcctaatcggtttagaagggattgagagaaaataattccacacctcaataggtgtggaacaaatcccatcatatccctgcctaataatatcggtctgtcaactatcattggataactggaccaaaaccggccaccgaacaacgtcgatgcgagacagatagcacagtactcctactatatacataaactcctctgaaactgatcaatggagcaataaggtcatcagacagtcatcacctcacctcacccacccacccccaccagctgatgaaagccacagcacaagcaaaatcacaaagctggtatacagcacagcagctcagacataccctgaatattcattgatcattattcactcatgtaccagaaacatttcttacacgacaagggaacatgagagagcatatgaacaccagggatcaataaatgaatgaatctagtgacaaacaaatcacatcacaggtggtaacagtagtagtattaattcatcatcaaccaccagcacaaatcaatacattatccaaatacaacactaagaaccagttaaaactgtgggggagaaaaaaaaatactcgagataatagcgagctgtaattcacaacaatggcattttagaatctcaaacggcaaacacaatcatcatcatattcttcctagtctacaacacctttacacatgtggttttttcttcttcttccctttatgttacaaaggccaccctccatcaccaggtgaggtgagggtgtgttcctcaactcctgaagccaaagttggaccacctcctcccagcatctttcttaacacgctgcgagttggtcacgaaaaggttttccagcgatttctgcttcctgttccgggaccgccctgcctccttcagaagctccgcaagccttagcttctcgtcctcgacatccgggtttgctgtgccgagcttctcttccctcaccttaagtacgtgttccagtatttcaatggcgtcctcaaccctgaaggcaaaagggaaatgcacttactcatgtatcaagttaaaatattggaaatctaaaagaacaaattctatctgttttctttttgcacagggaaaaacaagttgtggcaattcctaaatttatagatgcaacctcacaggtatataagcaatcaatacacccactcaaaaaaaaggggggaaaacagcacgcctgtaagtttggaaatcgactgagttgatgcaaatcaccgcaggttaatagcatttcaatgaatagtttatatcaggcaactttataaataattggacagttgtaatcatacactggcatgcagcaacatgtgggcaatttgatggtggtccactaaactaaatgatgccttcatttatttgttgattgattgcaatctctttgttaatgccatcgaaattatgcaaccttacataggatgataatctaattgatcaaccaatcttgcctatccatccaaataatactacacatgaactaaccgcctatccatccaaataatactacacatgaactaaccaacattcaacatttcacggattattagaggaggaaacccataagctgacaccttcagatagcaaaacaaattcaggggattacttctacagctgtgaatgataagggtagatgccaacataactcaataagcatattcaggtgcttgtcaatggcatttcttggattttccccataaccatcaagggattgctaccaagatatgatttgatcctaattctatatgaaacagctgttggttgaggaaaaaaaagtttctggtatgaacacatacctgcccatagcatcgtagattgcagccaaattactgtagacgccgagagtatctggatgagaggcaccacactcctgttctagaactgcccttgcctcttcaaacaactgtgcagcctcatcaatcttgaatagctgcacacaagctagccccatctggttcaacagaactccaaaaaatgccgacttcctctccccgctagctctcaatttggcaaccgcattttcaaatgagttccttgaatcggcatacctccctaccatgtagtacaacacacccatttgtgcctcgatgccagcaacagtgctccactgtcctggtgagtcctcaagcaactttagtgccctttgcaaaagcttcagtgcctcatcaaggtctccaagcgcctcatagatggcagcaatctccattaggcctccagcaacctcatcaggggcagcgccaggcgcgggctttgcatagacacggagtgcattctcacagtaggatttggactcgcggagcctccctgttcggtggtaaaggtctgcgaggcggacaaagacagatgcaaccgaagggtggtcatcaccacgggcagacttgagtactgtcaacgccttctggtaggagaagacagcctcgtcgaagcgggcgagggcaaggtaggtgttgcctatcgcgacatcgatcgtcgcgacctcaatgtcacgtccattggcgaccatggtcatggaggcaagcacaaggtgctccagggcaccatcatagtcacccttggcgtcaaggatgagtgccatcaggcggcggtcggaggcctcctcgagcgaagcgggagcgctgtgctcccggtggatctcgagggctttgcggcacaacttctctgcttcatcgaactgcagggcttgcacatgcgcttccgccaaatacctgctcatagtgcaaaataaatgttgtgttggtcaagtgctagctcttgcagattattgttacttctatctctactttttttttttttgcataataatgcgatggacttgatgaaatttatggcgagatcggcggaaatcacaaaatagcagagggaaattaaaaaagatgtcgcttttgaagaggtagattggagttgaaaagcaaaatggcgtttctaacttttaagagaggagatctagatcgagaaacgggcgagaaggaagggtttttgacctgcaggtctcggcgacgcggggatcacgctcgccgagcgcggccatctggatctcgaggcccttgccgtagcaggcgatggactcgtccatgcggccgagcatggcgtgggtgtcgccgagctgcatccagccggagaaggcggcgagggcccactcctcccccttctgctggtcctcgggcggctgctcctccgccgagctctcaccctcaggcggcggcggaggcggaggcggcgtgacgacggcgacggcgcgctcgaggacagggatggcgtcggcgtgcctgccgaggccgcagtggatggcggcggcgacgtggaggctcatggcgagctcgagctcggccccctcgccgcggcgctcgagcgcgcgggcggccctctcggcgaactcgagcgcgcgcgcggcgcccccgccctcccccgagaccatggcgtcgcgggcctgcttgagcaggaagggccccagatccgggttgtcgagcgccgcctcgtccgtctccggctgcgccgccaccttcctgggcttggcccgcgacgaggtggaaggcgacggcgacggcggcgcccggctcctgggcagcggcgacgacagccgcctcggcggcggggccgccaccggtggcgagttgtcggccgcggcgaggcccggcatggtcgggtgaggcgagcgcgaggtggggagtcagagagggacacagctgcttggccttggccttggccttgcttgcaatggaagagaagaagaagagcggcgcggcgcgggggtttgggtggcgtcataatgaggagagcggcacgagtaattaggcagcggttgatggccaagtttagtcattaatcaattaattaaggtcctcgaggtaggcaattaaggtggctggttcatctctctctctctgtcgcccaagtcttctcgtgtacctagttgattcgtgtactacggcctaaggctacaatgtactgtggctgtgtgcctgtgtgatgcgatggtgaatgggaatgggcttgattagggttgattgtgttgacctgtctcagaatgacaggtgggccatgcgtggttagcttgtgattaaggtgacaaattgttgggggtcttcatccatcttgatcgctgacaaatctgcctggtgttgcaggcatacagagcataactgagaaaaattattgttacagattactgctccctccgtttaatgtttggactttagagaaggcgtcatttattgagagtatatattttgacaaataaatttaaataagtggcctagataatacactaggaaaattatatttttttaagtgtggagcaaatatttcgtttaaatggttcagtaaataatctgaaaataaatgcttgacttagctactcacttgtctattgtaagtgtattttccgaaccactaaacgatgtatttataaatattttttacataaatatttctttataagtatcaaatattttgttcacgtttataataattagtatttaattgattacatgttaatgttaatgattttctcgtttcaagtatcgtcttgacaagcacagggcactactacccccagctcaaagctctgaaagttcgcttggtcggtatcgacactgatcctatgatatctgcttctacgttcgtatacattagcatgtagtttaattaattatatagtacgtacagtacagtgtatgagaaacattataattaagtagagtaggaggaaggattaaggaaggagtgcattacattacgcatgcatgcctacttgcaagttgcaaccaccatcggaagaagagatacaacgaaaatgatgaaatggatcatggaggatcatcagagctgtaatgcttccctggcatgcacaccctgtcatgaactaattagctcgatcatcacactgtatatgtttgtatgtcctaatcattgttttcggatccatccaaattatcctgacagatcttaaaacacagcccatcacaacgctggtttcgtacatggatatgttcttttcagacaccaattgctgacagtacattagtgtactccataggttcatcttgctgctgccattacttgagtgtagacaaagaaaggagaattattgctcgtgcatgcctcggttggtccgacattttcattgccattcgagcaccctatggattacagactgacagttaaattggttcgctaagtgtgatcagtgttcagtaacattttgctctgttcttatctccaagttcccaacccatctccctcgttttccgcgcgcacgcttttcaaactgctaaacggtgcgttttttgcaaaaaatttatatatgaaagttgcttaaaaaaaatcaaattaatccatttttgaaaaaaaaattagcaaatacttaattaatcatgcgctaatggagcactccgttttccgtgcggggagtttagttcccaactccccctatccgaacacagtactcctccgtgaaacctgtcggtgtaaaatccgaagagaagttgtctaacatgttggtgggccttgggcctcgtcgtgggctttagatttaggttgaggcccacttatcaacaacaaatagtacaaaggccacaacaaggggatgacgaactgccgctgctactcgccgtcgccgtcgccgtcgactcctcgtcgccggcgtccccaaaccaagcaaaatgccatctccgtctctcctcctccaccaccaccaccaccgcctctcccctcgcttcgccccctcccgctccccctccccccgaaccctatcgctgcatcctgctcctcgcctccgcctccgcctccggcttcgcgccagcgcccgcggcggcgggggcagcacacgggaccacgatgacggcgcgcggtccatcccgatagcgcggtgctacgaggcagccctcgcgcgcctcgacctctcgggaaccgcgcggcgggagcaggcggtcgcggcggcggcggcggccgatggaggcgcggctgccgaggctcacctcgccgctgtcgccgacgccatggtcatggaggccttcctccctggacccgacggcgcccggcgcagcgccatgtccacacggctggtgagcgtttcggggttccactcccacctgtccctgtatcttccctttgctgatttgctccacacaaccgattgatgatgagaccaatgtatttatttgttcccttacttgtttactgcttctgcctagtgtgatgctcgaagttgcgtcctaaattccacccggactcagcatcccatcagaattagtgtaacgcacctatatctatttactctaagctttgatgctttattttgcgctaaattcggagtattggttgctctggatttcgtcatttcatacatattacgtgaaatgtttgttggcatgtacacagcctattcaccacacggtagtacatatgatttttaagaacctgtacagggtgaaacaactaactgtacatgctaagttcaccatgtaaaattaatctcttggaactattggttggtactaggagtccaagtgcattagtgactcagtgtctcagcgcaagtggccggctgggaattttatgatacaatagaggtgcttgtacttgtagcttaacaacaaatcagtatctgtgcttttctatcatgttgtgtctaggaagagaacttattgccagttttgtatatatcgaacatggttagatgctttaatttcgatcggaatgtctgtccttgttggatcatgaggaagttctggcatttcattgtagattttgcaagcaaatgaagttacagagaaggccagtaagctaaagaaagaccttggcactgaatttttctctgaaaacgaacctgatgcagagagtgttttggcaatggcctttaagcaagttgtaatggatcagctcacaaactttcggcttgaagtgttctccccaggttcagagatagatctccaagatttgagcaaaccccgaaaggtgttcctctgtaaagtttgggacttgtatattattttgtttcgtttgtttgcttgttgctaatttgtggatgcacaccaggtgcctgcggattttagtatcagatcatcagatgaaaaacttctagctgctcttgcggaagccattttctcctgtgtcattgaggatgccagaaataattacctagggggcactggtggtttgtttcataagtggaagtcaaactgctcattggattcctctgtttgcatagacataatttctgagtcagaagtagtgaacagtgctaggaggcgcttagatagttttgatcttgtacagtcttctcatgtagcgggtaaagcaaagaatggatggtggccagctccaaagtctgaaaggttagtgaagattggtggccctgattttatgctttgggccagtgagtttgtgtacacatataaactacaaattgatgccaaagcattcaagaatacaaagcttgggggtcatcatgtgttagcaaataataagggggaagttctcttatcccacgcccaaatggtacattattattctctccttgtccttgatgtatacattacttgttgccattcttatttattgtatgctattctccatctcccaaacctgtaggtggagttagcaaatattctggacatgtattttgaagatcagttcacattacctggaaacaccttctattccaactggaattcagaaccatcaaagattaaaaagaacaatgtatgctgctattttttatttcagagcttacttgtgttaaatattttttttttatttatgttcatcaagcattttttttggtgcagggttatttgaacaacctttttgctttgttggctggtagctctattgtttttcttgtcggcgccattgctcagttatgctggcctcagtctcttaaagataaaagattggccactgttagttcatgtgtctcatcatcacagagctattgttctgatatccactctctagatagtagtgaggtatgctttctagttcttgaaatgttgttgcttgcccagggagaatcctgtttgtttttaagtgtggaaacactttggtattttatactattttctggatttttttttacttgataacccattcacaagacattgatcgtcattgtgttgtaatttagaaataactactcaactaattggaagtgtcccaaaccttttgatagtgcaatattgttctctacgtccaaatcaaagaaaaggaaacaagctacctcgatttttagttgctctgggatattttgattgtctgcattatcctatgcaacatagcatgtaagagccgctgctttaaaaataaaggatctctaagaaatggtctgaaactctgcatgattcatgtagaagtcatttcatcaacttgttatggcttcatgatgtgtgttcccattaggaacatcatgtagcatgtctcctttttgaactattacccttttgccagcaaacctagttgctgtttaaatttaattaagggcatatctggtgacaaatctatcataactactttgttgattatctaacatatctgttgtatgcaacctatttacccctgggcagttgcaggcttactgtgtatctgttgttgagaaaattaaagactcatttggttgtactggtgatctaatggttgatgcaaatattggtgcttgggttggagaactgcctgaattcttcaagggcatcaactgtgacagtcatgatgattatgtcgatattcagagtactggtgctattagccaaggagagcaaccctcattggtgtcaagtcctattaagatgtcttctcatctggaacaaaatgatgacactcaagaaactctgcagaatattgctagttttcaggtatgctcatttcctgcataaaaaatctctttgtatcagatgaagaacttggtatttttggtaaaatgatgtgcctaccaactcaaatgtgtatttgccattaacatagttcatgaagagggttaatcaccataaaagagattgatgacgatggtttggaagtagaactgaacctaaggggtaaagggttggcaggctgaggaacttggctagggaggatagactggaacatatggctgagatggacttggtgctaacttatatggtttcgcttttatagggacgacatctaacaatccattcaaacctttcctttaaatataataattctaccccatctgataagatcatatcctatctccaattaaacctaagttgctagctaagcaatgtgttgcagataaatattgtaactgccatctcacaccagccctgatgggcccgtgacctaccttatggccatatgcagttatgcacataacaatatcactgtgtgaggtttttagtctgtctattttatattgcaaatttccccaaaatattcatgctaacaggtttaccacacatctgtttatgatgcactgtcactacacattttcagtacttttaagttaccatgtcatttctttatttggttcctgtttttattgttcaatttcctttcatgcttggtagcaaaatgcacttgttttgccatctttattattctaaaacaattgattgatttaagttttgctgttctttacattaatttcctggttttcttattttcagcagcatatatccaagatctaaagtggatgttctataaactataataccctgtttggcatatattcatttgttctttggacataactcatcagtcatgactcaaaagaaagagactacactttctcttttctatttcgtttaatactatgaccacaatgaaattaatcgtttaccttgagtgttacaagatagcacaataagactgcaaaataataatgttttcgttcttttgaataagttgtttgcagcatctgttaacttttcctgcaagttgggttgcacgaatcacccaatgccattgtcttatacttttgaaactatatgatggtagaagattacacttgactttatgatggaaactattgttctattgttcatttccttgagttaaatagttcagacttacactatatcacccttttttgatacaaacttgcaggtggtcatgtcagaaagaggtaaagtagttggatttcagccaacaaaccgcctagctgtgaatcattgggcaacaaatccattaacgaagctcctgtacgaggggcgaaagatctctccaggtaccatgattgaagtatcaaaccatggaattttattgttaatacctgtgctaaagctgtattttgtctttgcttaatactatggtatggatattgtcagcctttctggagcctaggcttagaatttctcgcccagctaaggttgtcccagttgagttgctgatgtcggtgaatccagaatccttttttgctttggtgaggcctgttcaagatccatgctaatggaggtacttttcatttctcctccagttgttctccatctactaccctcaccctctcttctctctcatgtaattctataatcgccagtactttatttacccagagttctgtagttgctgtcctagttaaagctaatgtcatttgttgtcacccaatctatgcttatcttacccttaaaacaggattttacatgctttgtcattacatggtgctgtacagattcatgaactttttaaacatagtagactgggcagttttcttgttggttagtggatgcattttatagtaaaggatatggaattataaactctctaaatagtagctttactctttgtcttgcatgcgcttgcgaatcaaatagaagaactgcaagtaggtgttgcaagctatggaccatgaatcattgcagcacaggctctcacgttggggttctctatgtggttaaagcatggttgaatcgatccacatgtagaagttatcagttattacttcttaatgactccaatccagatgacacaatggagtccctttgtggaatatcagcaccatgccagattgcaatacagctattcgtgacgatatgctgtctgttctgctcatgttggagtttatcatcggttttctgtttctgaagtctcaggtaattaacctcgaaccttctgggtaaattctttttatcagtagtaacaatggtagctcttcatcatcggtatcaggatgctcattttgagttttttttttggggaagaatttgcctcaagcccattttccagtttctacagaaggctggaagcaatttcattttgcgtaatcaagatatcacctgctagacaactttgcaaactaacatacaccctgtaagagttgtcaagtgtacaattatagatcacagtgaaagtagaatgaatggtaaccacttcagttgacatcataggtcttgggcgtctatgatgtaacactctctttcgcacacagcatattttgtatgaaaaatattatataatcgatctcttctactgaactattgttctatgtgctcgtatgcaccacagtaaattaggatgctaaattgatttgtcgggctgcaaatctgaattcacaatcgtgagctaggcataaatttctccaattgagttcattatcacttcctctgtgataatttggttcattctctccgtgtggtgggcagcatcccagtatatgtacttgctgggatgtgtgcatgctcttcggcctctgcatgtttgcccaacttcaataactcctgttccacaacaacctcttgaggtttctgtcaggcctgtagttcagaagaaaatatttttttgaggttataataccaataagtgcacactttaataaggatgctctgaaatataggacaacttaccatagttattggggcttattgttgccatgccgatggttgtataagtatcaacaaatgtagccctgatatttggttgattctttagaagacgcaccacttcaactagcctctcattaaatgaggttgccagcaagttcatgttttcatggcatctggttgtacctgtgcctagcaatgttctagcaataggtaaacacccaattgggggcactccaacaaagacaaatctccttcctccaagtgctgccatcacctgagtaacatggcaatgattaggtcttgagcaaaagttgatataactcttttctgacaagtgcttacctgggtgtagttagcaacgcgtgatatcagctggttttcgtactgtgggccgctctctgctgctgactggtttgaggcaagatagtgaaaaagcagatctgttgttccagcacttacgacgaatgtagccctcctgactagttcttctgctcttcttcgtccaactaacctctgcaggttccttttgtaacgccaaaggtcctctatttggttgggaaatgacagtgcattctatcatgaaaaaggaaagaaaacctgtcatgacagttcattctaccatgaaaaagaaagaaaacctgtctagtcactacccaatgctggccctcaataatcaaattaacttggactactaagtagtcatgattcacatatcaaactaggttgatcatgcattatctgcttggttatccaattttgactactaaaaaatatttggtagtagcttctaattctgtccctggcagattgatttaatagcttttccttactttctgacggtgaaatatttgtgctttgcaggttatgcttaccgaacttctggcagtggcctcgtcatacccggaacctgctgatgcaaaactcacacccctcctgagctgtcctgacctcaaccttgggtcgcggaatcctggaatactcctcgctatacctagtttttccgctgcataaccacaaagcttatcctcaaatatccctactgaacaatggtgaacaccactactaactcaggtcaccttctaaatcaaagcacatctgctcaactctgaaatacttgtgtaaatggagatgcaaggcaatgggtgtatttgtgtctgtaccgagtatgtccgtgatgagccggccgttgctgaaccggccggtgggcctgccgccgaggaagtcggcgccgtacggcaagaagttggccttcatcgccgtctgcagccggttgttgttgccgggatccaccgtcgagtcaccgaacaccagcatggtggtacacccggtggtggtgtagttgatcaccctcgccggcggtggcggcactgaagaccagcccggctcctgcggcggcaccaccgtccgcggcggcgccggctccctccttggtggcaatggagactgccacggctgctgctgctgctggggcggcgttggtggtgctggctccggcgtgtcaggctcctgtgatggcggggaatccggcagcggcggctccggcgaatcggaataccccggcgacggtggtgacaccgggagcccaggcatgggcgggtcgtcgtattggtcgtccggtggctgtggcggtgacagctgcgccgctgccattgttatcagggagaagtgccatgcgacgaggagcagcgccgccgcagccaccgccagcctcctcatggacttgctgcgttgctttgctcagttcagttatgtgctagcttgtcaaggtccaaagacaagagtgcatgcatgtataaataaatgctcagtaagtaaaactgccgttgcctgtcaaggtggcttggtgccatgtaggtaagggagcgactaagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaaattttttgcaaaaaacgcaccgtttagtagtttgaaaagcgtgcgcgcggaaaacgagggacaatctccccaaacactcacaaacgaacggtgcctaaatttgcttaagagttcgagcttgctttgtgtgacatgactaaatttagaagacattttcagtgaaatcacccacttgttagtggccagtgggagattaatcgggagagattcttgtaaaaaaaaaaggagatcggaataaccaaagaggcacatactgcaaaattgcaaagaagagcaggtggtggttggttcagtggtttgtgtgatctttgcgtctgccatgcaaattcgctcttctagaacaatcttctttttttcttttttttccagcgaaaaaggtactgtgattttgtatttcctccttctatagtcaacaacagatgtcaaaatatgcatattcttcctccggtaaaagaaatacagcgtttcaacatttttcagttcgatcttttaaaattttgatcatcaataatttttgaaatgcttattttgaaaatataaaaatggtcaatgtagatttgttatgaaaaaaaatactttcgtaatctcataaaaatgatacatgtgtagattttataagtacctagccatgaaattgattttcttccttcacaaggtagaaccgaaggtaaatactgaaaataatagcaggagagttttcttttaataacaattctcaccatcatggcatcgtctgcttcaaaactagtactcgcaaatccatattcctctagaaacaagtaaacaaatagacatgtcacaccaatacacccaattgtttactcataagggattactcgcaaattactcgcaagaaaattccatttattatgccaaaggacatgagtgtcaaaattttgacattaattaaacaaaaaatgcaaacatttattatgccaaaggacatgagtgacaaaattttgacataaatgcaagagcctcagctagacaaaattgtcatttacaaaagagagtcctacatttattctacgacaaaattcaaaggaaaaaaaaactcttctaaatgtctatcctatcctaaccttggaaatgactgaaaaacaaaaaacccaacttcttcacgttggaatccggtctgcccacctataggcctgtagggatataaaccttcaaaaaataattgaattcttcatacctctaaattctaatatgataatttttgtatactgtatgatcttttggtatcatgtcatgcactctaaaacctaagaaagatgatctaaataaataaataaataatgaggatcaatttccctcatgcttcggctgcttattgtcattagagctggtgccctgctccaatgaggccttcacaaatctgcctctgacacgccttcgcgtgtctgctgttgccttgcgggaggcgtacattatctgcttgacaaacctgaaaaattcaaaagtgtaccagcaacttgtaattgcaatcttgtttcaaaaagctcgtactgaacaaaatattattcctaggcaactaaataatatttcagatgcacatttgagaattttaactgttctttctgaagactaatctgcaatgtaagctacaaagtgagacgaaaaatgcgtattgatacgtacctcctgttgctctttttctccttgtatctctgcacagctcgctgtctcttctccggatcagggcaagatttctcgggcagcacgatatgcgaggtctgttgatcttggccgtcaaacatgtttgagctcccacccagcagcgagcccgtgttggagctctgaaaattcacacagggaaactctgaacctgtgttgttgttgctactgtttgtgtctatcaccggtaactgatcatatgccgtttcgtcgtttatgttcagtggttgcagaagactatgatctgaagattgcggtatgagctgtgcgagttctgaagatgaagttgctgctcctatctcgttgttgatgttcgcgtccatcatcggtaactgaacataaggtgcgttgctcatgttcagaggctgcagaaagctagtatctgataacagtgcgatgtctgaacacgatgaggatgccatttgctgatgatcagggtccagataggatcccaaatcgaaataagaaggatccaaatccagataagaaggttcctgcgatcaattgaagaaaacaagtttgtgaggcggcatcaaactgtacgataattttgatgaatttgaaagggggtgaaataagcagaaccatcgtttacttgcaatgctcctggttccattagtgcgactgaatcaaacgagtttgtccaggcttgaaagtaatcttgctgatttgcattgtcaacaagtaaatcttctccacctattgtcgccatctctttactaatgtcaggattcgcatcttcaaacatctcaaatgagacatgtgtgtatatatatattagtatgcttatgttaattgaatgatggtaataagatgatatgttagtcatataatggaatgctatatattaatgggattgatcaagggatgaattaggtaaggaaaagaaatgcaactcacttttgtttaagaaggcagatcacttagagatttaagagtttaccattggcttcttttaataccagatcacttatttttaataccagatcacttagagatttaaggaaagaatgagtttaccattggcttcttttaatacctcgggataataacaataatttgtatagctcatactattgtcgtatgggacgaatgggagtgtgtcggtgatccacggctcatccgtcgccgccgccgccggcggcggcggcggtgccggcacgtcgatagagaagatgcgggccatctcggcggggccggggataccggtgtaagcggcggcggggcggtggcagtggcgcgaggcgtcgcgcgcgcacgaggcgc

SEQ ID NO: 1389 - DNA, 8128 bp, Oryza sativa
cgttgtcagtagcacacgcatctagacgtcgacggccggtgcgcgccgcggtgccggccaccggcggcgatcaaggtgagcgtaacgtggcggacgagggtgtccgcagggatcgttggatgggggatcgatggacctatttatagccctcgatggatttagtgtgttaaatatagtacggagtagttagcaacagaactaacagaccgacgtacggatcggttcatcatatccaccgactcaaacacgtcacagtggacgccgatacttcgtttcgtggtacgtacgtttagacacgatcagtttcgttcccaattataggaaaggttttcctttaaaaaaaaattagtataggagagcacgtaccatgccgtcttttaaggttcagttttattttatttttctgataaataatccctctatacaattatcaataaaatcaggtcatatctttgttcgttgaaaagatatctcctgactttgtgtagtttacagttataccacggaccccactttactatagtccacatgttacgcgctggaaagcgatctcctgattttgtgtagtttacagttataccaccaacctcacctacatgttactgcaagtcggccggtctcttcattcgtctccgttcggtttttggttttgtcgccgtttttcttttcaatccttttttttttttgcacgtggaagggtttttatgggtggacccgctttactcccgttttttttaccatccggtagttctttcgtcgctggtttttccttcgatctccagccgccgtggagccgaaccttactgcaacttcgatttgcctctcgatgtttcttcctccaattaattaaaaaatcgattatccactcatttctcattattttctccatgattttgtctttcaattcgacttaaatttggaaaattatatccctatttaaccgttagtggccgtctttttcccgagttttttcaattcggctttaaatcttccctgatttccccttttaattcgggaaattcaattcctatctagagcaagtacaatagcaggttacaagtcaactataagcacatatatgaagtagaagagaggagagtcacggctttaattcggggaattcaattcctatttagagcaagtacaatagcagaatacaagtcaacaagtaaactataacaccatatgaaagagagaggagagagaaagcgtgctacagattggtagcgagctactacacggattccaaaagttatatgtgtataagaggtgagactatatattaataatatagtaagcaactattgtatgagttgactattaaattggttataaatgatttggatttagtagttagctatactattaaacttttgctcttataagtaactatttgatagaatgagctattagattgactatagatgatttggagccagtggttggctatactattaaacttcctctcaaccatttggagccggtggttagctatactattaaaacttgggagaatttgaaccatgccacacaaaattttgtaaaatttgtgatatgccaccctgacccacatgtcattgactcatgtgggtcctacatgtcattgagatacgggtggcatatctcaaattttgcaaatataggttggcatggttccaacaaacccaatccgtggtagatgatgtccggcaagcgagcttcctggccatctttattcccgagttttacatattttgattttggaaaaaaaaagggaaagagatgattgagtggatcaaaagccctaaaccaattttaaattttaataaataaagaaagatcagaggtgattgagtggataaaaaccctcaaccaatttaaaaagatcaagaatgatccaattttaaaacatctttgccgaatttgatgggaatgatggcatcggcatcggcatcttatggacagtatgtgcgagctgagccggcttctctcgtggactggccgtaaagagactgaaaatcgtggactgggccgtaaagagactgaaaaggaagaaaagattgggctttagtccaaaccgggactgaaaatgaagaatttattagctttcagtaaaaaaaatatttttcaatttatttctcacctcccaacaactatatattctatttctgaaaaaatatctttacttattacaacgactgacatttttcatagcattagagaaaaaaaaccatgcatgattatgtgttgcaaatgctccttactcccgtagcacggatgaatgatttacgggattcagttttatctaatttttctcattttatctgatttttgtatcgagttcttgtttatcgtaagaggatttagtatgaataatttcacattataataggtgtgaaataaattctctaaatcaccctgagattaactgaacaaaatcacccctggtgtgaaattaccctcaattattttttgtgtgagagattaaccgagcaaaatcaccccaatccttttgtgtgagagattaaccgaactaaaatcacccctcgtgtgatagattaaccgaacaatgcaaaatagaaaaatatccccaaccatatatactccctctatttcaaaatgtttgacaccgttgactttttaacacatgatcgttcgtcttattaaaaaaatttgtgaaatatgtaaaactatatgtatacatcaaagtatatttaacaataaatcaaatgatataaaaagaataaataattacttaaattttttgaataagacgaatggtcaaatatgtacttaaaaaatcaacggtgtcaaacattttgaaatggaaatggagggagtatggattaagaaagacacgttaaggatacaaggaaccctaacaaacattgtgtctcaaaacggcagcaaccaatcgtagacgcgatgatggcccacgtaatctgatttggttatacaaacgtgttgccacactgtggcagcctcctcctccgtgtacttgtgaacgctccagctaattttgtcatacacgcctagcacactagagtcagtgtcataacgcaagctaccacacgtagctgataagtccgatcgtcgccgcgcgccgcgccatggtgccgtcgttcccgcagccggccagtgcggcggcggcgacgcggccaataccggggagctacggcccgccgctgctcggcccgctccgcgaccgcctcgactacttctggttccagggccccgacgacttcttccgccgccgcgccgccgaccacaagagcaccgtgttccgcgccaacatcccgcccaccttccccttcttcctcggcgtcgacccgcgcgtcgtcgccgtcgttgatgccgccgccttcaccgcgctcttcgacccggccctcgtcgacaagcgcgacgtcctcatcggcccctacgtccccagcctcgccttcacccgcggcacccgcgtcggcgtctacctcgacacccaggaccccgaccacgcccgcaccaaggccttctccatcgacctcctccgccgcgccgcccgcaactgggccgccgagctccgcgccgccgtcgacgacatgctcgccgccgtcgaggaagacctcaacagggcccctgaccccgccgccgcctccgccagctacctcatcccgctccagaagtgcatcttccgcttcctctgcaaggcgctcgtcggcgccgacccggcggcggacggcctcgtcgaccgcttcggcgtgtacatcctcgacgtgtggctggcgttgcagctggtgccgacgcagaaggtgggcgtcatcccgcagccgctggaggagctcctgctccactccttcccgctgccgtcgttcgtcgtcaagcccgggtacgacctcctctaccgcttcgtggagaagcacggcgccgccgccgtgtccatcgctgagaaggagcacggcatcagcaaggaggaggccatcaacaacatcctcttcgtgctcggcttcaacgcgttcggcggcttctcggtgttcctgccgttcctggtcatggaggtcggcaagcccggccgggacgacctgcggcggcggctgcgggaggaggtgcgccgcgtgctgggcggcggcgacggcggcgaggccgggttcgcggcggtgagggagatggcgctggtgcggtcgacggtgtacgaggtgctccggatgcagccgccggtgccgctgcagttcgggcgggcgcggcgagacttcgtgctgcggtcgcacggcggcgcggcgtacgaggtgggcaagggcgagctgctgtgcgggtaccagccgctggccatgcgcgacccggcggtgttcgaccggccggaggagttcgtgccggagaggttcctcggcgacgacggcgaggcgctgctgcagtacgtgtactggtccaacgggccggagaccggcgagccgtcgccggggaacaaacagtgtgccgccaaggaggtggtcgtcgccaccgcgtgcatgctcgtcgccgagcttttccggcggtacgacgacttcgaatgcgacggcacctccttcaccaagctcgacaagcgggagctcactcccagctaagctttgctgccgccattctctcactcgatctccatgcacatatgcatgaagaaattaattaaattcaagttgctagctccattttttctctttgagctgctgataaaaaaaacatctctattcttctgtgcaataagccaataattaagcattaatcagagcgtacaagtaaaaattgttttcactgttttatgtggatatatatatgtacagggatccaccaaaattaatttgatactacgtagtacgacatttgtttagggatcaacgattcacgtttcacttttttttacagcgtcaacatatataaacacatagatatgagagtatttaatatacttattactgacatactcgcttcgtcccataaaaaaaaaccaaatcctatgtatgaatggagtattctagtagtacagtagtgtaaaaaaccgccaatagattgatcctgaatttcaggtcaaggagacaaagcaactactccatagaatcatagtattaggatatgtttcatccagtaaaaaaatatatttgaagatggggagtaagaaacacgaaacggaaaaacgagtgaagaagagaagacatttcagggtctgcttgtttctgatgccaaaagcatttttttagataatgccaaatgcgtggacagaatgcttgttctaataccaaatgcatggacagaatggttgataggtatctgcttgtatcttgctcgatggaaaccgcatggacagcgacgcatttcttctccttttgcatgttactactgaacggttgacacaggatatattactggcgaaaaagtacatgttaacatgggttcaaacagtaacacgcatttcaatcaagtgtgcaagtgcaaacacaaaatgatcgtctgtaaccgtagcgcgtaaacaacaagacgtacagttatactacctccattccaaaattttgacgccgttgacttttttaaaaatgtttgtccgttcgtcttattcaaaaaatttaagtaattgttaattctttttctatcatttgatttattgttaaatatacttttatgtatacgtatagttttacacattttacaaatttttttaaataagacgaacggttaaatatatttaaaaaaagttaacggcgtcaaacatttagggaaggagggagtatatgccaaacatatccctgtatggctatattgattggcaacaaatacagtactattgatcccgtgttgtgccaaccacaacagcgacaagtatcctgtcaatttgtggtgctaacaacttgccattgataagtccagattaactagaatagacgcaccaaggcacatacatgtaaatgctagctcctggataggcaaaattgatccaaagaccagctaaactgccaaatcgttgggaaagtttacataaatgtgtctcccttgcaggtaaacaaaaacatatagtgagctgaagaaggctagttcttcgtgcaagagatcagctgtgcaatcctcataaaagggatcggctgatcatagctgatgaagaaaatgaatttgttgatttcatgaataacagtggcactaaaaggcattctgaatataaatgaaaaatacagtgttagaaagacaccaaaaacaaacaaacaaagacttgcaaggaaaacagtacaagacaaacagtcaccatagttctacttctttcacatgtgaaacatggctaggaaaggaaaatgaaaacctagacatgtaggaattgagtatacgagaattgccatggtttgtaatttgtactctgtagtttgtaccataggcattgcatttattcatttactatggcaagagaagaacagagaaccaagagcagttcaagaatagatagcagtctgttagaggagcgagttcaatgcagaagagaagttataatcaattggtatggaaacaatggatgtatcaaatggcatcggaaaatgtcgttgctgcactcacatatctagctacaaaaaggacagatggcttgaaggaggagctagctacgtacatcatgatggtattattccaaatacaatctgaaacaggtttgtagcctgagtttaaatgataaaaaaaggagtaactgaatataattttaaatggttggtttgccaagtcagtaagctatacaagcacagcaatgtacaaggttatgaatatattaccaacaataatctgtctcaatgcagaaaacatgtcgaaataacaaagcacgaatgaacagagcaacgtctgtcatacaaaaaactaaaatttcttgtgtggtcttagcagagccacttatagccaacccaagtacagcgaaacgtagtcatggcagcttaatttctcaatgaaattcataacaagcacatgttcattgattattaattaaacatgttttcttttgctaaggcaggtaaatgtacctgcccatgtttgcctctatattggaattaatttgtttgttttctttccatataaaaaagtgctgggaagcttctattgcatttgtatacacttcttatatattctgtaaattagttaacttattattattattattatctcttacttatggaagaaaagtaattaaccaatgttgcgtgtcctcacaaggatgtgtttgttctagttctcgtaaaaagaaaagaaaagaaaaggaaaggaaagagaggaggtgggtttggcccaactagaaaggcatctcgtacgtaagcccacttagcccaactagagaacgttgtaggggttgcgggaatcaacagccgccgggagaggttaattagggttccaaacttgcatggagcgagagatcgagatgagcgagatggagacgggtaaggcgatcgagttggtgttgaagcggttggatgaggtgcgtacgcgcatggatggggtggagaagctgttgcgtatactcatctgcagggaggagaagcgagcgaaggttgggaggaggaggaggaggtcgacaagatgcagatggtgacggcggcggcaggtggcggtagcagcagcaggaggaggaaagccatcaagagaaactttaaggctaaagaagcagaccgcaaggagacggaagaggagggcaatcaggtgaagaagatcaccagccagcagctgtaagtgtatttaagtactccctccatattttaatgtaggatgccgttgactttttaacaccactcgtcttatttaaaaattatatgtaaatataaaaatacttatgtcaaaaattttatgcaaatataaaaatacttatgtcatgcttaaagaatatttgatgataaattaagtcgcaataaaataaattataattacataatttttttaataagacgaaaggttaaacgtttgtaaaaaaatcaacagcgtcatacattaaaatacggatacggatagagttttatctgtaccgatggatgatccgatccagctattatccatcatccattctgagtttattggtaatgatgatactactgatatggtcaatttaaccctaactagttagtataccaatgttactatgtgatatatctgggcctcccaaaaggaagaggaagaggaagaaggaagaagacgc

SEQ ID NO: 1390 - DNA, 4555 bp, Oryza sativa
  unsure (1)..(4555): unsure at all n locations
ctccgtttcaaaatgtttgacaccgttgactttttagcacatgtttggccgttcgtcttattcaaaaaatttaagtaattattaattcttttcctatcatttgattcattattaaatatatttttatgtaggcatataattttacatatttaacaaaagcttttgaataagacgaacggtcaaacatgtgcctaaaaagtcacggtgtcaaatatttcgaaacagaggagtatatattagtactaatatcagattcttctactgctgacttcctgaatgagacgaacattcgatgcaaaattagagaatggttggtagtacgactgagatagtcagatagatgatcacgttgggtgtgtgtgtttgtcttggagggctgaaaacgacagttaagcttagacctgctggccgccagctagactccattgtttcgcttatttgcaaacagaaaataatttgcaaataaaacttttatatatgtgttcttagtgataaaatgcaaaggctgaaaaaactacgattaaaaaaaacctcaaaatcaacttaaggttgttcaattttggtttataagcatacgcataagtcaaaagatgaggctgttagtgttaatttcccagtggccaacaaactgtttttgatcagtgaagaaattaattcaaatgaatgaatgacggagtattggagcttgcacacttaagtatcttagttacataaatgtacgagcatctccctcacagctaaacaaaaacaacgcaaggctagtccttcagttctcatgcaggaaatcagctacgtaatcctcgtagaaaggatcgagtttgaaccaacgtaatccttataaccaacgtaatcataactaagaacagtggcactaaatgaccacactctgaatataaatgaaaaaaaaaagcaccaaaaaagatcaagaagaagaagctgctgctttcaaggaaaacaatacacgacaaatagtcaccatagttctttcacatgttaggaaaaaagaaaatgaaaacccaaacatgtaggaattgagtatacggattgccatggtttgtaatttgtattatgtaccatagacattacatttactatagccagagaacagagaagcaagagcagttaaggaatagagaaactatcaatgggtaattcctacatgtttttatattagaggagcgagttctatgcagaagagaaactatcaatgggtaattcggtattggaaacaaacatgtataaattgacatcgaaaaagctacaaagaggacagatggctttaagaaggagctacaagatgcattccagccaaacttgaaacaagtttatcacctgagtttaaatgacaaaaaagcagtaactgttcctcgagttgaatgttcacaccaaaagttggttgactggatcacggcaaatgatggatatgaaaaaaaaaaaaaagggtgcagaaataccatcaaaatgacttatctttaccatggaacctggaggcaggtcgagctaaaaaacatacatatctaacaaaaatagtacaacagatacacatcatgtaactgaataaaattttaaatggtcagtttgccaagtcagtaagctatacaggcacagcaaagtacaaggttgtgaatatattaccatcaacaatctgtctcaattcagagaacatgtcgaaataacaaagcacgaatgaacagagcaacatttgtcatacaaaaactgaaatttcttgtgtggtcttagcagagccacttataaccaacccaagtacaggaaattgtagtcatggcagctcaatttctcaatgaaattcatagcaagtacatcttcattgattattaaacatgttttcttttgctaaggcatggtacataactaaatgtggggtttctaaaaaaagaaaaggtaaatgtacctgcccatgttgtctcccaggctaaaaaagaccacttggccaatagctcagcaagcaaaaacaaaagaaataaaacactgctcttcaattcaaaaggaagatagtactatcttctcatgaatggataaaccgctacgcacccatggcaacccgtttgcccctcttggatgttgatgatgcattctctgccaatatcctagacaaaatgtctgcttgctttgagtaccctccagcttttaagctgtccatcagggcatcgcaacccttttgatccacgacacctcctttgttcttgatcttgcaaagcatggagtatgcaggcaatgtcttctcctcagtgtacagggcctccaagactctgtcataggttgagaagctgacatcaaagtccctgtccaatgcaaaatcagccaacttatgtgcctccatcactttgtcattctcgcagagggcaatcagcaacttatctagatcaggcaagcatccattttccaccatcagattgacacggccgattgcttcctccacatggcccctcatgaagagagcttccagaatcttatgagccatgtccatgttctctgtaacccccttctcaatcatactcttcataaccctgctagcagtctgaacccggccactgttgaaaagcgctaccatgacagacatgaacagggatgggctcggtacatgcccttgttccatcatactgtcaagtgccgtctttgcatcagctggctcattcttcttcaggaagctatcaacaagcagtgcatgcgattcagggtcagtacggacaccacggcgtgtcataatggcaagaatctcctgtgctgcttctggcacaccttcctttgcatgcccacggataagactgttaaaagcagccttgtcatcaacgcctttcttcatcagctgcctgaagaaagtctcagccttgctggtgttcccattgctgcacaaatactcaatcactggattataagctggcccttcaagcacagggctctttgggctcaacagtgtccccttctcaagaagctcatccatcacctcaacagcaccatcacactttccacccgcgcacaagctctccatcagcaccccatactgtcttggatccacaagaacatgcttgaactgcccactcttctggtgcacatccaacgcaccatccaagtcacccgctcggcatagcgtcgtcacaagcctcaaaaacactgacttgtcctttggagtgagccgccgctccgccatgtcatccattgccttccgggcctccacaacccttccctcatcatcacagagccctggcatcagagcagcaaacgtcttctcgctcaacctcaaccccttctcccccatttccgagaacagccccactgcctcctccaccttacctgcttcaacatatcccttgatcatgacattgtacgacaccgagttttgtgcaaaaccagctcctggcatttcgtcaaacactttgcgggcactctccagatcacccgcccgaacccaagcattgagaagagtgttgtacgtcgtcacatccggtgtcaccccgtgatccttcatgtccccgaacaccctcaaggctgcctccatcttcttgcacaggccgaacccccagatcaatgtgttgtaggtggacaggtcaggggtgacggcgtcggcgatcatggcgttgtagatccgcctggccatggcctctcggccgcggcagaggatggccttgaggacggcgttgtaggagagcgcggtgcgggcgatgccgaggtcgggcatcaagcggaagagcttaacggattcctgcgggatgttggccttgccgtaggcggcgatgagggcggcgacggtggcctcctcgggggcgatggagaaggagggcatggtgtcgaggaggatgcagcgggcgtggttgagcatgcggtgggaggcgaggatcgggatgaggagggagaaggtggctggctcggggctgaagccggcgcgacggtaggcgaagcggaagaactggagggcgaggtcggcgcggccggcggcggcggccccggagatgacgccgtggacgagcggcgcggcgagcgtcggggagagcaggcggatggagttctcgaggcgggtggtccacgggcggcggcggatcatgtagaggatggtctcgtggaggggctcctcgcggcggggcgggttgggggtcgccgccgccgcctccgccggcgtcacctccggcacagcctcggcctcggcctcggtctccgggggaggtggttccggcgtgtcgagggtggagaaggcatggcggaagagaggcgcggaggggttgttgcgggagaggaggcggagggggaggtggaggtggtggcggcgcgacatggctgcggcggcgtggaggagtggagctcggggagaagagtcgagggtttaggaggaggaggaagaggctcgacaccacccacgctaaagagcgtgatgggcccatatttaattgggccattaagtgacttgtggttctgggccttttagaacccagcccaacacggcagtgtagaaacaagggattcatacgggccgggctcaacagtcaatacnnnnnnnnnnnnnnnnnnnnnnnnnnnnnnnnnnnnnnnnnnnnnnnnnnnn

SEQ ID NO: 1391 - DNA, 10967 bp, Oryza sativa
ttacagaagtcacacaggacataataagagacacccacctatcatcaaaacccaattttaacataatcttttccaagaaaacccattcaactctgtcatacgccttatgcacatccaatttaatcgcacataacccccttttcccttgtttcctcttgatagtatgaatacattcatacgcaatcagaatattatctgtaattaatctacctggaacaaaagcactgatcacttataacctcaggaaggatgctcttcatcctgcgagagagcatttttgaaataactttatacaccacattgcaaagactgatagggcggaattgagccaccatatctgggttagacacctttggtatcataataatagtggtatcattccagccctcaggaattgttgcagtatttaccgctgttaaaacttcctttatcagatcatctcctagcattgaccaaaaccgtttaaagaaaatggcgtgcaaaccgtctggcccgggagctttcagatctccaatatcaaaaagtgcctttttgacctcttcagctgtaaatggagctaaaaggctccgattcatttcaggcgtgaccttgaccttaactgaatccaaaactgattcatcaagctcctgcatttcagactgaaacagatgggaaaaataattttgcaccatagaacacatagtgtcgctattctcttgtctcaccccctgttcatcaaccaacccagtaatcatgtttcttttccttcgactagaggcaaattgttgaaaaaatttggtatttcggtcaacatgctttagccaatttgcacgggcgcgctgtaaccaaatcagttcctcctgctccattaggagttccaggcggatcaacaactccttttgggcagcgatgctatcatcagtgaggggccccttctaatctcttcaagttttttttgcagcttttttatttgattaacaggtcccttcaacacctttttatcccagacgtggagctcttcatgtacttgcttggttttttgcgagaaatttggcacatctcctctggccgcagcactaccgtctcttccttgagccaacgtgcttcgaagcatttaggacctcgccttgtattggcatcagaatctgcccgcacaacagtttcaacaatcagcggactatggtccgaattgagcataccaccattctccagtcgtgcagtagggaaaagagcattccactgcgcgtttgagacacctcgatcaagcctttctcttattctccccctttgccaagtaaaaatgtcaccactatagcccatatccgagagagcacaatcagccaaagaatcactaaaagcttgcaaaagacgttgttctctcggtctccctccctccttctcatgatggaaaagaatctcattgaaatctcctaactccatccatggcctatccatcatcccatgaagatatctcaaggcctcccatgttttgcctttgtgctcccaacgcgactcaccataaattccagtaagtctccattcccttccatcatcaacaattacatcaatgaaatattcagagacatcttgcacataacataagcagtccaccacttggcccgtcactctcgaaaatgctgagatggtcaaaatttctgccttagctgttcccaaatgtgtttcagacaggaacaacacatcgggtctctcacgcctctgtaaatccagaagcgctcgcactgcccgccgcagttccatgctagtattttcattgtgcccggtcactctcctcaaaggagagcgccgattgtgcattagagttgtttgttgcaatcacgccatcttcacttctcctcaaagggctcatattactaccgagttgggaagagtgttccagcaagttgatttgctgagcaacctgacctcattagtatctcttttcccggactcaggggccaggccaccatcttcccctaaggccaatagcagtgcgggtaacacacatgccgtaaagaaccacacttcacagtgcacaatacatgtttgtgggtcccacccatgttagtaggtcccaccatctctcttttcacattcatctctccctctctatctctatccattcttctcgcatgccactgaccaggacggcaagcggcaagggcgaggacggcgggcaagaaggcacagacgccggcgagctcggacgcggcctcaacctccggtgagcttctccgacgaggacagtggcggcggcgcggaccgaagcggcgtggcaacgagctccccggcgacaccgaggtcggcgacgcggagcggagagcgtggacgacgacgaggccctccctcactcggctccacggcggcgcacgacggcgaaccgcccgccccctcctctccttgtcgggccggacggcagtgacctcgacggtgggacggctgcgcgcatggcgaggtagcgggtcctgtggcggcggcgtcctcggggccgagtggcgccggctgtcccctcctccctccgccggcgccgactcccctaatcccgaagcggaagaagccggcgagggtggcagtggcgccgaacgatgccggggacgcggcggacgggaagccccggggcgaggacggcgggcaagaaggcatggacgccggcgtggcggcgcctctcatcgttggggccggaggccacagacgccggcgcctccctccccctaccccgctccgcagcaacgggctctcggtggggtcttcctcgcggaggtcgccgcgcgacctcgtcttcctcgcggacgacgagcggcggcacggtcgtcgtcgaccggagccacgcgaccttgtcttcctctcaaagccgggtggagcggcggcccgagcggcgacggcgacgacgctgggctgagcggccagatccggcctaggcccactggatcaaggcgacgacggcgaggtcggacgcggcatcgacctcgagctcctctccttctccgcgctttccccatcgagccggcgagcttctccgacgaggacggtggcggcggcacggatcgaagcggcgcagcgacgagctccccggcgacatcgaggtcagtgacgcggagcgggagacggcaacgaggtcgacgctggagagggcgcgaggggacgacgagttggaggcacgccctccacagcgcgagctctaggcgttccctctgcctcgcgcgagcgaggaatcgcgtttccttgcttgggagcgagcggctcaacaaggacgtggtgctacgcgacacgtcggcgaaattcctagctagcacaacaaggcaacgctctacctaggagcactgtgaagggcctaagggatggttaagggggttaaatatactttttcctaaaaaggataggagcgagacagacggcgctgggggacgaggcttgttgggccggccttagcccagactcacgacgcggttgtgcgctttctaggtggacggatggatctgctcgactgctctctgccgtcgtgagggctgaagtcagacgtcacgagctgattccgcctcccctcgcccctgccatctcaagcgccgccgttgtttgctccatccctcccacgccaaccgcagcgcagccgctgctgccgtcgattccgacgcccagccttcgccaccggcacccctccccgctgatcgcctccagaccgacgccgcccctccccaccgaccgcatcgcccccacctcaccctggatcacgacgggatctcctccccttcctctcacccggtgccagaccgccgtggcttctcgctgctctgcctcttccttgtgcctcatcaccctggtgttgaaaggaagaaggtgttagaagtagtgatagttcagagatatgcatgcatgcatatgcagggagtccggtgcatgtgatatgaatgagattgatttggttgagataaaaccggatcacaacagattttgtttcctgattgtaagccacgttggaggctatttccaactgagatcaatatattcgtgcggcctcgacaagaggtgataacgcttcctaaaaaccttttatggtatcagagcccgaaatcgccagaatcagatcgcatctgttatggcgagttcctccatcagcgccggcaatcccttctctggccatgccgtccctaagaagctaaccaggacgaatttccttttatggaaagggcaaatcctcccggtgatccgcggtgcgcgtttggaaggttacctcacaggtgcaacacaagccccgtcggctgtgattgacgccaaggaaggagaagccactgtcaagaaatccaatccggcatttgaaacctggattgcggcagatcagcaggtgttggggtttcttctctcaaccctatccaaggaaattttgactcaagtcatccacatggaaactgcggctcaagtttggaaggcaatcaacgagatgctgtcctcccagtcgcgtgcgcggtctctgaacacgcgcctggcgctagcgacgacccagaaggtcgatctcagcgtctcggactacatcaacaaaatgaagatcctcgccgacgagatgacgtccgccggcaagccaatggatgatgaggaattgatgtcctacatccttgccggtcttgatgatgattgggaaccagtggtgtcttccctcgtcgggagaccagatgcagtttccttctccgagttctactctcaacttctgagcttcgaatcaaggcagaaacttcgccatgcagcagcgcatcagtcctccgccaacagcgccaaatgtggtggtggaaggggcggctacacccccttcaaccgcggcggacacagcggcaacaatggtgggcgcggcaacagcaacaatggcgggcgtggtggtggtcgcggcaacaacaatggaggccgtggcggcaaaccgcgccctgtttgtcagctctgtggaaaaacggggcacgtcgtcgctgactgtttgtataggtatgatgagaactttgtttctgataataagatggcagctgcagcctcctatggtgtggacacaaattggtatgttgacaccggagctacggatcacataactagagagttggacaaattgacgacccgggagaagtacaatgggaaggatcaaatctacatggcaagtggtgcaggtatggacattaaacatattggccattccgttattcatacccctactcgcaatttatatcttaagaatattttacatgttcctaaggccaagaaaaatctcctttctgcacgtcgtttagcccttgataatcatgcctttgttgaagttcactctcgtttctttgccattaaggatcaggtcacgaggaatcttcttcttagagggccttgccgcaatggtctctatcccattccacagtcgtcgctatcttcatccaagcaagtttttggagccatcaaacccactatttcgaagtggcatagtcgtttgggtcatccatctttgtctatcgttcaaaaagttgtgaacaataataatctcccatgtttaggagatattaatgaattaggtgtgtgtgatgcttgtcaaaggggtaagagtcatcaactcccctatcctaagtctttcagtgtgtccaataatcctttagagcttgtgttttctgatgtttggggtcctgcccctgactctgttggtggcagaaaatattatgtcagtttcatagatgatttcagcaagtttacttggatctatttgcttaagaaaaaatctgaggttattcataagtttcatgagttccaacaacttgttgagaggatgtttaatcgcaaaattattgctatgcaatctgactgggggggagaatatgaaaaacttcattccttttttactaagataggaattactcatcatgtctcatgtccccatgctcaccaacaaaatggctccgcagaacgtaaacatagacacattgtggaagttgggctttctttacttgctcacgcttctatgcctcttaaattttgggatgaggcttttcttgcagctacatatctcatcaatcgcacacctagcaaagttatacaatactccacgcctttagagcgtctcttgcatcaaaaaccaaattactcctctttgagaacttttggatgtgcttgttggcctaatcttagaccctacaacactcgcaaacttcagtttcgctccaagcaatgtgtgtttcttggctatagcaatattcataaaggattcaagtgtctagatgttgcaactggcagagtttatatttctagagatgttgttttttatgaaaatatttttcctttctctaatctccactccaatgctggagttaggctcaaatctgaaattttactcttgccctcaacactgttgaatcctgaagttgctagtaggggtatacaagaaaatggttatatgtttaatagtcctcctgttgagtctaatatttttgatgagcaagtatctgaacagggagaagaaggagagcaaaattcatatgctgcacatgatacagaaaatcctgatgatggtggcaatgatttctctgttgcttctgatgctgaaaatagtactaaggctgtgtttagttcagcgcaaagtttggattttggttgaaattggagatgatgtgactgaaaagttatgtgtgtatgacaggttgatgtgatggaaaaagactagagtttggatccaaactttgaatctaaacacaggctaatgcaagtggttcagctgaaaatagtactaatgcaggtggttcagaacctgcagcaaatacacacggcgcagaaaatgaaaacagtgctactgctgctggaagtaccacagccgaacctgcaaatggcagtggtggtggcaagtctgcgagtcgcagtagcagcagtacagcaataggtagcagtgttactgctaatcagtcggttgatgactctgtgcaggtacaacagcagcaaactagacctaccactaggctgcagagggggatacgtaaggagaaagtctataccgatggtacagtgaggtacagttttcttgcttcctctagtgaagagccacagagtttaaatgaagctttagctgattctaattggaaacaagccatggatactgaatttacagccttgattcataataaaacttggcatttagttccaccacaacatggtaggaatgttactgattgtaagtgggtatataaaattaaaagaaaagctgatggtagcctggatagatataaagctcggctggttgcaaagggttttaaacagcggtatggtattgactatgaggatacttttagtccggtggttaaggctgctactattagagctattttgtctattgctatatctaggggttggtgccttcgacaacttgatgtgcagaatgcttttcaacatggtttgcttgaagaagaggtttacatgagataaccgcctggatatgagaataagagtaagtctagttatgtttgcaagttagacaaggctttatatggactgaaacatgcactacgggcatggtattctagactaagtagtaaatgatgtgatcttggttttaagtcatcaaaggctgacacttcattatttttctatagtaaagggagtgtgactatttttgtccttatatatgtggatgacataattgtggctagttcaactcaagatgcagctgaagcgttgctaagagatttaaaacaagattttgcccttaaagatctaggtgatctgcactattttatgggtatagaggttaacaaggtaagcgatggtattttgttaacccaagaaaagtatgcatctgatctgttaaaaagggtaggtatgtcaggatgtaaacctgttgccacacctatgtctacctcagagaagttgtcagctcataatggtactgaactaggagaacatgatgccactagatataagagtattgttggggctttgcagaacttgactttgactagaccagatatttcttttgcagtaaataaggtctgtcagtttttacatgctcctactttacaacattggatggcagttaagaggatactgagatatgttaagtcctctgttgatcttggcctaaagattaacagatcttcttctactcttgttagtgctttttctgatgcagattgggcaggatctgtagatgacagaagatctacaggaggtttttgcagtatttcttggatcaaatctagtgtcatggagtgctaggaaacaggctacagtatccaggtcaagtactgaggctgagtataaagcagtagcaaatgctacagcagaggtaatgtgggttcaaactcttaaagaaattggagttcaagttcctcctatggcaaggttatggtgtgataatttgagagctacatatttgtcagtcaattctgtgtttcatgctagaacaaaacatatagaagttgattatcattttgtaagagagagagttgctaggaagcaactagagataaagtttatagcttcaggagatcaagttgcagatggttttactaaaccaattactgtttaacagcttagagattttagacacaatcttaacttagataagttatgattgaggggggctgttagaagtagcgatagtttagagatatgcatgcatgcatatgcagggagtccggtgcatgtgatatgaatgagattgattggttgagataaaaccggatcacaacagattttgtttcctgattgtaagccacgttggaggctatttccaactgagatcaatatattcgtgcggcctcgacaagaggtgataatgcttcctaaaaaccttttagaaggaagtagcaagcaccagcggcagcgaagtcgacggttgggagaccctaaaccctagaaccaagctccagaatcgatccccttttgcctaccggtaatgggcgacccagttctagcctacaggtacggactccttcctccctctctcccagacaatcacgacatcgatttatttatcccattgctcctgttaacttggtgcgttgtttgattcccagcacttgtttcagaatgacgtgtgaaattgcaagtacagagcccagtcagtcatctcctcatcagcacggcggtacgagaagtctgggcacagcaagcaagcaggaggctagcaaaggtttgtcagctctaatccaaaaacagcacctcattgcacatattttccctgtatgtgaaagaccatataagctgtgcagacaacaggtgagtttgatctccctgtgtgtgaaaaccatctatcgtgcagacaacatgtgttattatcctgtcgtttatatgcaaactatattgatagttcgagtgactgaataatcaaaatgagtcattgtcagtgagtagtattttcatcaggtgaagaaaaatggtagataatattactatatgtcaatgtcacgcagggtttcattcagtccctacacacagattccctatgaaaaaattcattagccaggttgtggtagtgtggtcttatctgccaccagtaatgcaaaatactaatctgagtgtaaccaaatccttgaaattttcaaatattcaaatagaattgggagaactgatgaaatttcattttagaatcctgcagtgtgtgaaggtgtgaaaatgagctttctggtatctccttttccaattatgaaattatttttctttatttatgatacatctcataggtagattgaagaaattactatgacagagtgagttctagatcccaccaaaaactcagattcaattttacctccagcatagtgacatattcaatttctatctcgaatggtgcttcaatatcaatgtggggttttttttggcccttttttttaaatcttccttcctctattctttgtgtaaaaatataagatgcagtttgaaatgtattgttttttatatggtcatcggcatattcttgtttgctaaaggaagtatgtttgataaatagtatgtttcatatcagagctttttcctccaatatcttgtcatgtatggcatttccaatagcttttcatggtgtcatctcgatggcttgcatgtataagagatagacgggaagggcttgtaactataggggtaccatgattgtgtcagattgctttgacctttacggaacattatttttcaacaaaaaggaataatactgtgtttcgatatcctcttttcttgtatttcagattctgtattatgtaactcgtcgcatttggtgcctacgtttgtactatatcttactgatttacagtaggacctaagtggtgttcaatttttcatttcattcctacccctaaagataggtactgtggcatggaagatgtatgtttctgtgcaagctaaatcgcacttatgcataaacgcatggttaattactttatctcctcagttaatctacacaacttgatttccaaaaacttgatagtatcaagtgaagtctcaagggattaatacatgattatgctttgaagggctttagaaaaaaaatgctgggcttaagtacaacatgctggatcactaattatccctcttctcaaattgatcaaatagtactgcccatctcgaactatgtatattctaatatccataactgcctactctttatgatcatatagtattgtctctaataaatttgatactgtgattttatatcatgatttcttgtatagcatttttcattgaatgctttgttgttaatgctatccctcaactatcagtaggaccagttggatctgtcgagtctcataaagaagagatgcttgtgcttgtgcttgctggttcatcaaacagctcgggaaaggccttggcctctccagtcggagctccgacaaaggccgcagcgcatgcatctaggcaacattaggacctgctttgtgctaggagctactgctctactaccatcgtcaccgctcaaaacatcgtaggtaggtagcctgatttcgtctatttctcttcaatttctgcaccctgtctgaatgtctggctttttagggttcttccgc

SEQ ID NO: 1392 - DNA, 40186 bp, Oryza sativa
ctgcaggttgcaacacgccagcaggtatttcttaatttggatattttaattgttataatgtgaaggaatcagtggatagatctagcttgaatatttgactatctgtcattaatttacacagaaatgagaaacacatatgtagccattaatgtatatgatgtttataggtcaagctatatgtgattagttttcttaaggaagataatagctcaaagtattttcttcctcagaggagattttacaaaaagtactgtcaccggcattgcggatccccgatctccaccgccagagctgcgtcgctagactcggtgacgcccatctccgtgccggctccgatctccacttgatctccaccgccaaataccgtcgcccgcctcggttgtctcgtcccgtcctccgtgccacccctgatctccaccacccgaacaccgtcgcccgccctgtcacccgcctccacacagccacggatctctgattcgcacaaaggtacataaatcctcctctcgtttcatcatacggttcttaatattttccagaatcaaccaaaatacaacgaccaaaacaatcattatggtatattatttgtgtccaagttctgatgaatataatgatgtttactatattaattgcaccactaaaatatgggatgtcatcagtattttattttttaagctttctgcctgaattggtttcatctgtcagcgtaaggaattgcttgagtataagactcagctgtcaagagggccgtctcgccgtcgtctcaggctagggggccgccgccaattatctattcccatagagggctgctatataccggtatcccgacgaaaaagggataattctgaaaccaacacaatatcgtgcgcgtgcgtcaacaaaaacaggaatagaaacgtatcgtaccagtgctcgctgccccgcctgaatcctcccgacgaatcctcctccagaatcgcgctcccgcgtgcgattcctcgccggcgcgagctcctccgcaacccgacgaatcgcgattcctcaccggcgcgagctcctccgcatcccgacgaatcagcctcggaatcgcgcgtcctcgccggcgcgagctcctccgcaacccaacgaatcctcctcggaatcgcgcgcgattccgagtcggcgcgaactcctccacaacccgacgaatcctcctcggaatcgcgcgcctccgtgcgtgattcctcaccggcgcaagctcctccgcatcccgaagattcattcgcggaatcgcgtgcctccatgctcgtttcctcgactgattccattggcgcacacgttgtctgccaatttcctctgcaatccggcgtcttatgtgattgctgaaatttttcacacaagtagcacatgattcttgtggttttcaaagatgatactctattaggatcatgtgatactcttgaggatcacatggtactcttgttatcttgtaggatcatgtgatacctctgtagcatcacatggttctcctcaaaaaagtatcattaagtgtgatacatttgaggtatcacatatgatcttacttaggtatcatgtcttctaacatgatccctatgggtttcacagatggtacttaatggtgtgatactttacaggtatcacacatgatcctactaaaaaaaatatcattaagtgtgatacatgtgaggtaccacacatgatcctacttagggatcttgtcttttaacataatcctacttgggtatcatgtatcctacttaggtatcatgtcttctaacatgatcccaataggtttcacaaatgctacttaatggcgtgatacttatcacacatgatcctactaaaaaaagtatcattaagtgtgatacatgtgaggtatcacacatgatcctacttaggtatcatgtcttctaacatgaacctacttaggtatcatgtcctctaacatgatcctacttaggtatcatgtcctctaacatgatccctatgggtttcacagatgatacttagtaggatggtgtgatactttacaggtatcacacatgattctacttgggtatcatctctggtaacatgatccctgtgaggtttcagatatgatactttagtaggatggtgtgatacctgtgaagtatcatacatgatcctacccaggaaaatcatctatcatgatacatgggtaggtaggatcatgtgatacatgagtttcattatgattgatacatgtgaagtatcacatgatcctatctagtatcatgtcttgtaaagtggttccctactggtttcacatatgatacttgagtaggatcatgtgaaccctgggaggtatcatgatcctcctcagtatcatttcctcaggtttcatatgatactgaactcggtttcattgtgtacaacgtactcaaactatatatagtccacagaaaaggtctacgcaatataatccacttctttaccaacatatatgtacatgaaaacagtagccacatacagagttcatgtctttgattgttgtgccccttgcaaccttccagttcaagacaaaaacagtagccacatacacaattctgaaacttgacttgttacatatgttggttgggggagagggagggagggagctacaaaaatggcctaagcacacatccgacactgcttgaaccgaatgagcatattggttctgaagcttagaaacgacgttttggatgtaagtcgttaaagcgatggtacaacaaccttttgcatagctcactacgatattctttcatgtagtcctgcatagatgacaagaatgagcagtgttagatttgtcaaagtggggtgaagctgagccgttgttcaaccttggagagcaccttgtcttctttgaaacatgcatgaaatcggattcgcttgaagcaggtggcaacgccatttcaactctgtgcacatgtgtgaacggataaagaaaatatcatttcaatggtgattcatcctcgattgaacaaaagtatctaatcattttaaaacagaaaacacccatgtagccactaagatatgcaaaacatcaacagaaaaaaaaatccaaatcatctgcatctatgactcagctgcatctgccatctctgtcgccacgcactgccctctatgacaaagaggataacaattgacaagcaaagcgtgcccggaactagaagccaacaaccgactgatgcggatttctctgattttgtttacacttcagttcacccaaaaaaaaatcctactagttgaatggagatttctctgtttcaaaacagtgtgtacttgttaacggcaaaattgcttgctccaagcaatatttgccttcccatcaatatacagctagaagcatttcaagcgatctattccaattcgaacattttgctgcaagtatcatatgattcagcacatacacacatccctcacctctgctacaaacacccccagtgaatgaacaaaaacacacagaaaaaagagagagagtattaacttactttgatttcaatttggatgtgatatgatgagccccatccacaaattagtgattcaacaaaccctagaaaatgcaaaaatgaagagatgttaaatcaaaatcaggaaatcgatgaaaaaagaggaatgagagaaaggggtatcgtgcgcaccggctctgccgcagcagcagccaccggctccgccgcagacgccaccggcttcgccgtagacgccgccgccacagccgccaccaccacgctcacgccactctccctctctggcactactgaccttgtgcgcatcggcgccgctgaagaggaggagccgcaagcaggctccgccgccggctccgcccgccgccgactccgccaccgccgccggctccgccgccgcagccatgctcgtgacgatttgggagctgtaggtgtctgtttgggagtgactcagggccgttttggattgctaccaaaacttagccttaccaatattttggtagtttaaatagtacatgtgcttgtttggattgagaccaatttattggtaatgcccatgctagatttgccatcaatctagaacaatcttcactagaagtcacatgttggctttatattggtaccaaaccaaatataatcttatcctaccaaaaaattggtaggaccaaaatttatctaagatttggcactactaaaaatttggcatggtagcaatccaaataggccctcaatgtttctcgagtgtgtgtatctgatccgtgagggtgtgtgtttgatccgtgggaaattgtcccgtccggggctgactccaaacggtataccggtgactagcatttctgattcccatatcactatgaacaggtgttttgcgctcgcaaaacctccttccctgaattgaaggtacaagcaatttcaagtttttataattttcataatgggaaacctgtttagattgtcgagttttcagattatttagaatggggtgcctgtttagattgcagcataggtaaaaaataaaaataatatactcaatgcagttctaacccctcgatgcattatttcagttgaagttcagcatctaaaaacgtatatcgcctctccaaacatgatgtgtactaaaactaatgagaaatgcttcctcttgattgagcagatattcattgtgaaacagcactataaaccatgtttcttctatcatcattaaaaggctgaatgaaaaatgccagagcgagcgttcctctgaatatttctgaatttggcgatatcatttctgggttgttcttagtgaattttgaatataatcatttttattttaatcatgattgatttgcacactaatgtcgtcatctggcaggagcacaagctacccattcaaaaatcggtgttgggcaaccagccgcttctcttcttgggaccccttgctgtttcccgtcgacgtcgggctttttctgacttgtgggttctactattttattcccctgttttccttgtgtgatcgatacgattggttaattaatgatgcagaactagccttttgtttttccgtggtaccaaaattgacctttggtagctatgaacgacatatgtcttggcatatttcttgcggtaaaaaggttaaattttattgtacataggatccgtgccctttacagttcctaaatcctactgggcagatatgttcactcgagctttgctcaatgcgatcattcacactatatgtttctctgcttattttctgaataagctggtaagtagtattatgccacctatgagaaaaaaaaagttattatctgcatgtgtgagaaaataacttattaattatctgcatatgcttccctaattcaaatagcaggcttaatcttttgtcaagccaggaaaaatgctaactgtctcagcattactgcagagtgtgtttgggctgcaactaatttttgaagtgcagtgagtctcagaccttggagataaattactgaagaactggactctaatgtgagtacctgtttaatatctgttctattaaccttcaaggatttctttgtaacaagttttaaattcagtcaacattgcttaagacttaagataattcagtatattttgttataaattatgtgccgctatggctcttttcaatgcgcattcgctgtttggaatgcgagtatgttcaaacttaagaggagcatttggatcttgctgttttaaaaccatattggtgaatatgcagatttctgaattgctctttcaacaaaaataaactataatatacacacattacttcagcaaacatgactttagcagcttagcttttctgaaacttgatgggtgtgtgtttagtatgtttgttgaagtctgatttcagagataaacttagaggtacaattgctcagctgccaagatctgttttgtagaggtacaagtacaatggcagaatttatctcaccatgattcctttttatatggtgaaagaataaaggaacaaaacaaaacaatgataacttgctcagtagcactttgagacaatcttatcctcactttagaactccatgaagtgtgtgatatgagtttctgaccatattttctgaatttggcttatgttgtattttaattttgtagtcttgggaaaccattttaagcctctgaattgttgtagggttgatcactttttctaggccttttgtttttcacctggcgatctggcatcagatcagactaattatttgtctagcccttaattgttgtatatttgaacaatttgcacaattatttgagaaaaaaaggaattacctcaggattgattagtcgcacagaaacccatcctttattttcacatggcctggaaacataaggtgcagatattatcaccttccatgaaaataaagtgtactatttagtactgtatagtgcacaacatatgctatttcacaaactgtttttagattatcataagttgtcatgattccttataagtttctaattatgaaaatgaaagtgttgtaagcatgtctgcttgttttccattgccagacagactccattttggattttattaaccaatgtggtatgtattgtcctggttatttctcaaattgctcctctaccagattggctgaatctggaaaaaaaattatgagattgtttactacatactaagatttaccggtaaattatccaattactctcttgcgtccttgattcctcaactattaattaatcttttgcaccttgtattttccaatattgttattccttcgacaaaataagtttttactcttactacgattcactggtcaaataagggcatctcataattaatgtggtgtcaatgtatatattatacaatacatgtgcgacatatttaattgcaattaggaattttacatgtcaagttgttgaaggaatcaaacagtagatgatatcttgccaaatcggactttgctctaccaattgatataaatataaagtaagcctctattgaaacctatggtgctgaagttaatctttgccaatcagtactatctatctatctattatataatatataattaaatgaatagaaaaaaggagcctccacgttcgctctcatggcctagaaattctcacattaatcggagaaaaagaagaaaaagaaaaagcagagtccatatagaaatacaatttaaaaatagaagaggagactagagtccatatagaaatacaattaggaaataactgaaattcggaattaaaatataaggaatattagaagaggagactagagtccatatagaaatacaattagaaaataactgaaattcggaattaaaatataaggaatattagaagaggagactagagtctatatagaaatacaattaggaaataactgaaattcggaattaaaaataaggaatattagaagtagagtatatagttcatatagaaatacaattaggaaatgaaagaaatttggagttaaaaataaggaatattagaaatagagtatagagtccatatagaaatacaattaagaaaaaaaatacaaattcggaattaaaaaataaggattattagaagtagagtatagagtccatataggaatttaaaactaactaaaatttggaataaacgagtccatatagaaatacaattaggaaataactgaaattcggaaataaaatataaggaatattagaagaggagactagagtccatatagaaatacaattaggaaataactgaaattcggaattaaaatataaggaatattagaagaggagactagagtctatatagaaatacaattaggaaataactgaaattcagaattaaaaataaggaatattagaagtagaatatatagttcatatagaaatacaattaggaaatgaaagaaatttggagttaaaaataaggaatattagaaatagagtatagagtccatatagaaatacaattaagaaaaaaaatagaataactaaaatttgatattaaaagaaatattaaaagacgagtctagagtccatataagaatatatataatttacaaataactaaaatttgatattaaaaataattaataactaacacgtatataaaatataatataaaaattcagaaataaaaataaataatataaaaatatataataatgctagccgcgcaatctgcgcgggccaccatgctagttttctgtatatgtactatggtttctaacaacaggtagcggctttggtgaggtgtgatctgattgctcacatacatgtttatgctttatacttccaagttgcaaaaaaaataaataaatgataccaacgtcctcttgttttatacagcacatcatcacaatttaattggaataatgtgtaattatcttctccatactattgcgttctagatgtgtcagtttgcaccgggctgataatatgactatatgttaacacttgtatttctttaaatttgtactttagcatcggcaaattttcgttgtcgttccatgtagatcttaaaagaagacgttaacgagatgaccaacaattgttatcttgttttacatggtaaaactattaatttgatatatgtatcatatcaaactgttatttgagtttatattcacgatcttatgctaacacaaaaaatattttttttgttaacatgaaattttattgagcttatattcaagtcttatgctaacacaaaaaatatttttttgttaacatgaaattttattgaggttatattcatgtcttatgctaacacaaaaaaaaaattttgccaacatgaaattttaaactttattaaagacaaatagaaatacagtgtagcgtttagcactgacatattactagtaatgactggttattcattgccaatttaaaaccaccattattttcgccgtggggaaatgcagatgggccagtccaattaggcctaatgtatgcatatatgatggttcccatcatcacaaaaatagtccgcaaagagattttaatcatatgaaaatataaaacgaccgacatatatacgagcagtgttgtggaaaacggtgttaacggccgttaatacgtccgataatacggatacggagatcagtccatcacgtcacgccgatccggtcattattagtcggtaacgaacccataaatccgatcattaccgattaaatcgtccgtctccgtctaatcagacgtataatcggcgtgatgacaaaggtcgattccacaatccagctcattagctgtgccctttggattcggatcaagtgcagtcacagtagtgactgcaactttggcagtacctaatcatccaaccatccagcacatgagggatggtccagatttaactgtgtcatgcatcattttagctatttgaacaagcacagaacagcttcagttcagattttgcctgcaatttctctccttttgatctgaattttcttgaactttcagaaaacccaaatattgttaaagaaaagtagacacagacttcatttcattatattgaacttcataatatcttgcacgcataattgacaaaatgagctagagtttaactattttcgctgaaattgggtgtcatgcatccactgagacaaaagctttcaaaatcaactagccatgctactgctagattaacccagtaacaaaagctttcatgatccaaaagtagatcatcatctgcttcccaaatcagcacgatgccttctaagttctattgacctcttcaaatgaacttttgagataagatgacatcttcaacgtcaatagaaccctagggaaaaaaaaataatatccaaattaaaataatttgttagcacatatatttatctttgaagaaactggtcagcataccagtagaagttgggcatagctgctaattgcttcacattcttgatgttcttccacatcagtttgcatgttttcctcctctgccttttcttcaggctgcataacagatttgagaagtggctcaatatatagttctcaatatatatagctgcataacagatttgagtagtcgctcaaatatatttacctttctcttttttgttttttgcagtttatcaatccaatttgttttccgttttgttacacgtttccggctctcctttttcttcagaccagagacatgtgccaagttctgagctaactgggatgttgactgatcattcgactttgcaatgccatcactgtaagtttgttttattttgtcctcaacttttttactaacggcatgaagtgcttcttccacaagcaagtaacattcttcaaagtctgcagctctggaagccaaaggaagaaattgctggtacagatatctgtacctaagagtagtactcagcttggggtcttccactatttgtctgccatgcatatcttgaatagctccacattttgcttctcgagtccaacgcttcaatacatatttttcaggcaacaatttaatgttcactaaatcaagagctttcaaggcatgtctacacagtagacctattctctcaaacaatcgacaactacacgacacggtctgatcaaaagggttggcagtcaacttgtgctcatcttcaagtatgaactgatcatcaagtgagccaattgcaattatgaaatcattacttccatttgatcctttcgtataggcagccatggatttcttttttttcgccgggccggcgaatagccggccgatgtatattaagagtaagaaagggaatgtacaaggtagcgcggtgcgtcaatgcaccaccatttcagacataaaatgaaagctaaaatctcacagaatgagttgctacagagtgacacatggggctaacaagacctgcagctatccaagtctcccattcatcccccatggcggaacagccatggatttctcatattcggcttggaagacttcaaataaagcaggtgtgtaaagcttacttgcctgtaccaaaataggtgtcatcatcataattcttggcaaattctttcttgattcatattcagattgcaattccttctctctcttttcttcaacaacacgctctacacgattaaggaacctgccgatgtcaagatctgatttctaatgacctttcaagttactattcaaactttcacttaattgtgtgcttcgcatccctattgtgaaaacatctgacatgtagcactcagcccacttttcttttaaattgtatatgctatccaaccaagtcactttacgcaccttttgtctcatggcatcaaatacttcttcaaattcttctttttcctcatactcatacatacatgcactgaaatctgctaggatacttgaaccttctgtttggtgaggactcaaatgctttactgcattttgtgatatgtgccaagtacataaaccatgccatgcaccagtgaatacttcagacacagcctttcccattgcaatgtcttggtctgtaaaaatggtttgaggttgcttttgattatgggctgataaaaatgtattgaacatccacttgaatgattcaaatgtctcatcatacatcaaagctgcaccaaaaaccactgtctctctaaaatggttgaagccaacaaacataccaaaaggtctactttctttatttgtcccgaatgtagtgtctaaggtgatgacatcaccaaagtgagcataatcagcaatcatcctacatctgcccaaaatatattagctatttgttcttcgcaatccaattgcactgcatagtgaaatgagggattttccacaattttatcttggaagtactttagtaaacttcctgcctcaccataaagtaagtccctttggcgcctagaacgcaaataattcttatgatcacgctgtgtgtaaccaagattagctgacccaccaacatgccgaccaagaaactcatgtgctgctttaggtgtaataccagaatcatacgccacctcaatttcgactgcttggtgtttagaaatgttcctttgtgatggcatcaaacggcttgtttgtggagtttgaagaagatggctgtgttctacagctaagtcatgaaccttgtatgtcattgtttccctgagtaaagtgatgcccatgcgaacttggcaaccagttcgagtatgagttcgattacgttttgctacagcatatttcttttcttctgctctagaaccctgatttgaacaaacaaacctactggatgttactaactgatcaagatcacttttgttagtgtaattctttcgaacatcaaagccaatacgaccaccatatttgacccaaaaatcccaagcttcttcataggaattaaatgtcataccaatttgaggcatccaacagggaggtttagtagatctgttacattacagtatagaggaataaaaagtttgatgcatgaacaaaacaggaagaaagaagacaaaaatcagaagacaaaggatcctatcgcgatctgtacctctccaggttttgctccatggccttctcaacggtcatggctgaacagagaagagaaaaagaagcgtgtgatgtgcagcagtagggggtaaagtatgcttcccatggtagaattggcgccaattctcacctccctctcagacttttccctccaaaacacatctgctggagtcagagagtaggtgaaaagttgggggaaattgagcaaccaatctagaccatcccttgtgtgctggatggttggatgatgggtactgctaaagttgcagtcacagtagtgactgcatctgatccgaatccgtgccgtttactactattgactagaagtttgctcttctgaaattctcacaaggcagcaagatgtaaaatgacaaggaactgacttcctctaaaggttttgaacatgagttccttgattttgatgagtttgctcttccggaattctcataaggcagcaagatgtaaaatgacaaggaactgatttcctctaaagtttgaacacgagttccttgattttgatgatgatcacgttattggagtttgtatttgatgaagctcttcgaggtaaccgatacacatgttatttgggactttgattacggtcatttatgctatgtaacattctcttgataattcatttcatgcattatgaacaaaacccatcactacgtgagaattgagatatacagtaacagctatccattatgaatttatttaaatgtcatatatggttattctatttaaggatatatatagaaggaatatatttagttatatgcatttgtttatcaaaaagggaaaactattatcaactactacctccatcctaaaatataataacttttggctatgatagctaaaaatgtttatatttttggacggagggagaatgtacatatatttttaaaacgttatatttccgccaaattccgattaatcatttggcggtaccctttgtctgatacccgtataccgttttccacaacactgtatacgagtattgtacagtttctgtaaacatcaataatatcctcgaatttcaaaccatcaataatacaatttgttactccatctgttttatattataaattgtttgacttttttttctaatcaaagttctttaggtttgctcaaatttaagtaaaaaaaatagcaacatctataacactaaattagtttcattaaatttaacattgagtatattttaataatatgtttgttttgtattgtattgtaaatgttaccatatttttctacaaactcggtcaaacttttttcggtttgactaagaaaaaaatcaaacgacttaaaatataaaagaaatggagtattatcattccttcaatccaacaacaaacggagcatcccattacgcggctctcaaaaaagtgagatgcaacttatcaaagtcgatgcaacctcgcgtcaagtgtcaagttttgtcggtgataaataaaaacctcgggaagaatgatggcaatgcgccgagagtaattgtaattatctatgagataaattatagggaccctgctatgagataaattatagggaccctgggtatacatatttatacacacaaaccgataagagttctatttagacatgacacaaacatttgtaaagataaaagaaaaaaacattcataaatacaaaacttatctgccatgtcgtggtcttcgtaactccttttcaaactcgatctctgttgtataaatcttgtcatatttcgttaacgaaatttacttaaatattcaaaccaaattttagcattaacagttctctatgcatgccacattttgccacggccttgtttagatccaccctaaaatttttcaccctatcacatcgaacgtttgaacacctgcataaagtattaaatgtaggctacaaaaataattaattgcatagattgcgactaatttacaagatgaatcttttaaatctaattgctttatgatttgataatgttgtgctacagtaaacattgctaataatgattaattagacttaataaattgtctcgcagtttatacggcaaaaattcagtctaaagtaattcggcgggcgatgggccccacagtacaacatctcgatttgctccgatgagataactgtcccgtatggccgtatatatctgtaaattgcccaacaaaaaaaaggaagaaaagaaagaaaagcttctccccgagctccgagctcccgtgccgcccgctagagagatctcgcccgccgtccccgagatcccgccccgccgtcgagatcacgcgccaccgaggagaggagattcggcggtccgcctatcgcgtgaggacgagcgagactgcatactccagaaggtgcgtgatttcttccagatcgaagatactctttgtcaaaagaaaaaaaaaatatagaaaagaaaaattttgaatagaagaatatcaatagagacgatgatgcggcggtttgtgaatttggtggtggacaccgccggcgtcggcgccgacgcgacggcgtgcaagctgtaccgcgtcgctgcatcggccctcttttcatctccagcacgtcgtcaagcagcagccaaagaactagatccagatgacgtggacgacgccggcggcctgcctcctccggccatcaccttccacccctcctcattgtccggccctggcaacgtcgatttcttgcacctccccggcgacgacagccttctcgccctcgacgtcgacggccgcggtctgctctatagtgccgcctccgccgccgtccgctacatgcccgacccgtgcaagcccaagatggagcccatctccttcaccgccggcgatagcgtcctctacgtcatcgagagggtgcccttctccggtaaccccggctgcttcgaggctctcacctacggcctactcccccacgacttggacaggatgggctggtactggcggtctcttccgccgcctcctttcgccaaggttggctacgacggcgacttccggcgccaccgccagcgccgagagtacgacatcaccgcctccgcggtggtgaacgagacggagctgtgggtgacggcgcacggagctgggaccttttctttcgacacgcaggttggggagtggagggggcgcggcgaatggcggatgccgttcaaggggcggggcgagtatgtggaggagcacggcaaatggtttgggctctcctccacgccgctgcaggggctgcacctctgttcctgcgatctctcccatctctgctgttcctacgatgtgccggtggtcaggcgctggttggatggcctagaccgtctgccggcggcggcgccgcccaagcaatcctttctgatggaagcctacgccgtgcacctcggctccggtaggttctgcatcgccaggttcatggaagaggaggaggaggaggaagttgaggaggagaaggacaacatctcagttcatccattcttccacgtcgccggcgtcaacaacaacaagaagaagaacgacaggttcttgctgctcaccggcgttgatgtggtggcctgtgacgacgccgtcctcgtgcacaagtctatacgctacccattccaaaacggcgatttcgttcgtggttactctcgactcttttaatttcatctaatttacttattatacctctctccggtaaaactagctatattttgttttgtgacggagtgaatatatcatttttatatatatatcccttttcctttcgattgcaataatagtaataatgctgtatatgaatggtactttttgggtactccattcgtttatattaagaggctgtcctcttatagtcttattatacatgctcattcttgactctggaaaaagaaactttttttttgcaagttagaccgaaggattgaccgaccaaattttattaagagagaaaaggggttataattgtttacaagatcgacattaagctgtcaaggcaaagtgacaaccaaaccagtcatcagccgaaaagaaaaagtgaaaacagaacagaggccaactaatcacattgccaaaaaaaaaattcctgcttccttctaatgatcatatgatgaattccacttacagtactacaatttgactgcagctattttgacaattaagaaagcagagtgttgtaaaatttgggcataataagatgatatatcttccttagcagttagcacagcaacaacatcccaaaggtgaaatgtttttgaccggagtgatgcaactgcaacatatattccaaatagattctctctgcaaaattaaattattcaactagttccatctcattgcacgcctgcctgatgtgttgttcattgtatctcaaaaatcatatttgcagcagagcagaaaaaaaaaatcatttgcagcagagcagaaaaaaagcatcagtaatccatgattattattattaattgctcacatcacatccggtggctcatggacgcgagcaaatgagtaataatgcaatatatatagatggacgagatgatcatggcatgtcggcagcgtgatcgtgatcgatggcggcgacggggaggtgagtggaggaggagggcggcggctggtcgtcgtcctcgtggcagcagaggcagagcatgccgcggaggaggttgcacttgccgccaggaagccgagctgcttgcagcaggcgttgcacttgcctctaaaatccgattttatccccttgaatacgacgcgaatttggattcgttttcgagtttatctctccgccaaaccctaggttttcccggcgtgattccttgcgttccaagcccgatctctctctcccgtggctataaatagagtccccttcctctcctctttcgtttgcctcaagtcccagccatcgctgttgcctgtagcgccctacccgcggtcgccttctgtctccgccaccggcagccgttccagccgacgcccttctgcgctgccacttccctcggctccgaaaggctgatctccatcccggccgctggttaccttgcgccgaaactcgccggaagcccttcgtcactttgaatccgatctactccgcctccggccgaacaccaccgttgtttccgtcaacgccaagcttcgccgttgccttcctcggcatcacagcgccaagacgaagcccgtccacacctccgttgctcccatcgtcacctacggtcgccggccgttttccgtcatcgattctcgtcaccgtcaccaccggtgagttcgtctcgtcgtcctctccgcgttggtgctctcggatagcccggctgagcctcctaacaccggcgacctcgcggaccagtgcatggtcggctgtgatgtcatcgatgatgtcattatctatttaataaatcgtgaattctttgctgtataaggctaaaatcagtttaattaatcttgtaaaattcataactaattcatatgaagtcggaattaagtggttcaagtctctaaattcatctaaaatcatgatctacatgtttgtttactttatatgtactgtttatttggtttttattagtttttttttctcgttttgcgtgttagctcgtcgttttcatcgttgcgaaggttcgcgagtgcgtcggaagtgttcaagaagactaattgaagaccgattattgtaaggcaagtcacacaaatcccaaatgaccctttgagcatgttgaacccatttaaagctattgttttattttaaaatatgcattattttcgaatgtcattgggtggtgagtctttctcatttaattatggccgaagatgactttattttcctatggtaataaattgattagcttaaaccttatatattggtttggttcagctagatgttggacataattgcttagccatgcttagaaacattagcacatgattgggataactaatgttacactatcacttatgattatatttaatggtacccatgatggtcaatcgtgattggttaattaattacttgccaactaaaatttgattaatggtgggttgtgagcacatggttttgatggtcgtgctcatgacaattaaggaccggttcgtgagctactgttgtgagacattaaccatgccaaccataagccagcgtgggcaacggctttaccttttgtatagcatggttcatcacggggtgccagactgagaagcggcgagaagttcgtgggggtcgctggggagtccatgccttgttttataagggggtgattatgatccaggaacggtgcactgtggtgagttgtgttgtgcagaggatattgtcacagcctctattcgggtactttccagtatcgcgacgcatggtagacatgatgttgaggctttgtcttgtgggtacagtggtacacctctggccagagtaaaactattcgaatagccgtgcccgcggtcatgggcgggttgagcaatgtttcttgtgattagtctcacacctctcacaataattattggtgctataactggtaataatttgcttagctcctggtttggagttagatctgtacagccgggtatggttgtttaggatggtcgggcctgagcagcatgggtgtgctgttcagtgttgattaaaattgatgaataattactctactgttttacttctaaatgtttgctaaatgctgcttttgcaaatgagcctatattatgccatcctttggtatccttgtgcacttgcatatttgctgtgtggcttgttgagtatgtcatatgctcaccttgcaataatcaatcaacctaagttgaagaaaaatgatccagaaggagaagacgtttggcttataccccagttgagctgcctgtgggagtggagccggagcttcgctagatcgttattccgctgttgttttttttttcttttgtaagtatgtaacgttattattatgatggatttgtatattaaattatcagtttgtgtacctcggctgattcctggacgaggattttttgcacaaattagttcagaaattactagtgaatttctgggcgtgacagtgatccacatgtcaaggccaacgcgctgctgcaagctcatttttcaaggcgcactatcttggcagccgaccagcgggagatactcctttctgctcatagattgctccaggcaatggttgatgttatctccagcaatggatggcttacgcttgctcttaatgcaatggagctgagtcaaatggtgacacaaggcatatgggatcgtgattctgttcttttacagcttccacatttcaccaaggagttggcgcggagatgccaggagaatgaagggaggcccattgagagcatcttcgatctggctgagatgagcatcgatgagatgcgggatctgttgcagctatcaaaccctcagctacaggatatcattgaattcttcaagcgtttccccaatgtcgacatggcttacgaagttggcgagggtggatgatatcagggctggtgacaatgtaactgtacaggtgaccctggagcgtgacatgacgaacttgccttccgaggtggggccagttcatgcccccaggtacccaaagcccaaggaagaaggctggtggctggtaattggtgatagctctaccaatcagggttgcacttcagaagagggctcgagtgaagcttgagttcaccgctgcttcagaagctgggagaaaggagtacatgatctacctgatgtccgattattatctgggccgtgatcaggagtacgagttcaccgtcgatgtcatggatgctggaggggattgatcccaaggcaggaaagaggatgatagctttgcccagcccccaggttgtgtatgaaactgggtggttgcttgtacgctcgtagcaattcctagaagatatcaactttaaacactaactaattaatatcctatccacacttgtatttgtttgttacttgcttctatcttgttcattttctcattgtaactgatgcgcacctgtgctgctacttgtgctcagccttggggatctttattagcctatggctgcatgtgcttcttgtgatcatccttcatgttgtgtttttgtcttcctgtttcatctaatcaagtcattcatgtcctgattctatctacatcatttgatcatgcttggtcgtattatttgttgtatctcatatgttcatatagattgctccagccaatgcttgatataattattgttgcgcaactgcttgcaacgggtttggcttgttctggaaacaagaagtgatgtactaggagtaggacgtgctgtgcagtgtacagtacaccgtcaatccctaccctgttgctcacatggaccttttggattctcgactgcatgcatacatacaaaactgtcactcttaactaattgttgtttgtgtagggtatggatgtcaaactcaactattgttgtttgcgtagggtatggaggatatagtatataactggatttttaaaaataagatcgaacgtggcaattccattaacaaccaaacaaaggtgaagaggtcatgggctaactaactgtgtgaatagtcaacgtagagacttatcgaaaccaccaaagctaagccagagaataaaaaagctcaacgcgcactcttgttttgtttgctttgcgtacgtaagaaaggaaaaaaaaaaaccttgacaaaaacacatgatggataagactagatggaataatattatattattgcctcaagtataaataaaagtcattacggactttttactagtactgctattccaaaataatatccacaaggtaaagttagaatatgaggagagttagtacttagtcttggaggaaattaagctaagcaagggtaccagcagcaacgccaagccaacaatggaggagacctggctcttcctcctcttctccatctcgctcgtcgccgtcttgctcgccaccgctcgccgccgtcgatctagcagcagcaaggcgcgcctccctcccgggccgaagccgctagctcttactcgccaagtgactccgactccgacgatacattttagaccttgggccgattctccgcgacctgcacgcgcgccacggccccgtcatctccatccgcctcttcggcaccaccctcgtcttcgtcgccgaccgccgcctcgcccaccgcgcactcgtccagggcggctccaccttcgccgaccgcccgccgctcccggagctcggccgcctcttcacctccgacacccgcgacatcaactcctccccgtacggcccctactggcgcctcgtccgccgcaacctcgcctccgaggcgctcagcccggcccgcgtcgcgctcttcgcgccggcgaggcggcgcgcgcgcgacgtgctcgtccgcggcctccgcgaccgcggcggcgacggctcccggcccgtcgagctgaggccgttgctccggcgcgccatgttcgagctgctcctgtacatgagcctcggcgccaggcttgccccggaggcgctcgaggaggtcgagcggctggagctatggatgctccgcgccttcaccagcttccccgtcttctccttcttcccggcgatcaccaagaggctcttccgcaaccagtgggccgctcacgtggccgttcgccggagggtgggcgagatatacgtcccgctgatcaacgccaggcgcgccggagacggagacggcgacgacccaccctgctacacggactccctcctccagctgcgcgtggccgaggaaggcgaccggccgctgacggacgacgagatcatcgcgctctgctccgagttcctcaacgccggcaccgacacgacggtgacgttggtggagtggatcatggccgagcttgtgaaccgccccgacatccaggccaaggtccacgacgaggtgagacgccggccggagctaaccgaggcagacctgcaggcgatgccgtacctcaaggccgtggtgctggagggcctccggctgcacccgccggcgcagttcctgctgccgcacggcgtgcagagcgacgcggaggtcggcggctacgtggtgcccaggggcgcggagctgaacgtgtgggtggcggagttggggcgggacgaggtggtgtggacggcggcgagggagttcatgccggagaggttcatggacggcggcgaggtggaggtggacgtgacggggagcagggagataacgatgatgccgttcggcgtggggcggcggatgtgccccgggtacacggtggggacgctgcacgcggagtacctggtggggagcctggtgagggagctggagtggctgccggagacggagggggaggcggcggacatggcggaggagctggatttcaccaccgtcatgaagcacccgctccgtgctcgcgtcctcccaaggccctcctccctctactaatcgtgcttccatggatgaatcatgcatgaagaataacatgccaatcgatagttttgtgatggttgtaaaagcatgtgtagttttatgatacgtactttatgtttaaatatgtgtaatactgttgatttttgaaataatatttcatcattgtcttatttaaatatttagggtaaatataaaaaaacataaatcatgtttaaattatagggtacacataagttgtaataatatgaatgacacatgcatgttttttgttttgtaaaatgaatggtgaatcgtcatatgagtcaaccgcagcgagacgtacgcggtgatttcgtgaatctcaagatataccagttgagtctttgatggtgcttataaagaaagagtgtgcatatgtgtatccatcttatgtttgtactatcattcaaaaaaacaataaccatgaaaaactcaattcatcacccaaggggatatccccttattttcgcatgtcacttaaaaagtcatcaaaaaatatgaaaaaaaatagtaagataaatcaatatgtaatatgtcacttcacagacatacaaatacaaattcaacttatacaagtagaaacaaaaataacaaatttgtgaatttttgtttcgaattgtataagtcaaatttaaaatcgcaggttgcgaaaagatatatcatacattgatatatcatatattgatatatcctgatatgttttttataattttttttgaacgacatgtagaaaacgagaaaatattccctcgagggacaaaattccacttcctatgatatactaacaatatacgtttgaaaacggaacggtgaaataattcattgtagaggaaaatatatagatgaaataattgcctgcggaaaaatactttgggctttgatgggcccgtggtttttcctcgttcagtcggttgtgttttatcgtattttcccctgaattcttgttgtgtaaaggaaaaaaacaaacaaaaaaaaaccattgtagaagcagatgcggcggtttgtgaatttggtggtggacaacgccggcggcggcggcgcgacggcgtacaagctgtaccgtgtcgctgcatcggccctcttttcatctccaccacgtcggcaagcagccaacgtactcgatccggatgacgtggaggacgccgccggcggcctgcctcctccggccatcaccttccacccctcctcattgtccgtcggccctggcaacgtcgatttcttgcgcctctccggcgacgacagccttctcgccctcgacgtcgacggccgcggtctgctctacaacgccgcctccgccgccgtccgctacatgcccgacccgtgcaagcccaagatggagccaatctccttcaccaccgccggcgatagctgcctctacgtcatcgagagggtgcccttctccggtaaccccggctgcttcgaggctctcacctacggcctactccccgacgacgacgactcactgtcctccaggatgggctggtactggcggtctcttccgccgcctcctttcgccaaggttggctacgacggcgacatccaccgccaccgccatcgccgagagtacgacatcaccgcctccgcggtggtgaacgagacggagctgtgggtgacggcgcacggagccgggaccttctcgttcgacacgcaggctggggagtggagggcgcgcggcgaatggcggatgccgttcatggggcgcggcgagtacgtggaggagcacggcggatggttcgggctctcctccacgccggtgaaggggctgcacctctgctcctgccgtctctgttcctacgatgtgccggtggtcaggcgctggttggatggcctagaccggctgccggcggcggcgccgcccaagcgatcgtttctgatggaggcctacgccgtgcacctcggctccggtaggttctgcatcgccaggttcatggaagaggaggaggaggagaaggacaacatctcacttcatccattcttccgcgtcgccggcgaaaaaagcaagaacgacaggttcttgcttctcaccggcgttgatgtggtgggcagtgacggcgccgccgtcgtcgtgcacaaatctatacgctacaaattccaaaacggcgatttcgtttgtggttactctcgactcttttaatttacttacacctctctccggtaaaactacccagtatatttcccttttccttttcatttcgagcgagattacaataataatcttcttcgtttgtaatagagtaataatcgaaatgctgtatatgctccattcggcctttcgtttatattaccaacagacaaggaattcacagccttattaagaggctgtcctcttattatatatgctccttcattctggaaaatgaaaacttttttctttgctagttcgaccgaaggattgaccgaccaaattttattaagagagaaaaggggttataattgtttaacattaagctgtcaaggcaaagtggcaaccaaaccagtcatcacccgaaaagaaaaagggaaaacagaacaggggccaactaatcacatttcccaaaaaaaaaaatcttgcttccttctaatgatatgatgatttcctcttactgtactacaatttggctgatgctattttaatactacttccatattttaatgtatgatgctgttgactttttttcaatgtttgatcattcgtcttattaaaaaaattgtgtaaatatcatttattttattgtgacttgattcgttatcaaatgttctttaaacatgacataagtattttcatatttacccaaaaattttaaataaaacgaataatcaaacgttagtcaaaaagacaacggcgtcatacattaaaatacggagggagtaacaattaaggcaaggtgttgtaaaatttgggcataataagatgatatatcttccttagcagttagcacagcaacaacatcccaaaggtgaaatgtttttgaccggagtgatgcacctgcaacagatattccaaatagattctctctacaaaattaaatttattcaactagttccctctcattgcgcgcctgcctgatgtgttgttcattgtatctcgaaaatcatagttgcagcagagcagaaaaaaaaaatcatttgcagcatcagtaatccgtggttattattattaattgctcacatcacatccggtggctcatgatccagccaacatatatatgtactccaactataaatgggagtagatgagattggtacctgcagtgcaggtatgtgtgtgtgtatatagacgcgagcaaatgagcaatatatatagatggatgaatgatgatcatggcatgccggcggcgtgatcgtgatcgtgatcgtgatcgatggcgaggtgagtggaggaggaggaggagggcggcggctggtcgtcgtcctcgtggcagcagaggcagagcatgccgcccaggaagccgagctgcttgcagcaggcgttgcacttgcctctcttgtagcacaccccctagcacttgtagattgggtagttgcacgtctccgcctccgccgcccactgcatcatcgcaccatctgcatttccatttctaaatcccatcttatttcttttctttcttttcatttttctagctagctatagctgtttgcatttgcaataataatagtattttccatcttcttcttttattgctgcatgtatatgcattcatgctaacttgataacttaaactaatagtcaagcattgaacaggctaactgaaactaatagttaagcactgaggaggaggagggaggagctagataattagtaattaagatgactcacgcgaggcgatgaggacggtcactaggaacagcgccaccaccggcttcatcttcacagtcatcctactcgtacgcctcaatgctcactcgctatctagctgcctggcctcttatatactactcgttgcaagcctgcagctagcttttgacatggcagcccataaaattatgctccagagttaattaacatcgtccttcccattgtaattacaataataggcttaagtaattgtttttcacttttttcttcttttcttcccaaacccccttcttttctttgttttgccttttgtgtaaattttattcctcttaatacaaaagtgcgcaatccttttacgtattccaaaaaaaaaattaaatcgtcttgctgggggtagctagctgtcgtctcctcgtgcttgcttgcaagttactagtattaggagtttctgattatctagcattagcctgctttaagtaatgcgatcaatagtattgtgcgactactatcttaattgagatcgagacaagcatccagttcgttcatcattgatctcttgcaaatcgatctggtacatgtctatgtcattgctcttaatctgcctcaatgactcaatatggctagctcttaatctcagctcgattatgtcatcgaacaattcaagcacttatcttgccatatataccgagacctgatatgtgatagatggacaaattttgaatgtcttgttcgatgcacaacatttggagatgatgcgtgcgatttcgaagctgggacagaatttgtgaagaccaagaaaatgacaactcaatcacaacaaaccaaccaccgcccaggcagatcgcattcagagcatgagtaaataaatttcaagtctccctgttcttttcagaagaatacatgtccgaatgtggtataattaagcctgctaatgggttaaaatccaggccgcatccaccccaatccacctcctctgcaaccactccaccaaaccagtccgctccactttctcatctctaacatccaaattaatccaacccgcaggatgtttgaaaccaacccaacccaaaccattgtagctaagtggattgaatccatttcaaacccatggactgagaccacatgaaaccgccgccgccgccggcggaggaacattgacgcaaacccaacgaacgcatgcaacggtagtagcttgtcgtcgtgctcgatccgtggccgcgcgagcccgccatgtccagagactgcgtgatgagtgagcagctggcctgttcgacgcacacgacaatggctgcccgccgccgtgctcgtggccgcccgccgccgtgctcgcatccatggccgacgcgcacaacaacggcgggacggagctacttcacgacacggaggtgcgcggcgagcttcttctcccgccggtaaggaatagtagccgatgaacctgacctccattgtcgccaagctgagctcgaagagacagccatggtacagccggaagagcaccgcgccgctgctcttggcgaagcactcgagccggacctcctcgtccactgtcaatggcggcggcatctcctccggcgcggctgactccaccaccctcgccaggtccaccgcggcgcggcacgtccacctcgccgcgccgtcgtccttcgacaacgacgacgacagcggccgcctcgctgcgctgtcgtccttcgacgacaacgatcgatatctcgtggcgcctcgccacggccaggccgagcgtcccgtccggctacgacacgaggagcatctccacgctcggcttggcgacgcgttcgaggttcgagggatgagggagtttgatctgcgccgacggcgatgacctgtcgaggcggagcgcgggggcatagcagccgagctccgcggcgttcgagagcacagccagcagcgcagcgtcgtcgctgtctccatggatcgaacccactctagcatccatggatttaatccaagttggacccgaaattttatacccaaaaccaaaccaacccaaaccgttctcacatgcagtccaaaccgccccagcccattagtctcgtcaaaccatttccatccaaccaaagccagcccaaacttgaaaccaatccattttacccacttcaacccaacccattagcaggcttaggtataattaaggggagctccatgcttttcagtgttcttttcaaaagagtacatgtccgaatgtggtataattaaggggagctccgtgcttttcagagtttcagacgaaactgaacacctaaaactgcccaatgtgacggcaacagccaaaatattctgagatttagaggtagcgaccaccggccacatcaacgaggctctcgtctccatgggcaacttactttgttagttcttgctttggaaaaaatataaaattagcaagtggtattttgagaagaaatcgaaatgctaatggcacaggtcaagctagtacttgctgacaatagttgcaatacttctgtcgctatacatagccacgggctcacatactcgtatataacaacaggacttgatcaatttatttcatcatttttttattaccagtattgtccttggagcagcaataacagccagtgtcaacgggagaaaaatattacatcatcaaagccgagtttatgaccctacaaaagttgaattcgctttgcgctctcagtacaaactctccgaatgacatagtttcagctacactcccttggggagccccgtgaccgaatcgatcaatgctaggctttcgtcagtgacaacttttgggccagctccaagcctgctacagatgaagtagctcacatctcccttgaatttttggctcggcatcttcgtctcggcaggagctgggagggcctccacatcttctatcgatttcagtccagcatcgcttagaatcgacttgtcgccaaccatatagctgcatcattttgtttgtcaaatagattcttggatagattggtatgtcatactcatgacaatattaacgcacctgctgagatcattatcttgaggagggaaataatacaagagcttctgaaggagaatggttgcatttttgcggtttggtgcgattaggacagcattgggcccagcatcgaaggtgtaagcaacctgccatcaaaaaaagctcttgtagaatgagaagagttgatagcacaactgtctactagttccatactcgtatagaagaaaaatgcatactagaaaacataaacagtacaaataagtcctagacaaggattttcaatgaaagaacttccttatcacgaagccatattatgtacagccagattatcttgtgcattccttgggcttttgtttccatcataacaaagtaatgaattggtatatatatcatatccaatatatgtactaattaaatatgatcctccatagcattaacaccaatggactgatgacaattagaaaagggtgaaaagggtgtggaaaatgagcttagagtcaaacatttgctatttctacaaagatcattgagcaatgtgagtcatacacgttttggctagggcagtacaaattgtttgtgccaccatatgagcttatggtccattatacccttgttatgaactcagcatgtaaccaaccctatttcatggtatggacatccataaaccgcaacagtttattgagaaaaaaaaaggagaaaagaagagtatacctgtggggttccttctgactggttccacttctccacaaggctaattatcctgtgattaattcagacagcaatgtcaaagctgatgtgtcattagcaacagaagcccaaaacagagcactgataaataaaagatcacctgtgtgatgtatcgttcatatagaagatgggagggctcgtgtccaaacatacagcatgaaattggttgctatctgcacaagttaacctggcaaaggactcaaaattacgagacttgatagcctcttccattttcaacacccgttctggaactacagtctgcaatacaagaacaagcaattcaaaggacataagaaaaaagaagtaacagctaaattgacagaaaagctcaattaatattttactgcagtataaaactgcccaactctacttcctctatgaatcatgagaaatttaaacggtcaaaacagtcacctgggccctatattgcaaaaggggacttgtttcaacactgtctcgcatcccactagtgctacttgtttccttctgctttgaactgacctattttacacagggaagattcaattattttgaaggtgtcagacatgacataattagtaaatgttgttaaaaagcatgataaaatactagagttaccatccgattcaaatttactggttgtgaagccacaacaccaggagacaggagtagtaatgctacaacagattatacgcagtaagaggtatgttaaatgcacatcacataccaccgctatgataataacaagatcattccagtgtgcctcatcagcaagttgtacagctatgctgtcgcttccatcattattctgtaagtgtagtataaaacttatcattactcgctagaaaggatatgcgataaatttcaccaaggctgttcctctttcatagcatcagataactcacttttcccatacaccatttcacgaatcccccatatatactgcggcatgcacttccagacccttgcctgcatttgaatttgtcagttataccagaaggagaaaaggagcagttccatagcatattgatcagtacagatgagtacaagcaacaaaataccttgctatggaagaaagttcaccatgatcttctttcacattcattagctttccaagggtgaaaactacaaaaagcaatcaggtgataaatatgtgcttccattcaccctatttagatttttttaaaaataaaaaaatcaccaataagatgattgaaccattgtctgattttgggtggcattatcaaatttgaaaatatttgagacaaaataagtagggaaatatcattgatatcagaagtaagagactttaccaaaacaagccaagccagcagccgaagaggccaaaccagcagcagtggggaagttgttgaacgatgctatgtgtacatgtagcttcccccagtcctctttcttgatcctgatccccttcttctcatcctcgacatcttgagcacgcttccggatctccctcaggcagctctgaaacctccctcctgacaaggagatctcctgcacagttcaaaacgaaaagccagcttaagacatagtataccattaaaaaaagtaaaggatcatcccttaaggtctagcgtggtgatagatcacagacttttaagtttcacacagtgtaaatctaggatttgacagtttgtatttagataggatcagtgactgtaacagaaacaaagctagaaacacatactagatgctagtgcatatgaaatcaggaatgtgattcttttttaaaataataaaagaatggaaattagagctccactgcctgtagaatttgtagatgggaagaacactgaaacagattgccattattcagatctaagcagcagttgtcatcagtttgatgaacagagtcccattattcagaggggacaacaaagcataaacatcaatgcgaagcaacaacaaaaaaaaaaagtaggaagcagcagagcagagagatggaagagtagagaggaggaggaccttgccgttgagccacatgcggtcggaggggaaggaagggctgacggcgacggtggtggtggcggagaggtggtcggggtcgagggtgacgctgatgctgtcgttgacggggaggatgagcgcctcgtccctcttcccccagtacttgatgacggcgatgttggtgggagatcggccggtggccatgagcacccactgcccctcctccgccgccgccatggaaggagaccgatctgctgcggcccagaagagcgagcaacgcgcgtcagggattcggactagcaacctcaactagatacagtcccaggcagcttaccggaacggaagcaacgacggggagcgggagcagtcgccggcggcggcggaggcgggagggcgggagatcggagacggcggggcggagacaccgaggaagacgagagtgagaccgaatcttgatgctaaatccaacggctgcgatttatctatcccctccttagtatatgttttttcacaaaaacccctcactcgggtcgctatcgcagccagcatcttttgtttttctttcctttttgcacaaagacccctctgaataataataaataataatatgacggctcggttacttcctcctccaagttcaagtccaagctagcgatcgccggcgatcaagccggcgaccatgcttccccggccaccgcgccgcgccgccacccccgtctatcatgatcatatcttctgtgaatggcttttcataagctgttgatccttcctgcagcatctaccaagtgaaatctgcatacacaatttgagatcaacatcgataagatgagatgagatgagatgcacaagtgaaatctgaatgcacaagttgagatcaacatcgataagatgagatgagatgagatacacaagtgagatctgcatgcacaagttgagatgcaggattcctattggattttgaagagagacagataatttacagggggtggattgactgattctcctcatacttcctggcttgaaaacgggaaagcttggagctttcggctctgatttgatccggtcagttctactgcttgacaaactgtggagaatctattccttccagccatatacatccaatttcttgacaatctggaccggacgatccatcagaaaaaattaattcagaatgcaatttggagtgcagcagcttttttggctggcacatcggtgtagtgcatctatatgtgaccttgcaactgtgcaagggtcaaacagcacggccacaagtacttttgttgatgaatcagttattaccacatgacttcgtcaatgctagcccagcaagtgatggaaggaaagatggatgaatgataaggctccagggctcataaatacctgagactgaacattgctcattacagtcttcagatgtaaagcagtgttgttcttcttctctattctgctcaaggcagctgcatccagatcactctactgatgaggaccacgaggatcatctgctggaagaaaacaaagatttgcacattgactatgcactgctgtaattgtatcaatatcgaattctaaatgctgaatgaacagttgctgatatgatcctgtcaggaagcaaaaacaagatactaattgccctcagagacatatatagtggacgtgcactagtgttttcataccacaaatcctttggccactggagtcaacttttgatcatctggataacataagtaaagaagattctatttcctacaagagcagcagcagctaagcacacacatccttttttcctttccagaaaggatataatgatggattagaatattcagacagtagtacagcttcaggattgctgcaagattagtcataaaataatactagtagtagtatcatcttactaccatccatggggttcaggacaaattagttgaactaggagtacatacagctgatacagttgtgcagtgaagcggtgacaattgtcaattgacaaagtgccaaggtctcacagctaatccccagctcagctgcctgctgcccccttgatggtctgcacatctctgcccattgaaatctttggtcagcaccatcctctggctgtcaagagttaggtgcagcccgatttgagtcaaccctttgattgcatcaagcaaaggtatactagtatcaatgcccctttatccaattctgcaaagtttcttccccaacttgctgtgtcctgaacaactggatttcattcggtcatcagcttacacggctggttgaatggttggtcaattgcaagctgttcatctgagagactgaaacaaaaccatttggatttgcggttgcagtcttgcagagatcacagaatgttgatctttcaggattagaaacaaaatgcagcacaaatatgatatgagtatatattctgatgaccagaatcagcacacacggttggttgaatgattggtcaattgcaagctgatcatctgggagactgaaacaaactgtttagattgcagttgcagtcctgcagaaatcaaagcaagtgcagcacagtatcaggcttcatatgacatgaatatatgatgacgatcagagattcagaatcgaaatcctcgtctgaaatttacaatttctgcattccttcactagtttcaacaacatttttttttgcttgctcttcagcacaaagattgaacagcaatacacactaacccaacaaaaagttagtttttacaagcaaatgtacacttcacaggatcacaaaggcagcagcagcagcacataaaaatcaaagaatggtagagtacagaaaggggaaaaagagagatttttttttatcatcctcctaattaaatcaaatcaacagccaactaccatcgtgggtttccctccacggaaggaaacctcagaaggaatggtggtgaggcggcgcgccggagccggacgccgccgccgccgcggcgctggcggtggcgctgctgttgctgcgcgtgctgtgctccatgatgcgcaccacctcgccgcggctggccaccacgcggtggaacacggcgcgcacctgccgctccagcggcgcgaggccctcctccagagcccggcacgcggcggcgagcgcctcggcgcgctcgaccacgtcacgcgcgcgctcatcggtcgcgcccatcaccagctgctcttcctcctcctcctccgcgacttcctcgaggagactgctcagctcccgcgcggcgcgctccacagcctgcatctcggcgaggagccccgtcgccgccgccgaccccgacgacgaccccttcttgtcctttttcctccactcgtcggcgatccgctcctggagagcacacatcggggccgcccactgcacctgcttcggcggcgccaccggggggttggtggccgcggacgaccggtcctggcacggcaccgccgcgaccagcgcccacatggagaagacgagcaccgagctcatggtgtagagcgccagccccagcccgcaacccgcgccgggggaggcggacgtgggcgactgcggcggcggcgcgaggtgcgccgccatggcgtggacgtggcggccggaggaccagttcctggagacgctgaaggacagcgcgcgcgcggggccggccctgcacgagggggacggcgcggcggcgagcttggcggcgtcggggaacagcctggagatggcccggcgcgcgcggccgaagtgggcgcggtgcagcggcggggcgaggaggcacgaggcggcggtgagcgcggcgcggtgcgagccccggagcgaggcgagcgtgagggagacggcgttgagtatgtcgagcgtcttgacggtgcggtcgaggaggtcagcggcgaggcggtcggcgggcggcctggagagcgcggcggcgacggggccgatgccgagaacctcgcggaaggcgtcgtcggaggagagcaccgcgtcgagcagcttggagaggaaggcgagggagaggagcggcgggtgatgggagagggcggcgaggcggtcggcgacgtgggcctggagggcgtggaggacctgcagctcgtcgtcctgcgcggggtcaaaggaggcgacggcggtggcgctgcggcggaagctgaggaggccgaggaagcccatcccggtgggcggcggcggcgggtcggcggcggccatcgtcgtcggggggcttcagcttcggggctgtgcgtgtgcgtgggcttgggcttgggctttgggcctgggccttggtggtggtcgtcgagggaagcaatggtggtgggtggagcgggcggtggtggcgcgcgccctcatatacgcacgcgcgccggctccgaccacgtctcgcgcgcaagagctacctttgactgcaaggtggggccatgggtgtatagggcccatgtgtcagtgggggtggagaggaagaggaggtggtgcgctgcgcggagaggaatgggaaaggtggactggttcttggagctgacttggttgcctcccactaactgtgtggacctggtgtacagcacccagtaatccctttttttttttcattcgctcccattttctaaatactattttgttgcgtattagttattttcacgtatattctgtgtgagtttttttccctggctagctgcctgagattaaggtgttttttttcagagatgttttcgcttcttatcagcgcagtactacctccgtcacaaaatacttatcgtttagagtttttttgtaacgtttaattatttatcttattcaaaagattatggaattattatttattttgtttgtgacttgctttattaacagaagtacgacttatttttttatatttacgcaacttttgaaataagataaataatcaaacgtttgcaactgtattaatagaaatgtgtaatgtgtagtactagtagtatttgttgtttttatttagttgcagctggcagcttaggacaaattgtaccttgaaggcttgatggctggcagggaatgaaaagtcatgaggtcttaagtccctatcatatcggatgtttgaaaattaattataaatattaaatgtagactattaataaaacccatccataatcttggactaatttgcgagacgaatctaatgagcctaattaatccatgattagcctatgtgatgctaccgtaaacattctctaattatagattaattaggcttaaaaaatttgtctcgtgaattagcttttatttatgtaattagttttgtaagtagtctatatttaatactctaaattagtgtctaaagacatggactaaagttaagtccctggatctaaacaccacctaaaggcttaaagcatgacagggcagggcaggccagatggagttaaattaaagccaaaacagatacggttgtgatagaatcatactagtagaaattagaagaggacgcatgcaaagcttgtatcatgtgacagtgagaagccaaacgcataggacacacaccaccaacatagcacaggtatgtaaacacaacgacaaatgctccattttagtaaggcgagcaggatcttaattcatcttacaaagaaaaaaaaaggaataagacagtgtcatgccactacaaaacactagtactaaaataaaacattagcaccaatcatcttctctctcttttgatctcttctctgaagtagtactagtagtacttcctccgtcctaaaatgaagctatttttgaggttggcacggatattaagaaagtatgtgagaatgattggaggaagtgtgtgattggttgaaaagagaaagtaggtgaagaagaatagttgtgattggttgagaggaggaggtaggtgaagaaatagctttattttgggacaagacactgtgctagaaatagctacattttggaacggagggagtagtaaataactagtgtagtttgaccatgtctattttgacgcgagaacacatctccaccgtcgatctctctgcccacgtgtcgtcccaggatgatctgcgccgctgaatagtaagtactacgtcaggacagtgaccctgcacttataattcactaaacgaaaaggaaaatgaaaaccaataatgattactggaggactacttagtttagaagatacgagaaatactcaagctaattaaccttggactgttctcaaaaaaaaaaattaagcttggaccacgtcagatgagagccggccgagcgtcgcgttatgtgctgcatgcttgcatagaccaagtcttcctagctagctaattcttcatttaacttaaatttgatgtaattttcacaatacatatgcaaactaactatctactactaataattaaaacgagcttgattgttactagtatatattcaatttatagtacatagtaattagctcgcggttgcactttctgtaattaaattaacactgggcgatcggcttcagctagctagctagaccaagtcacctgcaagctattagctcgagtactttccagtttcaattcaagtcatggatataattaacaacacatgtaacacggattagaaatcaagcaagctatctactccagggaaggcaggctgactcagatcataccaggtcagccaatcaacggccatgcatacatacatcagaataaatattcatgtgatcgcctagcttatggtttcaaatgacacaaagaatttaactcacgtgttcatcaagagaatgcagtttatacattccaacaaaattcatctttcacttcactcgacgagccggccggctgctgctatttagatagtgatgtttcgaaacagagcaacctctcatgactcatcagattcatgatattttctttttcaataatacaagaagaagtaattaagctgatgataaaaaaagatgagcacttacacgtgtctatgcaggtatgaactcaggtgactgtcaatcgacctccttgattccatcttataccatacatacattagctatgattgaacatatgatgatgagttccatgaatcaatggatcaatatatatcgatcgctaacgcgaaaacaacaagctaatgaccaggagaaaattaaattaaataagcaagtgaataattaatcgtgatatccctaagtagctaggtagtaattaattgtaatctttgtcaattgagacagatgctgctgcagtaatagacacgtcttttaccaagaacagccttgcgtgcatacacatcacaatacatcaccatctcctgggatgatcgatgtatacgtacgcactcaccaccactaagggccccttttatttgtagaaaaaatatatgaattttagaggatttcaatcctatggaaaaaaaaatcctatgaaagcctttgaaaggattgaattatatccaatcctttaaaatttctaagaaatgggtaatcctatgcacattttggagaaaagttagccagaggtctaaccacttggaacatttcctctgagcctatctctctcatctgattcttgcgtttttcctgtggtccaatcaaacggccattcatgtgtttttcctatgttttacaatcttctgttttaaaattgtattcctatcctgtgttttttctattactctgttttttcattcctacgattcaaatggacctaatttcagataggtaaagatggagtagtacttcctatatatttattactcactcggtttcatatataagatgctttaattttctctaagttaatttttctaagtttaatgagtttataaaaatataataattcttacaacaccaaattatatctattaaatataacacttaatatatttgatagtatctttgtttggtataaaaatattattatgtttttatataaatttaattgaatataaagaattttgacttaaaaaagatcaaatcaaagtgtagtacaacaaagagagagatagagtagtatgatcttattatggttgattcgcgtgtatggacggtcaggatcgagttatatatatccggccgggtggctgcattctggccatatggacgtcacagtcacggccgtcgcctctgatccgggtcaagcagaataataagaggagaaatgcagctggtcagccccagatgcacaactatactagctggttaattataattagtcagtctcccatgtaactggttaatcaacacg

SEQ ID NO: 1393 - DNA, 10858 bp, Oryza sativa
aaactgaatcagtacccatggaaaattgttacaatcaacagaaatatgtctttttggttctctctctgtgtgtgcgtgtggtttgtggggggtgatagaaatatattctgtaacaagacctaagttgatacaatatgcagagctgtccccactaacctttcattgcaacttttgcctgtgatatcgtcaatggcttgatcaagtgcatatagagctatcttcttaacctggtgatgcatattcacagggttcaattagatatgaatgtcaaaaggggagaaactataaaacatagtgctagagctatcacagttgtcaaattattcaaatatgtgtgcagaagagtatggaactgcggataaaaggattagctaacctctagtttatcttcattcaccctatgacccttcggaagcaagcgaaattcttctgtcagcctgatgcactcttgcacattttccggagaaacaaagtcaagtgcaacctttatacatgactgtccaataaaagggaaaaaaaaagcaggttggtaaaaagaataataccacagataagattggtccattttaattcaacacatggtattaacagcaatggtaatggacagttggaaactgcttccatgtctgtcatagcataccttcaaatttctgacttggtggggacatcctgctgggataaacacagcctcaccaagtttctgttcaaatgtccaaggctcaattcctgcatatgaaatgaacaatatatatcagtaagtgagaacaaattacaaaagacatcagtattttttactgaccatgttcttccttgagctttctcttgtgctcatttgttagataaaagcattgatcgtgaataggatgagaaacctgacaacatagggcagttgtgtgagatgagaaacatgacagatggcattccatggacaagtggtagaataactaattacctgtttgactgtttcataattataatgtctaaactcttctgcatgcttcatcagataatcatgcaatttgctgacatcttcacgtcggaagatatcccacaatgcaccaccctctgtctgatttccctcaacaaatgggtgatcatctttgggctcaatagatatggtaaatgtgttagtctccatgctggtttcgtttatttcccctgttgcactggaagagcaagcatcacgtcgcctactgcgtctttgacaatcagaagattcagatgatcctacaccatgagaagatttacatttatcttccctcccaaagccattgcccatctcctctcccccattaattgtgcagatagaatggtctgtttcccccttggagaaagtaatatccatattatgtgcatcactttgattgggtgattgcccattagacagactcaagtttccctcagcttcatcagctaccatatctgtatgaacacctccctggtccattacagcaacatttggtgctggctgcttaatgcttgagccattttcaagtcctcgagatcttggcacttcagttgattcactgagagctattgatgtatcatcgtcatggtctggtcgcagaacatgaagattcttgccatctttacgtaagctctctttctttttctctattgctgtaatcctttcagctttgagttctacctcatcagtatgcatgagaatattaacctgtttacgcaataggaaacatgtgattattactttattagtcaaaactgaacaaagtaaacaggtgtataacaaatggaaaggcctgaaatcaggaaaataacacgatgatacagctttttattaaaaaaaaaggaaaatcacacgatgatacagctttttattaaaaaaacacaatgatacagctggatactgtatgcatcagatacattttcataattaaaattaacgttccattggttttttcccatataattcatgacatggtcaaccaactatccagcattgtcagccaccgtagcaagaattaaactaaggagtgcagctttcagcagcaagtaacaagacaacacaagcaaatatcacataattctttttatagatgattctataaatttatgctgtgtttaataactagactagatgttagcattggtaatcaactataaagagaactgaaaaatcaaaaatctaaataagcaacttccaacatgccaacagaagaatatttgaagccaaaaacatgcaggtagaacccagtgccctgaggttgagcaagctttgtcctgcttggttcggtactagtacaaaaattgtccctttataacagggctcactcttaaactaggaaggagctaaatatagtagaataacttgcagacttgacatgactacaatctaaagttaaactaggaaatggcttctatatattcgatgctcgtactgtcactgtagttgtcttccagccactgttcaacggcacgagctaggctcatggggtgctgaaggtctgtaagattttacaactccacatcagtaggcaatgattggccgaggccagcagtgaacaagttgacttgctgttctttcagaagagatggtgaaacctggtacaagagagcaaagaatttttttggtactctgccactatcctagtatggtgtaatagagataattggttcaaggcattgctgtgcattggagagccatagtgcatgttgacaaagtcgcagttttttttccacaagaaaacgccttcatatcatttaaaactgcatatagcacttctgtgcctcgcccatcatgtggtctgacacaagccattccttccctcttcaagagatcacggtccttgaaaaattgctcgcaacgattaaaccatgggagtgggtcttctttgccatcaaatgctgagaaggtcaatttgtggtagaatagcgcaccacacgcatcttcatcctgccctagcactgatgccaagacattgctgctgcggctagtgctggttggaatgaggccatgagggccagggtatcatgctacagcccttgcatcacttgtgttcatggcatcctgcctagaaatgaggatataaatcttcttgcccaggtctgtaccccagctgtttgaagagctcttccagggctttggagttttatatggtggatggcagggatgggttggtcagagggctagggctgctggaggaggagattgctatgatacgaaataatgtagtaaagaggaggaagaaggtcaggaatagaaacacaggcaggtatgaaccagcactctcaggtcaagcagggttgtcctgctcagctagatgctcggttggcaaggatttagagttgggtgaagaccttcagctttattgactgattgctgctagtacaaaattggtcccttcatataacagggataactcttaaactacgaagaagcgagatatggacatatggtagtacaacatacaaacttgacctgaatactaggaaatagctactatatttgatatataaagactaggaatgtatatcctcccagactactgcaggaggccctgctaattttgagttcccagcagccccttcctttccatgtttacgtctccgatactttctatccataacatataatagcatccaaggatagcaatatgtacaatcaatatgaattaaaaggaaacaagattttaatccataaatctacatatacaaatgccagaaatcacaagaaattcacttatttaccgcatcagacatgtcgcaatggatcttcgtaacagaatcacctattcccaactcttgggcgacaccataagcaatgtatgtctttggaccaagatctggctttttaacatgttttggaagcttcactgccagattaaggggaccagattttggatctgtatactcacgaaatggtagtgcagacatgaactcagcaccatgccgcggcaggcgctcctcaaaggaactatgttgtggccaatctttaagcttaagtagcacaggcaaatcctccgaaccaacagctccacgggaatacccctcaaaaaacatgtgaatatttatatcaacctgcattatggttaaatgaaagcaatggtattaggaagttaccagtttgaaatataaagtagtttcaatggtgctgttgaaccccagatatgaaactggcaccaccaacacatcctggtggtacataaactaatatattgatatgtgaagttcataagttctaccactaccaggcacataagctgagctgacattaggtagatatacagttctttttcttttgttgtgtgtacattttcatggtatcagggattccactggcacatctacacacctcaagaaatcacgatgatcaatgtttcaactccacacgtttataattgtactcgtgtagattatgtgactgacaatccctagcatcagctctacaagaggcagcttattgcaattttattaacataatgttacttacctcaaaccatgtcagacaatcaagagctataactgagagccgttcatgctctttcttgtctctcttttcccgtaaggcccgccacataaccattggctcccagctcagtccagaagttagctcaagcacgtcacgaacaatgactggctgaccattcaaccaatgctgctgaaaatgatctaaagctccactttgaacttctctagcagttggacaatatatgtagttatcattggagtcctctctgcaagctgatttccgtgatgtttcattgttcacttcaccggattcagtgaagcaggaacatctagagcctcccaactcctgctctgtttccttattgaccactgaattgactttatccagtaaatcagaaataaagttctccttaaacaaacacctaagttcgagaagacaatccccgcaaccacctgcattaggtgggcatggtatgcttccgttgctttttgccctccatatcaaactaggagtgcaatcctctgaaggagctgcactacctatcaacctgtcattctgttgatcagaagccccttgacctacagcactgctatgactacttccctcttgcaaaccttccttgccttctatttcaggtacatcaacagctgtgtcacaagtgacaacagtaccagtagtaagaccttgacgcaactcctggcagcagctgaggcagagatcatagtgaccacttttacaacttctgtggaagtcaacaatggatgttctgcagttatcactgtttcaaataaaccaaaaaattagatagttcacacttgaaagaacatatagtccacatgctttacaaataaagcaataccaaccagtaaatccgctcatcattattaaactgagcttgaggaacctccaagtcagttacatcgatccctgttgcagaattaggattaggaaccaacaaaagaaacttagtgctaaaagggaaccgtgttaagctatgataatacctttaattgtggcctcaacacttttctctagcatctgctcttggtgaagttgtttcaaccaagggagcaaaaagcgtgcaatacgcagagagtatttaattttgttcttaccatcggcaaactccttgtcaccctgacaaacgcataacagaaaatatcaaacaaaatgaagcaatgaggccaggtaataaaatagaaacgggacaacaaaaaaaagaggtgtaccttatttattacatttgtccgcagacaagtcttacaattgcagttattgtgacaaactggacagcagttctcaaaatcgtcctctgttagatgcgggtacctgcttagatcatgccacagaaacaagcaacagatccatattagtagctaagatataaatgtaaatttgtgcatgaactaacataataagaactgaaagggtgacacaactaaggtgatcaacattgagtgcttttagaagggcacaaaccagcgtttgatgcacttgacacaatatctgtgcctcctgtttttttcagcaccattccggcacctcacaactcttccactgtccttcctttggcactgatggcacatggttgaagttccatccatcttttttgtgtgctgcaaatcaaggaaatcatgatataaggacttagcaatgaattactgacatacaactgcaaatacaccatagagaatatgctgtataaaagattgcaatttccaccttattctccttgtagtctaccgctggaacgttccgcctgtccctgagcttcctgggtgcaagttcagtcgaagagggatcagcaacaggacccttcctgcgctttcttgcggttctcgaggcctgagtctgccctgcgccattctcctggaaccaaaaagagatccatcacacattcggaacatggtaaatgtttgcatttccagtccccggcaggaaaagaaaacactaacctcaggagaagcctgcgtttcctcctccttgtttgtcttctcaccgttttcctgcaaccgcacccaataactggtcaagcatttcgtatgcaaaactacatattaagctcttcttaaaaagaagtggagggaaaattcagcgcaattgcagaggaactcttcagtgctgcacattccgtgagcaacccaggcttagaaatccaatagattggtagatatccaatgaaatttgacaactctgtagcttagacaagcaaaatcagggaaatggtcgattatccaaataacagtacactatgattgaagaaaagggagcaaaatccattatccattgcaagcgcgaaaaggaatccaaggatattgcccacttcacatccccgaccagaataacaaatacagaaagaaaggggaacaactcaaagcggcaaaactaacacaccgaaagcaaacatgaagcagccagtgttgctcggagatactagcacgaatccatccgctagggtttaaacgtcccaacatcccctcgacgacaacggcgcgaagaagacgcagcacatcatagcaactccccgggttttccgaggcgttgcccgaaggaacgagagagaaaataaaaaaaaacgagacctaatcgaagcagcttcgcttcggttaccttggcggcggcgtcctccggggccttgcgcggcctcccgccaccgcgcttcctcttgggcggcatccccggctagaccccgcggcgaccggcggcgaggtcggcggcggagaaggaggaaatcaaatcaaattgcggcgcgggtcgggtcgggtcgggtcgatctgtgggcggaaggggattcggagtggaatggaagaggaaggatacatatgacacgacggagcccacgatgtgtgcgttagggcccactggtcagtgaccgtggagggctccggtgggccaggatggtaagcttctgggcccagtttcagcgagagctggagtaggggatgtatggcccactcatcggagaatcgtggccgcgcacgtgtgccgaggagtgtactaggaatggtttgtttatgtttttggttttcgcgggctgtggtgcgacgtgtgagtttgaatcgagcggcggttggtgaaaaggaaaattcgaggtaaaaaaaaaagggactgtctatctgtctcagtcgacagaaaatttggtgtctaatctgttgtttttttatcataagatttcgatcaaagagtctcagatttttcacagaaatactttaaaaaatatatatataatcttattcatgacccattggatacaataaaagcccaaaacaaaaagaagcccaaaattaaaacatgagccaaatccaatattacaaccacatcaaaactgacagagagaattcacgtgaccacattgcctattgaagaaaacttgagaaccaagaagatgctctgcataggcacgtgatctgatcattaaagcaaaaaaagcaactttgcttccaaagagaaaaatcagagcaatagatcgaacaaggaagaagaagatggaggtggaggagaagattgcaaaaaaacgaaggatttagaatctgcaaacaaaattcaagatctgaggaatatgaaatcaacaggtactgaatcttgttctgaacttcctaattcttgaaatcaacactcttctaattcttgttctgaatcttctgaacttccttctttgaatcttgaaaaaaataactcacaaatgactcaagttcatgggattcctgtgaagaggcaaaaaattgcattaatccatcagtcctctatactggcgtatgtaaaagaagcataaaatagcacaacactatatacacagtacttcataactcatttgacaattgatagaatcttcatatgaatctacaatagcacaacactttagactattgacaaaatcttcatatgaatctacaatagaactatcaaataatagacagaatttcatcactcatttgacaatcaaatatgttagttacaggattgcactgttggtattttaactaaattcttgtggacttaagatctctattcatattgcatatcaatttattgggaacaaattcagaaattaataggaaaagtcaatcatagcaaattttaatttaattatagttcaactaccatcaacctcctaactcaaagctttcaaacaaaggagcaaaggttcacatataaaatgactaggaaaacacaactacaaaattcaaaaaaaaaatcgcatggcccctgatacatatcagcaagcaacacacaatgactataagaaaacaatcacatggccctgatacatatcagcaagcaacattcaaggatttactgtccagactgtagacttaaaaacttaacataatcaaaaatttgaaaacttatactctgcaaaattcgaatttacttcagactattaacataatcttcatatgaatccacaacataactttcacataatatacagtacttcataactcatttgagaatcaacaggttagatacagtattgcacttttttgttttcaactaacttcttgtggacttaagatctctattcatattgcatatcaatttattggaaacaaattcagaatttcataggaaaagaaaatcagaacaaattttaattatagttcaactaccatccatccactaactcaagctctcaaataaattattcagagatacaattgtcaatatatttgtactacaataagatagactgtatttgatggccttgattcacatcaccagcaacacacaaagactactgtatttaaggattattgtccagtttgaagacttaaaactttacataatcaaaaatttgaaaactcaaaacagaaatcattcagagaattcagaaaatagacaatttatttcatatgaactgattagaaggaatttcagaatatcatatgaaaactatatgagataaaaaattacaatacaagtcaaaatgaaatcatcaagtgtactcatcaagtgtactgataatatgttctttgttttgattgctaaatgtttgataattaagtgtactgaaatatacttatgctttgttttcacaggtttgacagatgagaatttgaaaggttttgttggaggtaagaacagacttatatgtttatataatttaatgaggttatgcatacaactgttcattaaaaaaaattactaatttttgaaaattctatgtatacagaaacagcgaaaaaacaacagttgattgacttggatttaaacaaaaaaatttcacaatcaggtgaaaaaacataaattttttatgttgtttatttcaatatgaaatcagaattataatcagaaaatctcattcaaacaggtttacaattaattgagcaaaattacaataggacaagatcatttataatagatgcaaagaaaagtagtacacgatcaagtactgcacagtcaggtaagaacggaaaaaaaacatttgtccatataaatttttatttcattgatatgtttaaattaacttagaaagaaaacatatgttgtgcaggtattttgaaggatttaagagagagagacaaaaacattgagaagaagacaatatcaaaagatgaaggtaattgaaaataaaattacataatttcttttgactaattgtattcagagtttggttttaaatttcataagaaacaaacatcagattaattcaatttttttaataaataaaggacttgggttactggagcaaaattataatacgatgagatcatatatgcttgaagatggcaaaggtgatacaaaaactggtaagaaacataaatttagaaccattaaataaattagaatttaacaataatctgtctattctattataatatgcaggaaacactcaaagagattcagaaattgacaagggaaagagaatagctgttatcgagaatgtaaaaacaatggaaaatgaaagaattcaatttgaagaagatatgttaggtatatatatttttgactacacagaatttgtttttttgtacatattttagattgttttattttttttcaggagaacaggatatgaactatgcagaagaaatacatcaaaccaatgttctatcactattggatcaagatttcattgatgtaattatacattgtcagatatcgtatatttgttttattttgatttggttttaatttaattaatatattttaagcaggataaatttacttcatacactagtctaatggaacatattatatcttcacaacctacaagatgcaatgatttggaggtaatttaacttgtactctattgaaaattagaatttcttcattttttttgaattgttttttaaaaactatttttattctttgcagaattcgatgtgagaaagcagcagcacaaatgttgacttcaattataatttggtgaatgaggtattaaaaaaatttattatttgaatatatcatttagaaaacattaagatt

SEQ ID NO: 1394 - DNA, 425 bp, Oryza sativa
ctaacctttgggagtcttgatgctacaaaggtatcagcacctgggcagccaaccgtcgaagagctgatagacatttatgatataaggcgcataggacctgatacaaaggttctcggtgttatagccaacccagtaaaacagagcaagagcccagttttgcacaatacatgtcttcaatctgttggatacaatgctgtttatcttccacttttggcagacaacattgctagatttcttagcacatattcgtctccggatttttcaggattcaggtactaatttcaaaaagtagaaataattactttactatttcttggaattggatggactaattttttctaggagttggatatactagatttaagtggtattgactctcaagggaccacatgaataaggattgttgtaattttttgataaatcat

SEQ ID NO: 1395 - DNA, 238 bp, Oryza sativa
tcgccgccgccgctctagcagcatcaaggcgcgcctccctcccgggccgtcgccgctgctcttcctcgccaagttcctccgcctccgccgctccatcttcgacctcggcccgctcctccgcgacctgcacgcgcgccacggccccgtcatctccatccgcctcttcggcaccaccctcgtcttcgtcgccgaccgccgcctcgcccaccgcgcactcgtccagggcggctccaccttc

SEQ ID NO: 1396 - DNA, 1387 bp, Oryza sativa
aggtgatgagaatattcccaaagtctagagttgtaaaaccacctaatgttgcccaattaagcggcgaagcatctacctaaaatcatactagtggtaccatgagtagagtgtccactagttggggttttgtttaatctagggtgaacaaggtaataatatcaataacaataataataaggtcataacaaaggtaaataggcatggctaaataaaacagtgataacgcgggaatttaagtaaagcgataatgcaataatttaaatcaacataattttataaactgggattcaatatgttcaaggatgatgtgacttgccatgctcgctttcccaaacgtcggcttcaacttccacaaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattctgagttcaaatggccaagttatggccatttgaagtttatatgctctttaaataaatatttgcgaatttcttcttttaaaatttaattttaaaagggtttattgcgtcagccgaggggagggggcgcgcggaccgggtccacgggagtggggcccacgcggcagcctcacggtccacggtggaccgggtgcactcgggctcacaccggccagcgccgtaggtcccacgcgtcagccgcacccgaaggcgcgggcggctgacggctgggccccacgcggcagccgctcggtgcgcccgaaggcggccacgtcggcgcggccggcgggaggcggcgcgcccgcgcccctatggtcgccagcggcggccatgggcacaacggagcggcggccgagagaggggagcgaaagggggaaacgaggcggcggttcacggctcaccctaggtcgacggcgacgacgaaaaggcagccggagcggaggaaggcggcagcacggctcgggtcgacggggacggcggcgctccggcggtcgacgagcgaaacggaggggtggacgaggtcggcgaggatgcggcgaagccgaaggaggcggcgccgaggtgggaggtggtctggggcgatgacggcggcagaccggagctcggcggcgacggcggagagagagagcgacggcgcgagctcgattccggcgagaggcggaaacggacggaggaggtgcgaggagggtttaaatagggtggaagggggagaaatcggccggcagggaaagaataagcgcgggaggtccggccgccaacaatggcgccggcgagatttgcgggagcaaaaccgcccgtttgaacgcgagagagaaagggaaaaatggggggaaagggagagggga

SEQ ID NO: 1397 - DNA, 26052 bp, Oryza sativa
tatggacgcaacccatgtgtagtccccaaacaatccttgggagcatccttctcatacatgaaagtggtgctggtcactgataaagcatcctcctcaaagatatgtggacgacttaggtcatcatcatctagctccaaagctgcagcaaactgtgccatagaggtcttgtactgctgcccctgaatggtccacttcacaaaatgaagtcccttcctggtagtgccgaagaaagcgatggagtagaattgaccaattacttcctcattccaggaatactgcaaggccaacagatctgccacatgcttgtgcacacacaccttgcgcacctcattgaataccaagttgttctttgaggacatgtactgccagtcaagccacttcatctctaccactggatgagatcttcccatgatcactgaattataccaatcaacctgcaccaaggtcctgaatctgtcatcctgagagtcaacaggcaatgtgtcaggactgaccatcctatcctttgcacactttagcagattcttcagatagttcaccctctgacgcctaagggtaggatcaaacaacctcttctggaaaaagctcaaaggatggctctcagtcccaggctcattctcattttcatcaatatctgattcaaaggcaactggagaggaggaacggggagcatcacgaatgacaatgctagcagccctcctagtttgaatcggaatttgactcccactgtaaaaatctccaaccttttctttgcccaatcttctcctaggaccacaaaccggggggtctcatgtcagcgggaacatcctgtgaaagcttctggcgcttctctcgagcatactgaccactgcaacaagaatcaataagtttggagtgcaatggttaaggaaaaataggtggaatcaaaggttgcaggctggctggattgagaccggaagttccggactcatgaacaccggaacttccggcctgcaaaactgaagaacagtggattcaaacaggctagtgcatgtgataaaatcctatagatcggcaatctacaaggtagcaggaacaattctatccaaaaggttttctccctaggttcacatatttagagatcgaggcaaaaacatgatgaaccaaaagagaagatcaaaaaggctaccttgagtgaggaaatcgcaaatcgatcgcgggaagaacctcctagccaccaatgtggttgattccacggagaggaatcaaatttccacggttggaagtgaaaatcgccgagaggagcactgtagcggcggctagggtttgggaatcggggaggagaagaagtgaggagagaggtgatagtctcgggctccccctgggtatttatacccccgacccccggaagttccggactggggtgaccggaacttctggcctaacagaacagagggcagtcaggcctaagttcaaaggaatagatgagaattcaacgattagaaatggaaacctatggacaaatagagacttatgatgcatatgaccagccaacaatcaacaaaacataacaatggtcaatacacatcacaagaggggaataaaaaccaaatttttgcaagaaaaacacacacaagaaattttcgcaaaattttcacaaaagagtttttggatataaggggaatgtttgagctttattcctggtatcaagaccatcttctacccaagaagtgatctcaagacacaaaagctctctttttttttaatttacattttagtgatacatgtttggctatgaattagccaaccacccatcacctaatgttgcgagaatctaagatattgagctcactcctaagctcgcaaaatcttttctcatctaaaggcttggtgaaaatgtcggctaattggctttcggttctcacatgggtaaggcatatgtctcctttagtctcatgatctctcaagaagtgatggtgaatatctatgtgcttggttcttgagtgttgaacgagattgttaggtattttgatggcactctcattgtcacataggagtggaatcttggagaagttgtagccaaaatcttttagggtttgtttcatccaaaggagttgggcacaacaagaaccagcggcaacatattcggcttcggtggtggataaggcaatggaattttgcttcttagaggaccaagaaacaagggaaggaattgacaagtcccgattgtgctttttctatcaactttacaccctgcataatccgaatcagaatagccaaaaagctcaaagtcacaatccttaggataccacaagccaagattaggagtatgaactaaatatcttagaattctcttgacggcaatcaaatggcactctttaggctccgcttgaaaatgggcacacatacaaacactaagcatgatgtcgggacgagatgcacataagtaaagcaaagatcctatcatggaccgatataccttttggtccacacttttaccattatcgtcgaggtctaggtggccattagtaggtatgggcgtcttgataggtttggcatcctccatcccaaacttcttgagtatgtctttcacgtacttagtttgagagatgaagatgccctcttgtgcttgcttcacttgtagcccgaggaagaaggtcaactcgcccatcatagacatctcgaacctttaagtcatgatactactaaattcttcacaaaaagaggcattagtagaaccaaatattatatcatcgacataaatttggcatatgaataaatcactcttaaattttttagtgaagagagtagtatccgcctttccaatttcaaaaccattttttaaaagaaaatcttggagacattcataccaagctctaggggcttgtttgagcccgtagagcgccttgtggagcttgtacacatggtttggcaactttggatcctcgaaccctggtggttgctccacatagaccaactccgagataggtccattgagaaaggcactcttgacatccatttggaacaatctgaaattatggtgagcagcataggctaaaagaattcttattgactcaaggcgagcgacaggtgcgaaggtttcaccaaaatcaagaccctcaacttgggtgaacccttgcgcaactaaccgggctttgtttcttacaaccaccccatgttcttctttcttgttgcgaaaaatctacttggtgcccatgacgtccatacttggttgcgagtgaagttattcaactcctcttgcatacccatctcccaatccggatcaccaagcgcatcttccaccctggttggttccaaagaagagacaaacgagtagtattgacaaaaacttgtgacacgagagcgagtagttaccccttgtcttatgtcaccaagaatgttgtcgacgggatgatctctttggactatgtgatgtatccttggatggtgcactaaggggacatgagcctgatcagtatgctctaaagtgcccgcagcatcgatcccatccacttacgccgttggcacgtcttcactgtcactggtccggaggttccggactggataacccggaacttccgggcctggagatgtccggatgttccggtcaataggacccggaacttccggctctcaataggacccggaacttccggctcagcagacacagcacttgtagggctattggatgtcgatgacggaggttgatccctatcttcttgttcatcctacgtctcgacttgtcgtatgtctccaatagccttggtacctatagcttgacttggatccacatcacctacaacatgtacaacaacttgctctccttgggagccattagattcatcaaatgtcacatccctagtgacttcaacaataccagaggttttgttgaagacacgataggcatatgcatttgattcatagccaagtaagaatccctcatccaccttaggtgagaacttagatgagcgagacctcttactcaaaataaagcatttgctcccaaagacacgaaaatatgaaacattaggcttcttaccactcaagagctcatatgaagttttctttaggatcttgtggaggtaaaagcggttgatggcatgacatgcggtactcacggccttcgcccaaaagacatccgaagtcttgtactcatcaagcattgcccttgcggcttcaatgagggtttgattcttcctttcaacaatgccattttggggaggatcatagggggcggagaactcgtgcttgattccttcttcatcaagaaattcttcacttgagtgttcttgaattctccaccattgtcgcttcgcaccttcttgatagtaagatcatagaggttttgggcttgctttgcgaaacgcttgaagacatcttgagcttcgcttttgtcatggagaaagtacacccaagtgaagcgtgaaaaatcatcaacaatgacaaaaccatacttgttacctccaatgcttatgtaggccatgggcccaaataagtccatatgaagaagctcgagtggtcgtttgtagtcatgatgttcttgataggatgtggacttccaacttgcttcccggcttgacaagcactacacacacgatcgttctcaaaagaaacattagatagaccaaggatgtgttccccttttagaagagatgccaaattcctcattccaacatgggctagcctacggtgccatagccaacccatagaggatttagcaatcaagcatgcctccagattcactctatccacgtcgaaatcaatgagatagaggtcaccttttaacacacccttgaatgctatggatgagtcatctcacctaaaaacggttacatccacatcggtaaacaagcaattaaatcctaacttacacaattgagaaacggataataaattgtagcttaaagaattgacaaggaggacattagatagagattgattcttggaaatggcaatcttaccgagacccattacctttcccttaccatcatctctgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaataaacagtagcggactagcgggcctacggctccatcttcacaggcgctcaactagggtataagccaggactccacctacgacatcttctccaaagcttctcttactgaagggggggaaagattgagcaagaatgagtacaaccaccgtactcagcaagccacaccggagatgcataattaatgcaagggagtacaaggggataataatataggggttaagttttgcagtaaacagcatttaaaagtcacttagttgcttaaagctactttgtaaacacggtcctagagctatacaatattattaatcaaggccgtgaacccacatgaacctgccttaacccaaggcctacgatgattcagaccgaactggcaacccgaccctgggtcccagctcgtcccaagccaacccaggccaaccattccacattttagttattacgcaggttttaagaatttaaaacactaacttgggtacattgctcggcttgcccataaccgagggcgcgactattcgaatagattatactctgatcagaggtgtacatctttacccacaagacacatcttcctcacgtgtggccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactcagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaagataataataacaatagcaataataataaggtcataacaaaggtaaataggcatggctaaataaaacagtgataacgcgggaatttaaataaagcgataatgcaataatttaaatcaacataattttataaactgggattcaatatgttcaaggatgatgtgacttgccttgctcagagagaacggccttccgaaccttcggcgacgaccacgaaccacgcttcgggaacctcaggaacgacagaagctacgtgaagcacacaagcaaagctacaagcctataaagaagcaataacaatgcataaaaagaaagcacagggttctttaggttataacaaacattaggagacttgaacgggtcgattcggagttcgtatgaccaagatatgatcatccgaagtttaatgctgttacatggagatttgcggattattataattaggttttgcaactataaaacatgtgtaagcgctagcctggaaaagataggaaggctgcgccgttgacatgcggaccccacatgtcaacctaaaggaccgcggtagaccgagtacacagagacggtccacgggtcgacagaagcagatcccgtgtgtcaaccgaggcgagtggccgacaaacggactccactagacaccacacgggctgcacacgtggaaaccacgcggctaccgagcgggcacactaacacggtcaccacacgcacaagcgaacgactaccgacaccggtacacgggtaccggggtcgacaaccgcacaacgggcacgggcgacaccgaaaggacgaggacggggcagcgagaggagagatccttaccaccacgcgacgaggcgagggaacgacaacgacgaacgggcgcggcggagacggacggcgagggaacgacttcagcggcgatccttggacgaaggcgagacgcggccgacacaaggcttgacgacgcggagccgaggacgaagacgacgacggggcggcagcgacacacttgacggacgcggacgacggacgagaacggcttgacggagggacgaacgccacgacgaccgggaacgacgagaggacgacgacaggaaccggcgaggaggcgatgagggcagccggcagcagctgcacagagacgaggacggcgcggaacacgccgctacgatgatgacgagggtggcggcgcagcgagacgacgagccggcgaggacgaacgaccgatcggaggagtcgtcaacgaggacgaacggagacgacgacgatggaccgcggaggggttcggtcgaaggggaggcgaggccgagggcgaccttgccgctgcgatgccggaggtggagacggcgacgtcggccggcgcactggcacggcgaaaggggctgccggagtgggtgccgacgagaccgagggagaggcggcgcgcgcgacggcgttccgacgaaatacgggcgacgccgtggcttggccggggaagaggatggcgttccggtgccgggagaggtggtggcgacgtcggccggcgcacaggggacgcggcagaggcggccggaagcggaacagtggcggcaacgccactgttgccggcggggatgcacttccggaggtcttcgcgggaaacagagggcaggccggcgaagaggaggcggctgcgacgctggaggaggcgacggcacggccggccggcgtgctaacgcggcggcaggggcggctgaagacggccggcggcacgggagagaggggacgacggcggggaggtggctagggaccacgggagatcgcgggagggggctaaaacgatagaacggagcgaggggattccgttttatagcggagggaagcgagccgagcacgggaggagcggggaacggcggcggaaatggcggccggcggccatggaaggcagccgaggaaggcgcgggcgttcccgacgattgggggcacgaatcaagggggaaattagggggaattgaagaggaaggaaaggggattaattcccccttatcaattttggaattcccggtttgaatcgcgtggatttaggggaggaatcgacgctaggtttcacgggagagagaagagagagagaggatgccgggcgggaggaaggagacgaccgggtgggtgggacccactggtcaggcgcgcgtcgtcagcgcgcgcacgtgcgcggcacgggcgggagggcgccggtcggcttgggccgggcggccggcccaggaggagaggagggggaggcggcctgggggagagagggaggaggagggagtgggccgaggggaaggagaggaggcccaagagaaggagggagaggaggagagggagaggaatagagggaggaagagaggactttggccgcaggccgagagagagagagggaggttttgggccagacttggcccaaagggaggagggggattatttttaggttttctttttaataaactttgataattgttgttgttgtttaataaatatttccggtgctctgaaaattcaagtaaaatttgagggctccttttagaccaaggagaatttaacaaaaattctccgaaccacattcgaatttttcttgtacgtattttagtgtttgccaatttcttttcgaattttaattaattctattattccttttagaaaatgatttttatttcgggatgaatttatcaggacgtgacaatctccaaagacaatattttcacgacttccaccttcctcatcaagacttgtaaacatactcctctctcccgtcatatgattggtgcagccactgtccacaacccaacttgaaccaccggaggagtacgcctacaaaaaaaatcaagcttgggatttaggaacccaaacttgtctaagtttgggtcccttgatgttagttaccaaagcctttggcacccacacacaagtgcggtactcatcattgtaattcccattaaaataagcaaccaccttgccctctgaatttttggaaattacatatgaatcatagtaaagaccctctggccggaacttcctggtattatacccggaacttctggtcatccccttcggcctatcagaagcccggaacttcctgtcaaaatgtccggaacttcctgtcttacagggcaggaacttccggtcattttgtctggaactttcggttgtctgaccaatgaaggaatgagtcacctcacttgcttgtggagctttaccttctctcacaaacatcaagaattctttcccatttaccatcacatggttagacacaggacttccatgtcgcgaccgagaaattttgcattttcccgaacgctagtgtattaattcccgtcccaggaaaagccggggtacaccaaacaaacatgatacaaaaggcacatctttattatatcgataatatttacattattacaaaggcacttcaagtctgacaataaaaaataaacagcagcggactagcgggcctacggctccatcatcacaggcgctcaactggggtataagctaggactccacctaagacttcttctccaaagcttctctattgaaggggggaaacattgagcaagaatgagtacaaccacagtactcagcaagccacaccagaagatgcatgattaatgcaagggggtacaaggggataataatagggattaagttttgcagtaaacaacatttaaaagacttttagttgctcagggccattttgtaaacacgatcctagaactacacaatgttattaaataaggccgtgaacccacacgaacctgccttaacccaaggcctacgatgattcagaccgaactggcaaccaaacccaggtcccagctcgtcccaagccaacccaggccaaccattccaaattttagttgttaagcaggttttaagaatttaaaacactaacttgggtacattgctaggcttgcccataaccgagggcgcggctattcgaatagatttactctgatcagaggtgtacatctttacccacaagacacatcttcctcacgtgtaaccacgtgccacataccaccacggcatacggacgaaagacgtgatatagttcccaacccatcctagccataaacaagagtaccgacccaaccccgcctacggccggaacccccgagacaggtaggcagtagggatgaaaacggagcggatagtttccgtccgctccggacaaaaacggatacggatacctttcggatcggataattctcggatagttcggatatggatacgaatacagatattttctcccggatatgaatacgaatatggtaccagggtttccgtcggatacggataataattcggatatccggtgaacagtgctattcggatatccgcaggacccatgagacataccccatttctttctaactctataaccttcaatatacctttatagattttaatagtagtttatctcttaacactagtccatactattaatattatttaaattttaaaaaatatttataaattataccttattttatataaaatgagctaattatatatgttgatatttgtttccattagaagttgagttggttttcgtgttccaagaaaaatttgtttccgtattcaggtccgatcatattcgattcttattcgtattcgagataatccgtatttgtttccgtattcgagctatccgtattcgttttcgtatccggtaaaaaatatgaaaacgaatatggtatgagcattatccgtccgtatccgctccgttttcatccctagtaggcaggattgagcccctagcagcaggacaccagccctgtgccatgacatctcgactaccgggccacagctcgtgtagccttcatttgtcctagagatgtccatcgacccccgacttcgtccatctccatccgtgtacctttgtttataaccagactgagccacaaactaagccttacccactagacatgtggaagtacggtagtgcttcgcaacagaggcccgagcttaatccttatattggccggggtgctacttcccacaactggcatgcacccaaaccccaccggaaaacaggttttaggggttttgaaagaggaagagaggtgtatgtccaattccaccataagccaaccattctatagtgtccaagtgatatgagaattcccaaagtctaaagttataaaaccacctaatgttgcctaattaatcagcagagcatctacctaagttcatactagtggaaccatgaatagagtacccactagttggggttttattttcctagggtgaacaaggtgataataacaatagcaataataataatagtcataacaaaggtaaataggcatggctaaataaaacagtgataacgtgggaatttaaataaagcgataatgcattaatttaaatcaaaataattttataaactgggattcaatatgctcaaggatgatgtgacttgctttgctcagagacaagggccttccgaaccttcggcgatgaccacgacccacgcttcaaaaacctccggaacgacagaagctacgcgaagcacacaagcaaagctacaagcctataaagaagtaataacaatacataaaaagaaagcacagggttctttaggttataacaaacattaggagacttgaacgggttgattcagagttcgtatgaccaagacatggtcatccgaagtttaatgctattatatggagatttgcggattattataattaggttttgcaactataaaacatgtgtaagcgctagcctagaaaagacaggaaggctgcgctgttgacatgcggaccccacatgtcaatctaagggaccacggcagaccgggtacacagagacggtccacggttcgacggaagcggaccccgtgtgtcaaccgaggcgagtggccgacaaacggactccactagacaccacgcgggctgcacacgtggaaaccacgtggctaccgagcgggcacactaacacggtcaccatacgcacacacgaacgactatcgacaccggtacacgggtaccagggtcgacaaccgcacaacgggcacggggtgacacaaaaagaacgaggacggggcagcgaaggagagatccttaccaccacgcgacgaggcgtgggaacgactacggcgaacgggtggcagagacgaacgggaacgacggagacgatggcgaggggacgacttcggcggcgatccttggacgatgacgagacgcggccggcacaaggcttgacgacgcggagccgaggacgaagacgacgacggggctgctgcacacttgacgaaacgcgggcggcgaacgcgaacggcttgacggagggacgaatgccacgacgaggaggaaggaggaagacgacgaccggcggggaggcaatgatggcagccggcagcagctgcatggaggcgaggacggcgtgggacacgccgcagcgatgcccacgacggtggtggcgcagcgtgtcgacgagccggcgaggaggaacgaccgaccggaggagtcgtcgaggaggacgaacggagacgacgataacgaacaccggcggggttcagatgaaggggaggcgaggccgagggcaaccttgatgctgcaatgtcgaaggaggagatggcgacgtcggccagcgcacgggcacggtggaaggggctgccggaggcgatgtcgactaggaggaaggagaggctggcgcggcggcggcggtctccggacgaagacgggcagcggtcggggtggagggtgacgccgtggagacggggaaggagacgacgatgacggctgccgcaccgatgaggaacagtagccggccggaggtgggaaggtactaaacaccgacaaggagaccgctccggcgagcttcgggcgaggaggaggtgaggccggagatgagggcagcgtcgcggatgtcgcgaccgagaaaattgcattttcccgaacgctagtgtattattccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaaggctgtgaaccctcacgaacctgccttaacccaaggcctacgatgatccagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttaattctagggtgaacaaggtaataatatcaataacaataataataaggtcataacaaaggtaaataggcatggctaaataaaacagtgataacgcgggaatttaagtaaagcgataatgcaataatttaaatcaacataattttataaactgggattcaatatgttcaaggatgatgtgacttgccttgctcgctttcccaaacgtcagcttcaacttccacgaagagcggatcttccgaagctgcagcgtctacacgaccaacggaaaagaaacggcttttactctactaaactccatataacaagcagaaacaaagcacaaaaatgcgttcttgacttcttaaggaaaaattagagacttgaacggtccaattccgagttcaaatggccaagttatggccatttgaaggttatatgctctttaaatggatatttgcgaatttcttcatttaaaatttaatttaaaatcggatttattgcgtcagccgaggggaggaacgcgcggaccgggtccacgggagtggggcccacgcggcagcctcatggtccacggtggaccgggcgcacgcgggctcgcactggccggcgccgtgggtcccacacgtcagccgcacccgagggcgcgggcggctgacgcccgggccccacatggcaaccgctcggtgcgcccgaaggcggccacacaggcacttcggcggaagacggcagcggccataggcacggcgtatcggcggccgatagagaggagggaaagggggtaacgaagcggcggtccacggctccccccggtttgacggcgacatcggaatcgccgaccggaacgaagaaagccgccggctcggctcgggtgtacggggtcgccggtgctccggcggtcggcgaccgaaacggagaggtggacgaggtcggcgaggatgcggcgaagccgaaggagccggcgccgaggtgggaggtggtctggggcaacgacggcggcggaccggagctcagcggcgacggcggagagagagagcgacggcgcgagctcgattccggcgggaagaaaggccggcgagtggcgaaaacggtggtggggagctcggggagggtttaaatagggttggaagggggagagagcggccggcggggaaggaataggtgcgggagacccggccaccattaatggcgccggcgaggttaggggagaggtttccaaacgaatccgagggagagagggagggaaaaatggggggaaagggggaggggatcccggggaataattcccccactttattgcgcgcggggacggcgggaggcggcgggattcgcggcggcggcggcgctagggcgcgggcgaggcggcgggagcagcgggaggaagggaatgacgggtgggccccacccgtcagcgagggtggcgggcgggcccgcccgtcagcggcgcgcgcgcggggaggagaccggttgggccgcgggggagaggagggagggggaaggagatgggccgcgccggcccaagagggagagggagggaaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagagaatgatttttattttgggttgaatttatcaggacgtgacagcggagccgagggacgcgacggcacggccgaccgacgctcacgcgcgggcgcacaggcggctggaggcggccggcgcgggggaaagagaagggcgacgacagggaggggtgatacgaccacggggaggctcgggatgaggctaaaacgatagaacggaaggagggggttccattttataggcgcggggtgggagccggcaatgagagaggccggaacggaggcgggaatggcggccggcggccatggaaagcggccgggtttggcgcgtccgttcctggcgattgggggcacgattccagggggaaaatgggggaaatcaaagaggaatcaatggggattaattccccctatgtaatttggaaagagccggcttgaatggggtggatttggaggaggaacaacgctagggttcacgggagagagaggaaggaggccggcggctagaggtcggggacgcgcctgacaggcgggacccacgcgggaggcgcacggtcaacgcgcggcaacaacgcgcacgcgcgcgcacatgcgcggcacgggtgggaggcgcggctcggcttgggccgggcgaagccgaggcggcccaggaggagaagaggagggagtgggccgggaggggaaggggaggccaagagaaggagggagagaaggagagggagagaaagagagggaggaagagaggactttggccgcgggccgagggagagagagagggaagactttgggccagacttggcccaaaggaggaaggaggatttatttttagtttttatttttagtaaactttgttaattgttgttgttgcttaataaatatttttggtgctctgaaaatttaagtaaaatttgagggcaccttttagaccaaggagaatttaacaaaaattctccggaccacattcgaatttttcttgtacgtattttaatgtttgccaatttcttttcgaattttaattaattctattattccttttagagaatgatttttattttgggatgaatttatcaggacgtgacattccacccgaaaacccgagcccgtgtccatccttgttaggatgagcggtgatggtcttgtaaagggcatcttttgaatggtaagtcttcatgcatccatatttcaccaatgtacccaacctttcattctctttcttaagagcttgcatagcatcaacattagtagcataagaggtcaaatcaatattgtaacacctagcacaaccattactagtagatggattggaagaattagaaaccacatttggttgagaggtgctactccaaagagtgtctaattgaacttcaagatctttatgacttttgtctaaaatagcaaatttttcttgaagagtttcattgacatccctaaggctagctaaagaaccattagccaaattaagctcattagctagttgttcatttttagcacattctttagctaatctctcctctaaggcaatgtttcttttcttttcaagaataagcaattcttcttgcctttcgagtgattgttctttactatccaaagctctcattaatttagccaagtgttacatagcgggtttgctaaagctcttaagcacatcatctaattcattatcactttcttcatcactagaatcatcatcaagagaagtgtgagaaggcttttgagtcatcaccttgcggccttgggccatgaagcatgagtagtggtaggagtcgtcgtcgtcatcactcaagttgttgaagagacactctttgcttgaagaggatgacttgaaggcgacggtagcaataccaccctctccttcaatcttgtcttttggcttgggtttgggcttgtcctcggaagcttcttcatcttcggagtaccacacctccaccatgtgtgccttcaccacatgagcacgctccggcttcttcttgtctcctttagccttagcttcatttgttttggggcaatcggcaatgaagtggccatattcgccacaattgaagcaagctctctctgattgcctctttcccttgtcatcatccttccttcctttgccatagccactcttgagaagaaagtgcttgaatctcttgacaataagagccatctcttcatcttcactttcttcacaacttgactcttcttcttgttttgcgttcaaagccacttcttgatttttgatcatggcggcattcttcaccatttgcctcacttcacgagcttcctcttcttgcatctcatgagacacaattcttccaagaatgtcacttggggtgagcctcttgaagtctttcctctcacgtatcattgatacaagagtgggatttcttggaccaaatgcacggagaagtctcttgaccacaaagtgatttgtcatgtcctcactcccaaatcctttaatcttgttgacaaggatcatcatcctatcatacatctcttgaggtgtctccttgtcatccatcacaaatcttccaagccttccttccaacaattcaatcttgtcctcacgaacggcgggtgatccctcatgagccaattgcaaagtatcccatatctctttggcctcctcaagaccatcaaacttattgaactccttcggactcaaggcggagagaattgtattggaagcttgagcattgcggtggatgagttgctcttgctccgaagtgagctccatgtcatcattgggtacatcaatacctgtacaaacaactttccaaatacttggatgcaaagagattagatgcaacttcatcttgtgcttccaagcggcataatgtgtcccatcaaaatgaggtgcacgcccggaaggcacggagacaaagttatgaggaggaacattaagtttgatgtaatcaaagtgaatagtagctccctttgatccagtctccttggtgctagaagcgtctcccttctcctccaaatattcgtctccctctagatgcgacatcgtggatcacttcaagcggtgaagcttgaatcaagagcaacctgctctgataccaattgaacgtgctgatgaagcctggggggggtgaataggctgtccctgaaaactcaaaaacaaatcgcaacggtaaaattcaagcagacccggaacttcctggtaaggaacaccggaacttcctgtgttcttaggacaggaacttccgggtaatggaacaaagacgaaattcaaatttcgaaataggagactaagccaatcttaacaagatgatgcacaggtattctaagcagaagatagatcacagaatcatccacagaaacatcacagaaagagacaagagtgattttttcccgaagttcggatcttgcgatcctactctctgttgaggagctccaaagagctgggtctcaattaaccccttgcctcagttgtgcaaaaacccagaggaaatccacagccttcaaccctaaacacccctaggcaaatttctagaattgagtgaccaccaagatccaactcaacctacatctagaaattcgccacaagtgtaggttgctctacttggaaaacctctagaatctcagcacaagaacttcattaacttacctcgttccctttcggaggagaggagatcgttcacaaacttacccgggacatccacaatatgcaacggattctcgcgggcgacacctaaccgtctaggagatcatctccaagagtaataagcaccgagatgacagcccacgagatattcaagtgctcacccaagatcctagtcttcacacatattcaaatctgcttctctcactctcaatctctctttctcacaagaattaggctcaagattgagtggagaaggcaagaaacacttgggagaggctagcaacagctctagggatgaaaagtgaaagtggaatggccaagaaataagctggaaacaagttggttatgtataacggctaggtgacgtcatctagccgttactcacaattttgaactggaagctagacaggaagttccggacctggaagacaggaacttccggacaacactttaggaaaatctttcaccagaccggaacttccggacctggaagacaggaagttctggactcgctatgctggacagatggagtatttgcaaaaataactcctagggaaacttgtcacttaggtcacactaagagcacttgacatatctcagagaaccacatggaacccctcttaatagtacggtttttcctaaaactcgattgcaataaatatactatcctatgcactcctcgagttccggttcgctttgattttatacttttttggggggtgtccaagcatcttatcttccacaccttggactaatgcacctgagagtagctcaataaactcattagtcccttaaccacatttatcattaatcaccaaaacccactagggggattaatgcactttcacctatgtagttcatgggaaacacatggcgatcagatagcaccaatcaaaataatagtcccgttccttaagaattactacatccgtttcaggttataaggctttctagcattgcccacattcatatagatgttaatgaatctaggcatacatatatgtctagattcattaacatatatatgaatgtgggcaatgctagaaagtcttataatatgaaatggaggaagtactccatagagaatctcacagtccgatttttgctgttgagcagcttcaagcctccataagtaagaaacatgtgctactaattgatgatgccacagatgttgagggatactattaggagagtgaattcacatctaatagaaggctttacatgtactgatgcagaaggttatgtactctataggaattatactgaattaggaagaacaacaagtcttttaagagagagaggctaaatataacgaatactactttctttttttaacgaaagactgcaaaaacagtatccaaatttaggtagttcagtaaatcacaaaacaaaatatagcaatgggcaagaatcatcatacgactcgtaagacaaggaagattattgccataacctagccgaatgctttggtgaccacctctcgccgaaggagactggggtagaggcggaggagagcgacacgtccatgaggcttcaaacaacttgtccgctcttgctcctcgagccgatgatgccgcaccgatggcggcggcgctacagcgaccgtgaggaaggggctaggggctgctgctgctagaggtgtgtatgggtcgatccattgcagatttgtgggccacaatgacaccgacttagctccccgcaaaaaaaaaaaatgacaccgacttagcttggaccatttccggatcggcccatatgattttgtgtcgtggttttggcagaagacggcttggcccgttcaggatcaggaggagcccaagaaagatgaaagcccaccataaggcccataaccgaggaaactatggtctgtttgttagagctcaactcctaaatttagctccaacggttgagtctggagtgaagttgtagagctgcctaaacccagctgcacttctttaattcattttgtgagagcgttccacccagcttcgctcccattttaggtggagctaaaattgtttagctaagctggagctggaactgtgccaaacaggccctatatatatgtgcaaatcatctaaactaaaaccctcctagcctcgacagcgattcgggggcagcgtggctatttcccgtgctatccatgttgcccccgatgctccacgctgctggatttcagctagtgggaggttgcctcgactccggtagttttgcaaaaacacccttgatattattgataatttgtattcttacattgttgtgctgtggattcttacatttaggcccttaaagacttgaaatatcttataccaaggccccgctcgatgtggggttttgtagatagattttggttgtacgagaaacctcattagcacatgattatttaagcattaattattataaatttggaaaatggatttatttgtttttttataaccacttacatatagaaactttttatcaaaaacacaccattcaacagtttgagaagtgtgctaacggaaaacgaggaagttgaagtttggagttgagaaaaagaattgggcccaagaagagaaaaacagaaaataggattgcgcttcaaataacagcaagtgagaggtctttttgtaaaaacgaacaaccctaccgcccggcgctcgtccccaccacgattgattgccctgccctgcccttcccctctcctctctcgctctctcccctaccctcgcgacgggtgcatcttgtcttgccctcccccttgcccgcttcttcccatccgttgccgcctctcttttgctcttgtagccagcctgcacatccccttctcttaggaggtcaactgccagcaaggagtcagaggtggagcgtcgccatagtcccttaggttgacggcggaggaggcaacgacgacgacagcggtctgatgccgcaaggtaggggaagagcaaatcgggaggagacaggagacatggtgcctagatccggagaagagggtccatattaaggccggcggcggagggggtcatcagagatggccggggtcggagatgttcacgtcggtgttgttgcccgtgatgaagaggcccgcagccaacccgagcgccagtgtctcaccagcatctgaccgagtgccacccgctattggctgaggtggccatcagctggtggagcgagaaaatggacatttggccactttcaaaactgggtttcgctattatgccatcctcaaaacgtgattcgataaaataccatttttgagctcgcgttacttgccaaagtgccatttttgctgttttattcatttccaaaacgaatttcgctcggttgtggggtgatgagatggaaatgccttgttgacaggtaggaccccgggcttgttatccccttgcagcgagctcaatctttgtattgtacagcaaggaatggaaacaaagaattgtggactgccgcggaacatctcatcgatggtgatgatgatgcctatggccagcggcgtgcctaggcggggtcggccacgaggctgaacacatcgtccctggccgactccttccgtcggacctacgcgcatggcgttcctgcgtgaccacgcttctcctccagccgcggccgcatgcgccgcatgaaatcgaactctcccggcagtgactgcgatcatgggcgcgtgcggcggaccaccaaggccgacggcttagtcggacccactaataactacatccacaacgaggcggcggcgatgcaatgcctgcatgggagatgccttcgtcttcggcgacggcgaggcgatgcctgcgttggatctccggcccggcgctccgcctcttgtaccgccccaacggctcgcaacatccctttgccctctccgtctgcaccagcctcggcccgctcggatcccccacacgcgcgccgttcgccatctccaccgagttcaacctcctctgctccaacctgcccgttttctccctcctcttcaagcctgcatcggcgacttctcgctcgccaaatgcgatgaccacaatggccacagggcgcggcaaatgtggccgccgcggggaagagcggttgtggggtcaacgcactgttgtccgggatgtgcctcacgacctggagcgtgctgccgttgtggagcaaggcgagcctacggttccagtgggggctgcaggtgctgccggagctgaaggctgccctcgcggatgatgggtaccgttggtgagtaactttgaggagttcttgccagtaaacgaggcctcgcggcggcagagcgagtccatggcggcggtgacccgcgctctagctcaccagcagctgctgcctcctctccagctccacgaacctggcgctcaccgcgtccccctccgcctcttccgccgacaaggccatggggcccacctcgaaactctagccgccgccgccgccatcgaccccacgggcctatgagataactcgggcggcggtgttgtgtgccgtgctccccgcgcttgagacacaccgcatgggaaatttcgtctcatcaccaaacagaggagcaaaaatgatttcgaaattatacaaaatggccaaaatggtaaaatgacggtgagcacgtgctccatattgacattttaacgaaatgcgtttttgagatggtattctagcgaaaccatgttttgaacgtggctaaatgtccattttctctggaagagcagaggttgacagatccaagcagcgtgaccacgccagtcgccaccgagctccgtgcttagcttcctcaccaccagcaagccccacgtcgacattcagtcccctcgagctgttagctgcatcgtcagatctgtggactgtcaccagcgcggacgttagcccctctcttggttgcctcctcgccgtcgtcgacgcgcactgagcagctgtgctctatctcctacgccgatcatgcatggcaggtgcagaagcacaaactaggaggttctatgggaagtgggaactcacgcggaccatggcaatgacacagtcgctgcaatattcaaccgcaactccttggacgcgcgactatgactctttttagatgggactaaaactttactatcacatcggatgtttgatactaattataaatattaaacataggctattaataaaacccatccataatcttggactaattcgcgagacgaatctattgagcctaattaattcatgattagtctatgtgatgctacagtaaacatgcgctaattatggattaattagacttaaaaattttttcacgcgaattagctttcatttatgtaattagttttataagtagtctatatttaatactccaaattcaaccaatacgatagggactaaagtttagtccctggatccaaacgctacctacgtctcaggcgcccgatccgggggtggaaaaatcggacgcccacgtcaccatgcaaaactactttcaactattttttctcttaaattatttatccaaatcatgatccgattacaccattaaattcgttgtaattaaatctttgaaacaagatctgttgatgcgaaaacacgaggcttgggagatctgcttaactccagtgcaggtccaaaagcttgcctttaggttcgtgagcgtgccagttgatttgatcctgcaatcaacaagaaagaaaagcaaagaaaccgcggttaaatccataaacgatagccgatcggctagttgctgatgatatatcatttacctttgagccgatgtcatatgtgaatcgatcgacaatcatgaataagtgagaaggaactaaatctactcgatcggccgtagatattaacaatatataatccttatgtcgatatatacttaaatcaagtgattgggatagatcggtcgccatgccgagacaatataaatcacttagatcgaaatatatattaacaacaagactatacatatgttcatagcatggccgatcaaatagatctagcatgtatcggctaatactccgatactactctatatttgtcacgtcccaaaacgactctaaaatacatcctctaaattatgcctagaataattaaaatccgtgtgaaagcctccaacaactaaaatgtgcaaagttaaaagtcaaataaggcttggaggatttttgtatatttcctaaaagcctaaaatgcgtaaataaattttagtggaattttcagagcacaaataataattattaagaaataaacaaagttgaaaaggttttataaaaaagaaaagctttaaaaaa

SEQ ID NO: 1398 - DNA, 10485 bp, Oryza sativa
tgggacccagggtcgggttgccagttcggtctgaatcatcgtaggccttgggttaaggcaggttcgtgtgggttcacggccttgattaataatatggtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttctgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacaatattaggatgttaaagcaagtaaaatatatcaaacaaaagcttaacatattcaagtgcaacaaaatcttaatgtaaagggcggatttaaaatgtcaatcaagcatatagaatataaagtagttaaatcaggtaagatcggctgaaaccccgatgctaccctaatcggcaatcagaaagcaggctagagattaagattctaatcatgacttataaggtcaaactcaattgatacagctataagtatgaaaaaaggacaatatctagacaatcaagccgctgaatgtttcattgagtggtagatatcttatataatctaagtcaacgtcgatattgaacctaatcggctgccttctgttgacagacgtttgccgattgaaggttagatagcgatattgctatgtaagatatatgataactcgacgaattacataaacaagattagagtatcataaagatggaagcactaataccgagaacacaagccgccaaaacaagttttacttctagttgaagatcaaaaccgatgcagctcaacccaaaagcaagaactcatcaaaacaaaacgaaagtaaaagggtggcgatacgccgagattgtattgaacgtgtgttagattgattacatggggctcggggtctatttatacctgagattacaaaacatgtccatatcggacacgactcttatctctatcaaactctaagatactataagtctttacggcagacttttgcccaaacatatctctaaggaatttacataaaatatcctaattaatagatacaattgtcttcccaggactctatccatgcgcggcaatcctcatgaagcatattaatcttaacccgacaacatataccacgtcatattgtcggatctgactcgatcggctaacttcatccgactcgaactctgccgatcccagtcgtagccgattcggactccagccgatcctttctctgtttccgggacaatctccatctcgaattccgcttcgattccatcttcatctccgatacttggattaccaaatttggttgttaacaagaccacacatgaatatattctgacgaatttttttaagcttattattgaattatttttaaatgttgcacgatgttccaccaagtatatcggaattgtttcactaagtagatcgaaaatatttcaatcgtttaaattgacgctgtttcaccttatataaaaacaatgttttagcaaatagcgaaagaatgtttcaattcactgcaacatttgatctatatatagtgaaatattataagtacactaggtaaaatatttttggtagaacaaaaaatgaaacaaattcccttaatagagggtttccataatatgtaggtgatttgttgtaaaaaaatgtttcgattcactgcaacattagatctatacatagtgaaacattgtgagtacactaggtgaaacatttttttggaaaaaaatgaaacggattctcttaatagagggtttctaaaatatgtgggtgatttgttgtaatggcgtgtgtgatggggacacatggcaggtgtgcaggacgacacgcgtgtcaaggggggagcgtccgatttttttctcctcccggacgcccaatttgcaacattatcccaacttctccattgcaattttagacgaacagagaaattgcatctagatcaggcgtgtaaagttttggcgtgtcacatcacattattatatacgctgtcccatgaggagttcgggcactaataaaaaactaattaccctctcagttaagaaacccggagataaatttattaagcctaattaaaccatcattagtacatgtttactgtagccccccattgtcaaatcatgaagcaattacgcttaaaagatttttttcgcaaagtaggcgcaactatgccattaattattttttaagcttatatttaatacttcatacaggtgtttaaacatgtttaaacgttcgatgtgacagggtgtaaaattttgagccagcatctaagtgtttcccattgattggtgtcaggcaaggcaatgcagctagatgagaatgcattagatggctaggcaagacagccgcatcgatacactaggtgatgcccggaccacgtatcgcgcgcgggcacattattggtcacagtattaaatttataataaaccatggcaataataatttttaagtaccaaaagaaaattacatatcgagtcataaatctttgtataaaaaattatactatgaagcaatataccactattgaagtgcgaaaagttatttaagtttagtcagtaaatcttgagatatcctcatgtatcttgaaaattacaatttctttcggaatatgatatgcaatctagagggtctagaaggtatgaatatgtttctgcagatataccacctggcataagagcaagaagggcacattcgtcaactgctgaacaaagatccctacatacttcctccgtcctaaaaaaaaaaaaggcgaaccttaggtttgcgtgtccaacgtttgaccgttcgtcttatataaaatttttttatgattaatattttcattgttgttagatgataaagcatgattaatactttatgcgtgacttacctttttaaattttttttcatattttttcaaataaaacaaacggtgaaacgttggacacgtaaaccaaaggtttgccttttttttttgcgacggagggagtaggtctatgcctaaagcacctacattaccaaaagaaagcacacaatgtttacccagaggaggttgactatcattctacaacctcaggaaaggacataggatggaaaacagcaacagggcttggcatgatgccaatgtcaaattcctctgcaaaaggacacatacttcagtaacttcaatagcaaggattacatgacgtaataatttaaaaatgatatggtgaatagtaggaattcattagataataagaactatgaaatgataaaaacttttagtatcaggaatacatgcacaataatagacaatacatggagtatccagttcagatattatatccatgattggagtcaaagaatttaacagagtgaagagttggtgataatcaaataaaatgaatttccagaaacatgttctccctttttttttcttttaacctgaagaaacatgatttctgttcggaaataaactgccattcacaatacacctgacaatctgttcaggaggaaaaatatattttagtagggtatttgtagaatgaatctacatgtcatatcataatacagcactaaaacatgtataggtatagctagtaatctaaaggtgtaaattaccaaagggctaaaatatgtaggaaagactcaccaaaggacacgtgaaccgaaagcatgataaaacaaagcgagtacagtaaagttggcaaacaccctgcggatgcatgatttggtagaaacagaatattacattagacaggatgggtatgttgcctgacttgcctaatatctctgaaatgtattttcagcaagcaatcaagtaaataaaatcatattttgttcaaaatgacaccatatacagcttgctaccatattcatgaagccttgatttcagaattcagtaagtaataacacaacaatggtttagcaagaaaaaaatattaccatgcatgctagaagagaccatatggacatgaaatatgattttactgctaaattatggtttgtcttcatggagctgcacagatcaatataatttgttaacatataaaatgaatcattttagtgtatggggcacgtagagtaagacttcaacttctagactggatttcgcaggcaggaaagaatatgcatctctcgaacaacacaacacccatacgcatctcttgcccgtgtcatataaagaaggaaaaatcaaaactacaaatccatgttagggagcaggttttcagtacgtagaaacataagctatcatatatatttttttacagaggagaagaagcataattacctgagaacctggcaagtccaataaaaaatccaacaatacgacgatctgcagggctgtaaaacagagaggatccctcaattattttaaataacccctaataaaaagttaacaatttcaaatcgagcagagcagtaaaaaaacataagcattagcctagaagttaattaccagaatacttgcttagtcaaattataaattgtacgaacatggtgatctgcagggctggaaaagaaaagaggatcacataattaatgtaaagaaccccaaataaaaaatgcatatatttctgatctaaaccatggcgacacaataaaaagtgtctccgtgtgcgctcgccggtgtccgtaggcctctccttacatgtgtcctcgacgaaatcgctggctgccgaagttctgaccgcatcgtctcccccaaaatcgtcgggctgccggcaaccaggtcattacctggcgtgtgcgcaaacacgaaggatgagaagtacaacttcaaattgagacaaaccggcaagaagcaagacaagaagacaagtcatagaggtcaaaacctaacttgctacaattgtcacgaaaagagacatattggtaaaaattataccataggtaatactcctaagtttactattatttttgatgattatgtgcttaggaaaaataggcaagacaatgtatttgctagatatgttggtttacctagacttgcacctagaaggaggaccatttgggtgcctcgcaatttggtaactaacattgatggacctaattttgttggggaccaaaatatgctcaaatgagaatataggtacatgaaaggcattggtgttttggcctatgcgagaaaatgtgattctcaccaagttcaagaattggagccaataataaggatggagaattcacatcaaggaccaatgctatctcggtaacatgcttttggtttgaaaattcttttttatagctttgtgtagtttgcaatgcattctcataactctttccaaaattaaatctctctctcttataaaaatcatcatatatgcatgttgagcataataaatgtggcatatgaagctataggtttgatcatattcatgtatcatatttttctcgtgttgcttttgtgcttattatcaagcatatttgatcttagctcgatcttgtgtttattttcctatctttattgagttgaagggaatatcacattaagggaaagttgtcgcgcccggaaaaataccttttccagaacgctagtgtattaatccccgtcccaggaaaagccggggtacaccacacaaacatgatataaaagacacatctttattatatcgataatatttaaattattacaaaggcactccaggcctgacaaacaaaaataaacagcagcggactagcgggcctacggctccatcttcactggcgctcaattagggtataagccaggactccacctagttcttcttctccaaagcttctcttagtgaagcggggggagatagagcaagaatgagtacaaccaccgtactcagcaagccacaccggcagatgcatgattaatgcaagggggtacaaggggataataataggggttagattttgcagtaaacagcatttgaaagacacttagttgctcaaagctattttacaagcacgatcctaggaatacacaatatcattaatcaaggccatgaacccacacgaacctgccttaacccaaggcctatgatgattcagaccgaactggcaaccagacccaggtcccagctcgtcccaagccaacccaggccaaccattccacattttagttgttaagcaagttttaagaagtaaaccactaacttgggtacattgctaggcttgcccataaccgagggcgcgactattcgaatagattatactctgatcagaggtgtacatctttacccacaagactcatctttactccgcattccacggccgtggaacccgttgtaaagaatgtgtcataacccctttacccatcctagccgtgacaaaagcaccgagccaaccccgcctacggccggaacccccaagacaggtaggcaggattgagcccctagcagcagaacaccggccctgtgccatgacatctcgactaccgagccgcagcccgtgtagccttcatttgccatagagatgtccatcgagccctgacttcgtccatctccatccgtgtactcttgccaggactagactgagcaccgagttaagccttacctattagacatgtggttagtacagtagtgctttgcaacagaggcccgaagaccggtccttatagtggtcgaggtgctactagcagaaccatgcacctcgagcccagcctaaaaccattttgagagttttgaatagaggggggaggagtgtgttcaattccatcacaagccaaccattccataatgtccaaatgacatgagaactcccaaagtctaaagttataaaaccacctaatgttgcctaattaatcagcgaagcatctacctaaattcatactagtggaaccatgaatagagtacccactagttggggttttgttttcctatggtgaacgaggtgataataacaattgcaatgataaggctataacacggattaataggaagtgctaaataaaacagtgataccgcgggaatttaaataaaacggtaatgcaataatttaaattaaaataattttataaactgggattaaatatgctcaaggatgatgtgacttgccttgctcagagagaacggccttccgaaccttcggcgacgaccacgaaccgcacttcgggaacctccggaatgacggaagctacgcgaagcacacaagcaaagctacaagcctataaagaagcaataacaatacataaaaaaaagcacagggttttttaggttataacaaacattaagagacttgaacgggtcaattcggaattcatatgaccaaggcatggtcatccgaagtttaatgctgttatatggagatttgtggattattataattaggctttgcaactataaaacatgtgtaagcgctagcctggaaaagacaggaaggctgcgctgttgacatgcggaccccacatgtcaacctaagggaccacggtagaccgagtacacagagacggtccacgggtcaatggaagcggaccccgtgtgtcaaccgaggcaagtggccgacaaacggacttcactagacaccacgcgggctgcacacgtgaaaaccacgcggctaccgagcgggcacactagcacggtcaccacacgcacacacaaacgactaccgacaccggtacacgggtaccggggtcgacaaccgcacaacgggcatgggcgacactgaaaggatgaggacgggggcagcgagggagaaacccttaccaccacgcgacgaggcgtgggaacgaggacgacgaacgggcgcggcggagacggctcggggacgacggaggcgaacggcgagggaacgacttcggcagcgatccttggacgaaagcgagacacggccggcgcaacgcttgacgacgcggagccgaggatgaagacgatgaaggggctgcagcaacttgacgaaacgcaggcgacgaacgaacgtggcttgacggagtgacgaacgccacgacgaccgaaaacgacgggaggacgacgaccggaaccggcgaggaggcgacgagggcagccggcagcagctgcacggatgcgaggacggcacggaacacgtcgctgcgaggatgacgacggtggcggcgcagtgagacgacgagccaggtgaccgacgggacgttgacgacgaggacgaacggtgacgacgacgacggacagcgaaggggttcggatggaggggaggtgatgctgaggacgatgtcaccggctcgccgctgcgatgccggaggtggtggtggcgcggccgacggcgcacgggtggaggaagggccgaccggggaaattccggtgaggcggatggagaggccagcgtggcacgacggtgttccggcgaaattcaggcgatgccgtggcctggtcggggaagaggacggcgttcctgtgcctggagaggtagtggcgacgtcggccggcgcacaggagacgcggcagaggcggccgaaggcggaacagtggcggcaatgccactgttgccggtggggatgcacttccggaggtctccgcgggaaacggagggcaggccggtgcaggagaggcgactgtgacgccgggggaggcgacggcacggccggccggcgtgctgacgcggcggcaggggcagctggagtcggccggcggcatgggagagagagaagggtggcggggagaggaggtgaggccacggggtagctcgggaggaggctaaatcgatagaacggaggaaggggattccattttataggtgaggggagggagccggccatgggagaggcggggaacgatggcggaatttgtggccggcggccatggaaggtggccggggttggctcgtccgttcccggcgattgggggcgccattcaagggggaaattggggagaattgaagaggaaggaatgagaattaattcccccccaatcaatttcgggaaccccggtttgaatcgcgtggattttggggaggattggcgctagggtttgcacgggagagagagaggaaggaggccgagcgggaggaggacgactcgggggtgggacccacgcggtcaggcgcgcggtcagtgcacgcacgtgcgcggcacgggcgggagggcgccgctcggcttgggcccggaggcggcccaggtgggatggggcggggagacttgggccgagaggaaaaaagaacggagggcaggcccaagagagagagagggagagaaggagataaggtgaggaggaagggaggactttggccgcgggccgagggagagagagagggaggactttgggccagacttggcctaaagggaggagggggattatttttttggaaaaagtcgacttagactcccttaattgtaggccgaatctaattcgtacccctcaactagaaaaccggatagaacgaccccacgaacaattgaaaccagtgcaatttgactccctcaccggttttggggggtggttttgctgacatggcgctgatgtggcggtgttgacccggtcttcgtcccacatggcgcttgcgtgggattagaattaaaaaaatatctgtgagacccatatgtcattcacaaaaaaatacatagttggacccactaacatgtggggcccatgtcacgaccggaattaacccgacgggcgttccttacatgcgtgtattattccttgtcccaggaggcaaggtacaccaaaagttgatacatttcaaagtttatcaagcggaagcgtaaatagttaatttattacatgggcggcgaaggcccagcacacacaaaaacaaacgggaaacagcggaagactagggcgacgaccacaggcgcttgacggcaggcacgagctagacaccaaagccttcatgttccaggggctcctcttctgggtttgggaaaaattgagcaagactgagtacaaccactgtactcaacaagacacacccacaagtgcaggataaatgcaagggagtacaagggggttataatataaagggttagggtttgcagtaaacagcattaaaagacacttagttgcacaaagctattttgtaaacacgattccagagctatacaatatttttaatcaagaccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgcttggcttgcccataaccgagggcgcggctattcgaatagattatactctgatcagaggtgtacatctttaccctcaagacac

SEQ ID NO: 1399 - DNA, 23889 bp, Oryza sativa
  unsure (1)..(23889): unsure at all n locations
agtgtccagttgatgagaatattcccaaagtctagagttgtaaaaccacctaatgttgcccaattaaccaacaaagcatctacctaaaatcatactagtggtaccatgagtagagtgtccactaattggggttttgtttaatctaaggtgaacaaggtaataatatcaataacaataataataaggtcataacaaaggtaaataggcatggctaaataaaacagtgataacgcaagaatttaagtaaagcgataatgcaataatttaaatcaacataattttaaaaactgggattcaatatgttcaaggatgatgtgacttgccatgctcgctttcccaaacgtcagcttcaacttccacaaagagcggatcttccgaagctgcagcgtctacacgaccaacggaaaagaaaaggcttttactctaataaactccatataacaagcaggaacaaagcacaaaaatggattcttgaattcttaaggaaaaatttgagacttgaacggtccaattctgagttcaatggcgccggcgagatttgcgggagcaaatccgcccgtttgaacgcgagagagagagggggaaaaaatggggggaaagggagaggggatcacggggagtgatttcccccactttattgcacgcggggacggcgggaggcggcgggattcgcagcggcggcggcgctagggcgcggacgaggcggcgggagcggcggtaggaaggggatgacgggtgggccccatccgtcagcgagggtggcgggcgggcctgcccgtcagcggcgcgcgcgcggggagaggccggatgggccttggggagaggagagggagggggagggagatgtgccgagccggcccaagagggagagggagagaaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacgttttaattgttggaggctttcacacggattttaattattctaggcataatttagaggatgtattttagagtcgttttgggacatgacaaacctaccccccttaaacggaatctcgaccccgagattcggaagaactggcgaagagatcgggatgggctgctttcatctcgtcttcacgctaccaagtagcttcttcctcagcgtggttgctccattggaccttgcaaaaacggattacccggttcctggtcctgcgctccatggtgtccaggattttcactggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttccccgcgtcgagcaatgatacggaaaggacccacaaaccgaggtgcgagcttccctttcgtctgaaacctgtgtacacctcgcaatggcgtgacccgaaggtacacaaaatcgtccactgcgaattccagattacagcgtcggttatctgcataactcttctgccgggactgtgccacctttagattatcccgaatggttctgactttagcttcagcttctctcaggatatcagtcccgaacacttggctttccccaacttggtcccacaatagtggtgtccggcatttgcgtccatacaacgcttcatagggtgccatttgtatgctggcttgatagctgttattgtaggagaactcggcataggggagactcttatcccaggtcttcccaaaatctaggacacatgcgcgaagcatatcttctaggatctgatttagacgctcggtctgtccatctgtctgcgggtgatacgcggtgctgaaatttaatcgggtacgcagctcttcttggagcttcttccaaaagtgagaggtgaattggcttcccctatcagatacaattttcttaggaacgccatggagactcacgatcctagcgaagtagagctcggctagtttgttccctccataggtggtcttcacaggaataaaccgagctaccttggttagtcggtccacaactacccatatagaattatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgctgcatactaacccaccagtatttctctttcaagtctaagtacatcttcgtactgccagggtggatggaataagggctttcgtgagcttcctgaagtttcaactgtttaagttctctgtcgtctggaacgcatacccgatttccgttccatagggttccgtgttcatcctctgtgaaaccagcggctttaccctgtttcatattcttgaggagtccacgcatatccggatcattcttctgagcctcgcggatttgatcgagcaaggtaggcttggcttccagcgtagccaagaatccacgaccaactatgcttaggttcagggcttccatctgttgattaagttcgggtggaatgccacggacgtcaagagtgttgcaatggctttttcgacttagagcgttagcgaccacgttggccttaccaggatgatagtgaattcccacatcataatccttgatgagttctaaccatctcctctgccgaagattcagatccgactgagtgaagatgtatttcaaactcttatgatcagtatatatttcacagcgattcccaatgagatagtgccgccagatctttagagcatgaaccacagcggctaactccaaatcatgggtagggtagttgccttcatggggccgtagctggcgtgaggcataggctaccacatgaccttcctgcatgagcacgcaccccaatccttggcgcaaagcgtcacaatacaccatgaagtccttgcgagtatccggtaagattaaaactggcgaggaaaccagcttttccttgagagtttggaacgccttctcgcattgcgggctccacacaaatttctcttctttcttcaacaactgtgtcatgggtcgagcgattttggagaagttctcgatgaacctccgatagtatcctgccaaacccaagaagctgcgaatttgagtgactgtcttggattgcttccaaccagtgacggcggtcactgtttcggggtccacagcaactcctttagcagatatcacgtgccctaagaatttgacttcggacaaccagaactcacacttgctaagcttggcatacaattgatgttcccgcaactttcccaacaccagacggagatggtgctgatggtcttcctctgattgtgagtacaccagaatgtcgtcaatgaaaaccacaacaaacttatccaaatattccatgaacactttgttcattaagttcatgaagaaggtaggagcattggttaaaccgaacgacatcaccgtgaattcatacagtccgtatcgcgtggtgaatgcggtcttagggatatcttcttcacgaatacgcaattggtgatatccggaacgaagatcaatcttggagaatacagtggcacctttaagctaatcgaacagatcatcgatccggggaagagggtacttgtttttgatggtaacttcattgagagctctgtagtcaatgcacatcctctttgtcttgtcttccttctaaacaaaaatcacaggagcaccctagggggaagtactcggccgtatataccccttttctttcaactcttccaactgtttcttgacttcggccagttcatttgatgccatacggtagggtcgcttgtacaggggagtggttcctggagcaagatctatccggaactcaatctctcgcttcggcggcataccgggtagttcttccggaaacacgtctccgaactctctgacgatggggatttctgacagtcctatctgatgaagttcggaactaccgacagaggttgggggagcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaattccctgaatttctataggaacggcagggctataatactttgctgtcataacccctctaggggtggtgatgagcagagagttcctaagcctttctacccccaactgatttctccccacgaatggcacagatataaacgagtgggaagctccagagtcgaacaaaatggtagtagggatggaatgaatgaggaacgtaccaacgatgacgtttggagttgtcagcacatcctcggccgtcacgtggttcacccgaccccaaatgacatccttaccatcgttgttggggcggggaggcggttggccttgctggcgcctcggctttgggcatttatccgcaaagtgcccaggctcgaagcagttgaagcacagacgctgctgaccttgaacgtccctgcggccttgaccaggctgcacggctggcgtaggaggacggggcgcacgagtcccttgctgactctgctgttgctgcggctgtgggacgcgcaccacgaaatgaggtcggggcgcggagcgaggttgctgctgctgttgctgctgcgaggacgatccccctagatagggattggtgtagcggaccctttggttagccccctgttgattgcggaaattcgccaagcaacgcttgtgcgactccagtttcttgtgcttggcttccaagcggatgctcttgtcaaccaaacgctggaaatccggatagtccccggagaccagacgcatggacagctcagggtccattcctgccaagaacttctcttgcttctccttatcttcacgaacatcctccggggcgtatcgggccaggttgttaaactcatgcaaatactccatcacagagcggttgccttgtttcaactctcggaattcccttttcttaagggccatgacttcagcgggcacatgggttctccggaaagcggcggtgaagcgggcccaagtaaaaggctgcccttctggctgcgtagcctggaaatggtcccaccatagagatgcgggcccctgcaattggtgggcggcgaagatgactttctcctcatcgctgcactgcacggtgtctaactttttccccacggcatgcaaccaatccaatgcatccacggggttattggagctagagaaggtaggcggacggatgcggaggaactcgacgagtttagagtgttgtgggggcggtggtggagcattatgttgtggcggattttggatgtggtggaggaaagcaggcatcatgttggcctgctgggcgaggatttgggtgaggatggcgttggtgtctggtggtggtggtggaggcggaggaggaggtggaggtgggctgccatggttgttgtggttgctaccttcgggttgattgccatcaccggtattagcacgtctcctggtcgtcaccatctgaaaatcccacacagaactagcaaacagagagagctgacaattaaagctaaccacccacgactaccataattcttgaatttattactgctattaaattggttcattaaggttcaagttgcttaagcaaataaaataaggacaggctccgacacatttataccacacaccggcataaccatgccccatacgactctagcagaaaaacaaacgagaagaacacacacgcaagcctactaactgctggtctactgctccgacgggccagggcggaaggtgagcaacagcgcatccttcgtgctgccaacgccggaggctccatcctcctgaggaaccacgggcgcgggctcggcacgaggggtctcgacgaagcaggtccacgccagggactgacgaacaagctcgggcctggaggtactcttgcgggcggtgatcttcaggctgcggtagacgcgacggcgcttgaggcgacagacctctccctgggcgatcttgagctgacgcagctgcgcctccactgcgtctaggtccttctccagctgcagattctcctgacgcagctccaggatcttcatgttgttctcgaccaacccgcgacgcaccatctgatggaagtcgatacgggccgcgtcgtacacctccaccatgcgcgccaggtgcatgatggtagcgtcatcctccgagctagcatcccggaaggtggcgtagtcgcgggctcctccgcggcgagggtggtagcggtagggcgagtgctgcaactcgtccgggtagcgctggtgaagagtgccgatggcgaggagtgcggcgttctggcaagcggcggagaaggaatctccacccgcggtgactgccaacgaagtcctctcgggtgagccagtgaggatcactgcagtaacctcccaagcagcgtggggctctgcatcgtcaccctcctgctccgggagctgcttgccctggtagtctactccatgcggataccccaggacaacgcacatgccccgcagctccaaaacgaagccagtcaggtccagaccacgacggttgatgctgccggccatctacaaacaaaaaacaaaagagaaaagcaacattttaaagattagattttggcgataaatgaagcagcaggacagagagagactagaggattttcacaaataagaaaggatttttattttgaaaatattgctaaggcttgggatctacggctcgtcctagggtcaagggggctctgataccaacttgtaacaaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatgttccaggggctcctcttctgggtttggaaaaaattgagcaagactgagtacaaccactgtactcaacaagacacacccacaagtgcaggataaatgcaagggagtacaagggggttataatataaagggttagggtttgcagtaaacagcattaaaagacacttagttgcacaaagctattttgtaaacacgattccagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccagtccttatataccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaaccagcgaagcatctacctaaaatcatactagtggtaccatgagtagagtgtccactagttggggttttgtttattctaaggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggtttattgcgtcagccgaggggaaggggcgcgcggaccgggtccacgggagtggggcccacgcggcagcctcacggtccacggtggaccgggtgcacccgggctcacaccggccggcgccgtgggtcccacgcgtcaaccgcacctaagggcgcgggcggctgatggccgggccccacgcggcagccactcggcgcgcccgagggcggccaagccggcgcagccggcgggaggcggcgcccgcgcccctatggtcgccggcggcggccataggcacggcgaagcggcggctgagagaggggaagggaagggggaaaagaagcgacggtccacggctcaccctaggtcgacggcgacgacaaaaaaggcggccggagcggaggaaggcggtggcgcggctcgggtcgacggggtcgacggcgttccggcggtcggcgagcgaaacggaggggtggacgaggtcggcaaggatgcggcgaagccgaaggaggcggcgccgaggtgggagatggtctgaggcgacgacggcggcggaccggagctcggcggcgacggcggagagagggagcgacggcgcgagctcgattccggcggagagagagagcggcgagtggcggaaacggacggaggaggtgcggggagggtttaaatagagccagggcaagagagggtggccggggaagggaggaaaccggcgcgggaggtccggccgccatcaatggcgccggcgagatttgcgggggcaaatccgcccgtttgaacgcgagagagagagggaaaaatggggggaaagggagaggggatcacggggagtgatttccccctctttattgcacgcggggacggcgggaggcggcgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcggggagaggagagggagggggagggagatgggccgagccggcccaagagggagagggagagaaaggggactttttagagtttttctttttataaaatcattttaactttgtttatttcttaataattattatttgtgctctgaaaattccactaaaatttatttacgcattttaggcttttagaaaatatacaaaaatcctccaagccttatttgacttttaactttgcacattttaattgttggaggctttcacacagattttaattattctaggcataatttagaggatatattttagagtcgttttgggacgtgacaataaggaactcaacaaattatcctctgtgaggtgcccaatgcatttttgggcatttaatcttgctatgcgcagccgtatgtgacagaatgcactgaacattttccgcataatgcaatcacgatcttgtgctatagttcttttatgagaaaatccatgaaatgtcattgacaaacatcctaattccagaaatgccatcgacaaagacaacttcccaaatatgtcattgcacaagcctctttctcccaaaaatgctatcaccgtcaagtccacaccgttacatctgttaatttttttgataatgtctattttgccctcaatgcaatatatactccctattttcactgtcacaggaaaaattcaagggaaaaagaaccctaaccctacctatcgatcccgatccagcgaggaggcctggcggcggctcggcggtggtccacggcggcgccgccgctatgccagcagcccacgggggcggcgcgcaggggaggcctagggcggcgtcgcggagaggagtcctagggtggcggctcggcggtggtccacggcggcgccaccgctatgccggagacccacgggggcgtcgcgcaagtgaggcccaaggcggcggcggggcgaggaggcccacggcgcagcgaggaggcctgcgacgccgacgcggcagggagcagcgaggaggcccgcgacgctggcgtgacagggagcggcgaagaggcccgcggcagggagcggcgaggaggcccgcggcggcagcgcgacagggcgtgtcgatgcggttcacgacagtgcggtggtcgcaggttgcggcgcgggggccgtaggtgccggtgatgagggaaatttctgtgtgcttgttgtttcttgttgtccttgttatttctatgtgctttacttagaaattttaggtacccatgattcacaattgagctcagggggtgaatttagatgtctgtgaatttagatgtggacagaaatatgcatgaatgcaaaataattttgtgtgagcaaacattaccgaatgatgtgtgagcaaatggatgcctaagggtaagattgtcttttcatacaacttaacggagaggagttaacggcagttacgatgtgatggcatttttcggagaaagaggcttgtgcaatggcatttttgggaagttgtctttgtcgatggcatttcatggattttctcttcttttatgtgtgaaggagacggtaatttaccccctcctcacgtacaaattgtagttttagaattgtgattattgttgagaatataggctttgttcatatatgaaaaataacaaagctaaacttgttaccataacaaaagtaaaaagttatctcctcacatcacaaataattgtagttattgctcagaatataggctttggtcatatgaaaatggcaggcatagctattctgtactcactctgtttcatattactgctgaggaaatgaggtttttgttgctgacccagcaaaaaggctccctgtcgtcctcgcgcgggtgactgggggcgaaccctagcccccggccgccgccacacccctcctctccccggcctcgccgccgccggagcgcgtcgccggaaaccgtgcggccgcctcggcgcgaaggggcggcgcggagcttcgggaaggccgcggcggcggcgaggcgaggggcggcggatctggcgccgccaccaccggatccggtgcccagcatcggccacgaggcgagtggcggctggatccggcgtctccgctgccggatctaagccgtggtggtgcgagagcatggcggatgcggcgacgccggtggcgcgacggtcgtggctggtcggcggtggtgcggaagtgtggcgtcggccgggagacgcggcgttggtggcaagcgctacagccgggggcgcgggcggccgcagcaggcgcagtggcgcgacagccgtggctggccggcgggcggctgtggccagcagcgcgacatgacggccgtggctggctggcgacggcgaggccgccacggcagcgatagtgccggcgagctggcggatggtggcggggttgagttgggcgtctatggttctggtggtggtggtgacggcgtcatggtggttcaaggcacgcggggatggcgatggcggcggggatggcgtcagtcgagggcgcgaaggcggcatcattggtccctgcgcggcgacgtcgcggtgctcggcggtggcggcacctctcggctggatctggagggtggccggctatggtggtcggcgacagcgggcgacttgcgacggctggcgacggcagttggcgacggcagcgaggtggtcgcggcaattggcagcgacggcgtcggccaacgacgccggcgaaggaattggcggcagcatggcggagggcgacaacgaaaaggccgctggcagtggcggcggctcgcggaggcgctggctggtggccgcgacagcggtcaccggaggcatggcggcccttgacggctagccgagggcgtgggagacggctgcatttggccagcgcggcatcgtttggtagaagggtcggagaccggcttggcgcagagaggcgcagtcgatggcagtggaggccggctcgacgcgaaaaaggcgcgggcggcggagttggaggccggcttggcgcgagagccgcagccgatggagggaggccggattggcgcaagaggcgcgtccggtggaggaggccggattggcgcgagaggcgcggccggcggtggaggaggcgacctaggtgtgaggaggagctgccggtgggtgtcgcacggtcttcggcgcacgaaagctggccggcgggggacgccgatgcaggggtctcacatgtcggcagagcttgtgtggtggtggagcatcggtgtgtcagccgtgggtctcacccctcaagggtgattgccgagcaaaagcccagtcttggctcctttgagtcccgacggactgcgatggcggtttttccgtcgcttctcttcttgaagacgtcgttttggcatcccctaaggagcgatctcggctgtgtccctttattggtctagtggcggccggtcacgcttagcggcggccggtccggtgctagccttttcctgggcttgtgtgttggcgatgtcggtgtgtgggtggtggttttttttttctttttcctggttacaactctccagggttataatcttgtaattttttcctgctctatcaatagaacttcgcaccgtctcgtgcgagtcgttaaaaaaactcgcacgagacataaaacaaatataaatttaatgaaataatagtatttaatgacataaaacaaacataaaacaaatataagtttataaaaagtataatagtatttttgacataaaacaaatatattattaaaatatattcaatgttatatttaatgaaattaatttaacattttatatattgctaaattgttctataaatttgattaaatttaacaaagtttgattagaaaagagtcaaatgacttataatataaatctcggagggagtataacaaaacctttaacaatattacaatgactttcgcaaacgacaagtgacctgctgattgtttcgaggaaaattttttttgaacggaaattgtttcgaggaatttggtttttttggtccattcacatagcaaaatgtgatggcacagcaagctgcaccgatcagacaattaattaaccggttccgatgcgactcaaatcactcaactgcttgctcttctgcctccggacatgcgtgacaacgtactcatttataagttcgatgtaaccatactgaacattatatttgcagatgcaaagcttcaacatgactcagttcatcgagcaaacgtagctatttgaacgaaataatcaagaagcttacgaaaataactctagttagctgtgttctttgctcaagttaccaacctctcgccctcgtgtgttccgcgcacacgttttttaaactgttaaatggtgtatttttttacaaaaagtttctatacgaaagttgtttaaaacaatcaaattaatctattttttaaaaaaaattagctaatacttaattaatcacgcgctaatggatcgctccgtttttcatgcgtactgttttagttgggaacagagataacgaacacagccttaatcaacaattagaactgtggaatgatttacgggggaaattgggagtggagctagctgaccgcacataaagatgtgatgactcggaaaatgaatccaaatgggagattcacaaccagatccatactagtaatatatccgtgctaacactacgatccttaattttttttaataaatgactaaaattttgtgttagaaaaaataatcagtttaatgggatttttaattcaaattatgccatataattaaggcaaattacaatgtaggtacttcactgcacctattttcagtaattttcaattatacatattctgccatattgaacaatcagactactatcattcatggtaatgtaggttgatcctgcaatggaaacaaattattccacaacagacataacctcttgctttacttttgtgatttgtactaaacttaattacaaaatgggttctggaatagtttgatcctaatcactggtcatcaaccattgctatagacaagagttttcttcatcctcacatatcatcagataagaaaaggaccagcagtgttcttaaaaactccatttcagtgacacctaacaaaatacagaggaacaaatccttcttgtcggctagcaaccaagaactctacagactacagcaacattctgtgattgccgccataacccatgtggtaaatgtcaaccgaaagtaaacgaaaaaaattccagagaaaatattcaaacgtttgataaaaatagggaaaaaaaaagtagaactaatcaaccaacaaacccatatcttcttgtttgatattcatattctcttcctgctcagtcttgagacatcattttcagttttgacaagtaaaactaaaaaaatagaacatatcatgttcaggtgaaaacattgagaaaacgtgggcgatccattatctaaaattgcttattagcagtatcagaaacacgcaattcatccatcacattcagatatgcagcaaagaaatctcaatttcagatatgcagtatattgtagaaaagcggctcatttagcaagaaagaggcgcataataacaagagaaataaactaacaaaagatgagcatcaatcggatgcttttcctgatccccgatgcaactgagaaaaaaaaataggagccaaggatcgaggcttgtaagtttcatggattttgccaaaagtacggaataacggcagccagcaaatacaaataacaccataataaggtcatctagtcttccagcacaaaaaaatacacaagacactttggaccaatggcctgcgttgttcatccagacttcagagcatcagtatctcagaaataaaactcccgcttgcgaggaaatagaaatataccaatttgactaagaactagtatggttatatttttttttcacatagtaacatatatattttcacagaatataattatcatatattaaaatagcaacataattttaaattttgtactaacttagccgcaccaaccaatatgtaatattcatattgtattgtatatcacatgtaatattcatattgtattgtatatcacatgtaatattcatattgtattatatacatgatagttactaactacttttaaattttaaatttttgttatttctaaattggatttctgtatgtactctagactcctcttccaatatttcttcttttctaatttaaatgttctattatttaaaaaatttattcccatatggactctaaacctttctttcaataagtatttcttatttttaattctgaatttcaattatttttaaattgtattcctatataaactctagagtactcttccaatatttgtaaattatatttctataatgactctaaaatattattttaatatttttattttttaattccgaatattagttatttctaaattttattttttatggactctaactttagttctaaattttaattagttctacattgtatacatgtatggagtctagtcttatttttgaatattttatttttttaattaggaatttcagttatttttaaattatatttttatatggactccttttcaagttaaattctatatacctttggtctcaatattagattttctaaaaaaataattgtaatttcagattagtctgaattgtatttatacatagattcatcttgcaatagttagttatattttgaatttcaggttttttttttttacttttggactctaaacgatattaatgcattgtgaccggagtctgtttttatacttgtatagttgtatttccgtttccacacactaagtctgtttcttattgatgtttggcactttgacagtttccatgaatcggtgtccgattgctttactacttcttttcatattttcattcgattaacatatccttctccgcttgtcttttttatttttcttattttcttcgattaacgtggtaatttctagaccttgggagcgaacgtggtagctcctttttctattactttattaaggtaataaattgatacctatgagtattcaagtgtcaagaacattggctgatggaatgattgatatagtcatttggtcaccattatcaaacagtaaagcaatgtaaggtgtaagcaaaactcactgcactaactgaaggcctatttagatctcacctcgaaattttacaccctatcacatcgagcgtttgaacacatgcataaagtattaaatataggctaaaactaattgcacatattgcgactattttacgagacgaattttttaagcctaattgctccatgatttaataatgtagtgctacagtaaacatttgctaatgacggattaattgggcttaataaatttgtctcacggtttacttacggattctgtaattatttttttattagtgcccgaacacccacatgtgataccctataatatccgatgtgacacagcaaaactttacacccatggatacacccttgaattatgtatcggtgtttcaaggggaagaaatagatagcattcagagagttgtggcttgtcagcaaataccacaacaccatgatcagatcatctaaggcttctagcaaagaaaaacacaagacgctatggaccaattgtttgccttgggtttaaggcaaagtatgtgttaagtttattcagagcatcagggatctcagaagtaaactcctgcctacagggaaacagaaatttaacaatttcaactaagaattggtacccactacctactattcaacagccaagaacatcaacgtatggatcacagaatggtatggccgccaatatcataaagatacagtaaacatgacccattgcattactgtgaggtgcaagcaaaactcattgcattaactgaaaacaggaacagcaatacatggctcacctcgcatccatgacatcgtgcattgtgaccatgttatcctgctccccgtggatccctgatcgcacgcggtgcagctcctgcatatgcgcgccgacaccgagcaacaggccaaggtggacacagagcgtcctgacatacgtcccggcctcgcaggagatccagaacacggcaaggtgtcgctcggcatcgtgctcgagcagcttgctctcatagatagtcctcaccctgagctgccgcttcacggcggagatgagcgggaggcgctggaacatggcgcctgtgagcgcctcgagcgcgcgggcggtgtcggcggcgtggaagcgcgcgacgcagacgtactccttgccggcgccctgctgcgacttgacgaggcgggtggcgcggtcgacgcagacgatgaggttgccggtgaccttgggatcgagcgtgccgctgtgcccggtcttgttgacgcggaggaggcgcttgatccacgcgacgacccagcgccgatctaagcgaactcgcggcggacgggacgggtacgccgcgatgagcggatgaaggttgcggagggaggcgtgcgaaggaaaaggggcggcgactgatttgctggcgtgcgtgactttcggccggtgaccccgcgtgcgcaatctcgtactgggtgatcccgcgtgcgtgcactgtcgtcggatctcatgcgttagatgattttcgattgtttgatgtgtcacacgatgaatgataaatgatgaatgagtaaaacaacttgttaaactatagagtagatacagttatatagagctctgtcttttagaggtgtcgaggacagaagaattaattaaatattttgtgccttttaaaatcaatattttcagtggctagctagtatttaaaggcagaatcgaagctactaaacaacttaagacagatgaaccggtctggaagtcctaattgcaaagtatgtggagtatgtaaaacagtcctgcacattttgctttggtgttgtttagataaaaaaaagatttggagagagaaacgtctctccaaatattttttaaaaaagaaattatgagcgtgttgggactaaacaaggatctcagggtcgaaaccatacacctcttgccctttgccattacactatcaagtgcattttggtattgtttagataagtgctatgatgatcaagaacccctttcttctgggaggtttttttttttttgcaagaatatgtaggtgctcctgacaaagaacagaatcagactttgcccataagtaatgatcgggttctcaaaaacgagctggttaattcaagggctttgtttttctgtctggtttcagtttctgcgcgaggaggagcaagccggaagaagggcgttatgggagaagaaaccagaagaagatccaaagttggctggttgggaagatctggagttgatgaagctgtcctgttcttttcgtctgatgcttatttggatgtctggtagtgttccgggttgtatggctgtatggatagctggtaatcccaaccgtctgtagaagcagaaccaatttgtactctcgttataatttactcccttagttataggttataagatcttttgattttggtcaaaattaaactgctttaagtttaactaaatttatagataaatataataatatttacactagtaaattagttttattaaattaataattaaatatatttttatactaaatttatcttaggtaaaaatgttactatttttttctataaacttagttaaacttaaagtaatttgatatattataacctgagacgcttgatgtaaaactcctttccccctcccctcccctcccctcccctgtcaaaaaagaagaagaaagaaacaaatttgccagccgccccgccgatgagtatgagtgtatgactgttgccacgttgtctacggccatgactttttttttttaccgggacggccaaacgttagctgccctacgtatattaaggactaaggaggaagagggtattacaagttttacaaataggagaaagtgattttatccctcaaagaaatattctctcgtttcgtacataccacctaaatagttattaaaataattaaaaaacatttggcaacatagcttaatattaaatatatcactccacaaacatataattttaaattcaacttctacaagttgtaataaaaataacaaatatagctacgagtacaataactattttcagtttaatttgttttttttgttacaacttttagaagttgaatttgaatttggttttacatatttgtggagtgatatattccatattaatctatgttgtcgattttttaaattattttaataactatttagatgatatgtaaatgatgagaggatgttctctcaaacaataggaatccacatcgacattaaactgtcgagaaggaggaaacaaacaaactgccggacgggtaagccgcccgacaggtggagaaccctctagtctactctctcaaagatgcccgcttctttccaggtcatcagaatctcttccctgatcgcgttgcaaacctgctccgactttgatttttgctcggatatgctagcatttcgttctttccatataagacttgtttagttgaaaaaaaattctagatttagttatcacatcgaatatacgtacacatgtttaaagtattaacgtagtctaataataaaacaaattacagattccgccagaaaactacgagacaaatttattaagactaattaatctatcattagcaaatatttactttagcaccatattgtcaaatcatggcgcaattaaacttaaaagatttgtctcgcaatttacacgtaatatgtgtaattggttttttcctaaatttaatactctatgcatgtctaaatatttaatgtgatagcgtgaaaatttttgttttggtaactaaacatgcctaagcaaacaaaccaagacgcggagggagtcaaagcatcttttagctcgtctgaaaaacacctcgcgactgtaaccatcagttcgcgaattcagttccaccttcctctggcaacgggaatggcgttcagatccactctcttcgatcatgcgccaaactctgttcgtcaaagggcaagctagaagcaggtgctgacaggtttccggttctctgttgtagagaacgcaggttggcttgtgctcccaacctctcttttgcaagttatcggcagggagacagcggcccttggtagtgagcctgagccacatgaagaatttgattcttgacggtgctcgtgtctgccagatcagctcagcacaccagaattttatttatcagttttacttttagatcagtaataacgcgtatattcacaaattactttttatttgtaaatataccgaatgaaacgatgggtccgtaggatcttgtgtgcgccatgaagaacagctgataagccgatgccgcgttgtatctcccgtaggcagtgagcttccaattgatcgagtcatgctcttgttcacctatctgctacggccatgacttcactgtcgtcgactcgacggtgccgaccgccgccggcgaggcacgcatcgcatcttcacggctgcatatcggaggccacggcggcgggcggcggccacgaggtcatcggtgatttggtgtggagcggatcggccgccgagggcgagcagtagtgggctagtggctgctgccgttggctggggggtccttggggacggcttcgccagaaatttttatattttagtcctttataaaaacttttaaaataaacatctataaaacttatttctgtgaatagacgttttattgatgccagggttcaatgttccgaaattttgacatttttaccctttcacaaaacttattttataaataaagcttgataaaaactataataaaaaagtaggcctcagtgttaagattataggcgctgaggtatgtacatattaattacggaggatgaatgttttttcaaattcaattgagtagcctagtggttagttacttccctttataaccaaaggtggtgtgttcgaatcatatttcactttttttctatattttttttacttttcagttttcaccattttttttatcactgagcgttgctttttttttttaactagaccaagttacagaagtggattgttttcaatgtattgatgcgtggggcttaacaagcatggagcctgatgctttttataagttcagagcatcatcgtatggatcgggaaagcagaggttccacgatcacttgttaatcccaacctggatgggtggctcattgaataataccagcacacaggggcggacctaccactatggcatgccacaggtaaccttcgtcgcgaatactcccaccccagcttcccagaggtgtttttttatcgtgagtagcgtatggagcagcagacagctgtgtcgttggctgtagacacgcaaggaagaagacgaacagctccctttgctgtgttagtgggctgatatgggggtgtgagagataatgggctgtacatgataatgtgaccggttggctggcctatatgccaaagcccacttcttatttttccattaacaattccctaatccccaattccccatcaacttgctagggctgctgcctgctgctcgatttttggcattggcggcggccggcgggcgacggtgattgtgctacattgagcgggatctgttcagaaaacttgatagtaatgccatcaagaagcggtttcaaaacatgagagctagcagaaccaactacctaagtctcctaggaaaaacagccaaaactagtgctttagtaagtcttttgatttccttttcttttanaaacatcaagtactaagtgctaatccatctactttgcttatttacaggttcttgttacaattttttcttttttaggactaaaaatctcaaactgtgttgttcagcacatctgcaggtaatttcttatatatgatgtggtcatattttgcatgtttgcattcccataatagatgttgactcgaaccacttgattagtgactgcaatgtgggcatttttacgttttttcttggattggaatgaaatgctttgagtcaactcgtttgtttacgccatagctatatttttatcctggtccgccactgcctgcacatacttggtttagtccaaatgcaggtaatcaatttgtatatgaacataattggatgagacggagattctgtgaggtccttcaaattgaggattcaccatatcaccatacaggagcgaagccacgtgtggggcagcttgggcttgggcctcaaatgtggcaaagaatttcaatgacaaaataccaaaatttagatagaaactcagtgaaaattttgaaacagcatagctcggtcctactctcggtgaaatcttgcctccgcccctgtcaccatatccacctatcctgatgtaattgaatatcttcttgcctgtttattccatagtgacatgtttgaaattccattgttgtgtattcatctgatgccattttggtttggtaaaatctcttcttttttttaaaaaaaatccaatgtctggttactttagccttttgcactgaacacctagttttttttttaatgaggacattacgtccttcagagcagtttcatcatcggagcatacccagggtaccttgagcatacccccacacaacagattagagaggttcgcttgatgaattacgaggaggacaaaggggagctttgcttcagtgaagagcaagtttcattatccaggttgcgaaaacgtcctattccagactaattccagataatttaaggatctatttagattgtagccaaaataaactttaccaaattttagcaatattaaaattttggcaagtaagcaatattgtcaaaattttgacatgatttcttatgtatttactaaatttagcaacaaactaaacatatacacttttttggcaagtttgccaaaaataaatagtatggttgaaaatgacatcaatctaaacagcccataaaatacatggagcacgaatagaaaactgagaataatagaacatcggttaggggaagaacaacgtcgtatcaaacgagcaagaaatagtgctgttgctggtgatgcttgggtccagatcccctagagttggggccaactccaccggatggatttggcctaatctcaaccgtccttttgacttatacagctgagattttctctaatctctataaccgtgtttctttcctttcctaattaaattacaagtaccaaagcagcagaccatcgtttcccctccaaaaccacgacagctttgtctttgtcatcgaattttagttcagctatggtgataata

SEQ ID NO: 1400 - DNA, 3702 bp, Oryza sativa
ccatggtgaagaacataatgctaatgtttatttagatggttttgtgatggccagcgttgttttattgatattattggccggagaataatcatggttatggcgggaagtactaaaaaactaaatattttcctctaaatctatatgattaagatagttgattagaagaagagtaggtgccatgatcccagccgtagaagtcagaagaacggttaagattgagccaaatctaccggtggagttggccccaactccaggggatctggacccctaactagtttacgaagagattatgcagggctcaagaaaaggatatggatacaaatacaaaaggctaaggggcgattgatcgcccctagcgatcagccgatcccccctccctcaacgtggttttcttttttggcaccgcattatttttctattttagtaaatttatacacctaaaatttgtacccctaaagtttacacatcaaatgtttagaaacccaaggtttataagtcaaaagtctatatatccgatttaaatttaaatttaaattcaaatattttttaatatagtatttctatacatctaaagtttatacacctaaaatttataaaacctaaagtttataagttaaaattttacatacccgtttcaaatttgaatttgaattcaaatattagtttgtagacccaaagtttataagtcaaaattttacatacccgttttaaatttgaatttgaattcaaatattatttatagacccaaagtttataagtcaaaagtttgcatacccgttcaaatttgaatttgaatttaaatattagtttatagacccagagtttataagtcaaaagtttacatacatgtttcaaatttgaatttgaatttaaatattagtttatagacctaaagtttataagtcaaaagtttacacacccatttcaaatctgaatttgaattcaaatatcaaatattttttatatatagtatttctatacataattttttttaactttgtttttttattttttaaaaaatttatgatgtaataggaagagaagaaggggaggaggaaaggggagaggaggagcatataggagggatggggggtgatcgctccgcctattagccacgcccgatacaaataccattgtccgaaacattgaatttctcctttccggagtactggggtcagtgcatgtagaaaatccgcgttgccctctcatagcatctccatgcaaggtgctacataataaaagcatctttataaatatcctcttctccaatttagaaattcatataccttatggaatattcttttatctaagagccgtgggatcgctgagaaattagggccgccacgtcagcgtattagtctaacagcgatcatgcatcttgcctcttcgtgcatgcacgcggccgccgttgaggaaaaaaaaaaacagcctcgtgcgtgcgttcctaggcctccaatcttattgggctgtattacctgtgccggcccttccttgttcatactaaagcaccacatgtctacgagacccatcggttaccctaaaaaggataacccaaaaccaaaaccaaagtttaaattttaaaacttaattttaagatatttttaacgtaatttattttttcatattagctttaaatcagttttatgcacaaattatcgttttttaataactagaaaaaaatccgtgcgttgtaattggtgaatgctatgttaatcttattattgttatatgatatatatatagagagagagtgagagagagagaataatgagctgtagttagtagtccgatcatctccgattagcatgcgagtattctttttttaaagagatttcttatatgagttcttatgtatttcaaaaaccgactcaaatgcggatatgtatttctaaaagcgaacaaaattaaaagccgactcatacacggatgacgtaccaaagtaccgacaaatacatcaattttcataatagtagagatagagattcgctatcagcgttgcggtttttttttcgcacagaagaaaaagggagtaaatattgcagcagctgaggtttgaaccctgatctccaagatacatcaaaacaccattcaccacaaaaccacacaatgcatcatatgcttataggtctattactcttttcatagtgtttcatggcctcggcatcaatgggcttggtgttatgatattgggcctcaacgccaaggtccatggcgctgaggtgaaggcctatttttaagttatagtttttggcaaggtctacttatagaataagtttgttaaaaatatcaaaatgtcaaaattacggttcaatgtttcagcgccaaagacatcggcgttggcactctcgtcctgtggtagctaagtcacttatgtgaaaaggatttgtgtcaaagagattggcactacggacctatttataatttctttctaaaaaaagtcaaatgtaaataccttttcttataaatagaccctcagttctagtcttttttggatggtaaggatcctaatttagaggaaaaacatagcaattttgaaagatttcaactatagaaaaattttaagtgaggatctttgaaacaaaggattgaatcctgccatatccttttagcattcctttgaatcaaaggattaagaaaatagagaaataggaaaaacatatgattattataggaaaaatataggaatgattgttagattgaatctcagaaaaaacatagaaattatatgagagagataaacacataggaaacgtttcatgaagttggacatcatgttaaaaatcctccaaaacttgtttggattgagacattccttaagaatttcttatgagtttcataagatccaatagttttcaatcctttgtttcaaaagggtcatatatgcagatacatgcactgtgcgtgtacttgctgtgtgtttcgtgcattagtaggagacgagcacaatggttcccgcccccgtctcctcgcgttgcactcgcccccaccatagccgctgccatcgcacttgccttcgccagttcgctgtagtagccttccctgtcgcagtcgctgctattagggccggatccaagcatcatcagcacgcaggttatcatcggccctgtttggatcctccgggctattaaatagcactctagaatcttactatttaaaagtattaaacgtagattactgacaaaatttattccataatccctgggctattttacgagacgaatctaacgaggtatattaatccatgatttgctacagtgatgctacagtaattatccgctaaccatggattaatatacctcgttagattcatcttgcaaaatagcctacgggttatgaaatatgttttgttagtaatctacgtttaatattcctaaatagcaagattttggagggctatttaatagcccggagaatccaaacaagatcatcgtcctatttggctttcgggggccagcccgcctcctccccgatgcctttgcatcgctttgcactctccgcgcccctcctgtgtcttcacgcttttctactcctcctccctcgcccaccatgcctccaccactgacgatgggcccatgagccctctcctctgccgccgccacaatcgtcaaatgaggcaataggaagggggatagaggggaagaatacatatttcactgataggtgggccccactaactgactaagcaagtcaacgctctttaaa

SEQ ID NO: 1401 - DNA, 7127 bp, Oryza sativa
aggaaggcacaatagacttattcttattcagccagagagtggcccacaatctatggcccaggcccaggtcctcttctaactcttcccccacaagccacacaggaagattttttcacggtgcggcggcggggccaaaccccagatagaaccctgcgccgcgtggtgcctagccccgggccgccgccgccgtggtgctgcccggggcttgacggcgtcgctcctcagttcctgcctccgccgactgtttcttcttctttgaggtaagccggaagggagtgggggagatggatcttgtagctatcgcctctcgctccttgcctctaaccctattcgcctcattcgctctctcgctctaatctcgcccccaacccgacgtcctcggcagcggcggagtgagtaatttgagtgggtttgccctagtttgggggatttgatttccctctcttctctttactttgtctgtttgatttcgttggacgtttgatgtgcaatcgatgcttctgttccagtccaaggaattttattccgttgaatattgaatcccctggtcaggtttcaaagaaaagaaaaatccccagttcttttcctgccaagacgcctttcctctggatttcgatttcatttgaactgatagtttgattttaccccagtgggtgactttgacggcaagcagccctgatttttttggcagagttacatatctcctgaattcccactttgatttcatctttactttttttttcgtgggatgctctctttggggatctcgatttcgagagtttagttttacttcatttcattacttcattcagtggatgattttggttttaaatggattgcgtgtttgacatgggtattcctccttgcagagcaagctggtaaagcaaagtagtatacgatctccagtccaaacatccattcgtgtgagcagtcaaacagttaatccttaaggtatggtgcaatgtttttttttctagttattgacaagtttggagtagtctctgctgtcctgatttaatccatttggttggcaatggcattaaaatgagttaattgcaatgtaagataagttgcaatctttttgacaaaaaagcgattcacaactgtagttacatagtaagtgcaagaagattacaagataacaagaatgcaaaagttaatggaacctatgttggttagtctatagtggctgtagatacatcactacctttatagaaatttccagatttgcatagtatagagtaaaatacatggctgatccttaaagttggacgaggatatatggaggactttgagatcttccattcttcgacaatgaaagatcagccatatggcatatctagatatggttcatcgatttgtataaatgcatatctaggtccctaatctcagtttaatgttttcccaaggtccaaaatacatacgacatagcttgggtgctgacgtagttatccactacagtattttgcatttagacccctccacctcaatatgccccaccccgaccccccaccgtttccaccatacccgtggccgtggggaaggaggcgaagagacatcaattaggcagtatttgatcatcagcgatatgaggtcctcggagccgggatagatggtacgatagggagagggtgatcccgtgagtccagtatggtgtgattgtcaccttgacctcagattgtgggaggatcacatcgacaataaatgccacacctgactcacgggatcacccacttcgtaataagctatttatcttgacctccaggacctttgattgctgataatcgccacagctataatcactatctcttcatctcctctcccactggtgcggtaggagtcaatttggaagtggtgagagtcaatttggggggtatactgtagcggagggacctaaatgtgaaatctgtgccactgtggacaactacggtcagcgcccgagcggtgtcatctgcattttggactttgggttatacattaaatcaaaatcagggacatagatgtgcattttacaagttaatggacctagatggcacctctgtccaagtttaaggactgtccgtgaaggattttattttttttaatcataatatgatgatacaaatttacccccaatattaatgtactcatagtttgttcactttttcagtatggtttctgtatacgaagaagcacgggaaaggtggacttggaaaaatcaagtaacagaagaagggccttatggctttaaaattctctcccaaataagacgccaggaccatggtatgtactataatattgaagaccatgattctgcttggtccttctttgtattataatgcaaaacgattttatattttacttaactgattcttcgcttaaaaagggcaaaattttctttagactaactttttgacatttcctataggatactcttagttttgtggttctttgagcaatatttattcaaactcagatcttgcaaggtggctaagggtaaaatcgtcttttgtaaagttttatctctccattagaagaggatatattaaaataatggttgggagtgtcttttggcaaaaaaaaaaagattgtcctaaggcaaaatgattttcacgacaacagagcgttgataaactaaagcaattaaagctatgaatcacttgtatttttctagtaccgagaaacccagttgcttgtagactagtctgaactgaagctagctacatagtgcatgctatgacttatacattatcgaaaagatcgaagcacgaactgcaagcacgttaccatatggtttctgaagaaagtacaaagctacataacctcatgttgtgcaaaatcaaactcaaaaagagcctatactgtaaatgtaaatctaatcacatcacaatcactgaccattgaaatctgaacatggtgcatcaaattttgcccttagaaaatgtaggttgcgtttttttttcattttgtaatgatgcattgctttaacttattgttgtattactcccaattgcagactgctgtaccttctctgctatggcttcaactctcgaggccaatgtaagagttcagcatggaaggaacgatcaattttccatacctcacctgcaatttatagatgctcaatcaaaaatcagtgcaccaaataccaatgagacaaaggtactgaggcttttgaaaagtctaaaagagagagacggtggggtttacttggatgaagactatgatagtgaggtaccttgtttaattcacttctatgcctattttctaaacataatgtagaaaaaatgtgattgcctggtgcctatattaagcatactatgttttgtttttcaggggaatctccgagccttagatgctaaagtttgcagggtatggaagttcaatctctaccatgtgaaggacattattcatcttcgaagtgctcttcatcggctgcgcaggcaagggcctttactggctgttatccgcatcagccgtaattatgatgagtgccgcaagtcaggccatgtctacaaatatgatcctgcccgaatctgcacatatgatgatgggaaacccaagacgcacgcgttgtgtgttgtttcgtttgtaactgagaagggtacaccatgccttgagtgtcaggactctcacggcacagcttggggtattggcggttacttaactgtggaaatcaggtcactaaaagagctatacagtgttagagttacgtagctggtggctgtcaagtcaatgcaactcaagactctacgtatgcactcattttctatcattttaatacttcctgcttacagtacgtggccaatgcaaagatttcatggctcagaagaaagggatctttggaattaatactttgtatttaagtgataatggcctgttgcttctcttgaccttttgtcccttttttggatgtgagagttatggaagttagatttggggaacagaagattttgtgattctatcaaagcgagatcatttctttaatttgaatatccacatgcctaagggtatggttgtagagtgcctgaatgctgatatacgtggaattttgctcatttgatcatcaaccagcatgcctcttgttctctaaactgttaacgtggaatgttacaactcgctgatatttttagtgtactgtatagtatacattatatatgatctccggaggtttcgttggatttataccttcagatttcagagcaaggttaactagtacatcaggctgagtgtatggatgatacaccagcgaacaaactttgatggatgagcaaggtactttaagcgttaggcagatggactgtattgcacatcatatgctactatttcacattcagcacatgacatactccagaatcttaatatatctcagtttaagtttcagattgtaaatatgcacaacatatagatgaaaaactcactacattctgactatcatagagttgagaagtaactttcttgcaggtataattagaacacatgatcctgatcggcatttgaatcaggagcacttcagaattcaaatctgaatatttcagattcacattctaaagataaacatgaccaaaacttatacatgatgatctcccccaatgtagttggttcttaattgtaagtgctagtagtcaaacctgtttgtatgtgctagtagtcaaaccaatggatgcactccatatttcttaagtagttcgattgtcgcttgattaggtaggaatattctaactaatataacgtctttcatttcaagtagaaataaacaataagatgaacgtttatgaactgaagagagaataggaactaggataatagtccaacaaaaattctaaatactattgattgtaactttcccttggaagaaagtacggctcatttcccttggaagaaagtacggctcatttgtaagagcaggtacaatagcaggctataagccagctgcaaacatattttaaagagataaataaggagagagaagggcagcgggctacagatttgtagccagctgtagcacggactccaagacgcagtgtgtgtatgataggtgggaccatatattaatagtgtagtatgtaactattgtattaatgagctattagattagctatagattaattggagctagtagttagctacactgttaaacttgctctaagtttacggtagttcacacagatcaatggagtagttatgtaaatgacaggctaatgcttcagtggctactggctagattgattaatcaaagatcccatttcccttgaagaaagtacggctcatttgtaagtttatggtagttcacacagatcaatagttatgtaaatgacaggcttgttttcagtgataagatactagtgcgttcgttccagtgacattgggtgagaaaacatctcgttttccgcatgcacgtttcctaaactactaaacagtgcatttttttgcaaaaaaaaaattctataggaaagttgctttaaaaaatcatatttgtcagggttacggataaaatatactctctattcttgaatatacgttgtatactgatatggtatacccgcgcgtatacggatatttcctgtgtacgttaaggaaatctatcacgtgatagaagtggagtccatagatggaaggagtcctactcgaataaaactgggtcgttaccatatcgtgtggggtccgatatccctgagtcctacttggagatcgactgacccgcggtataaaagggaccccccgagcaggacctaaggcattgaatcttaccgccaacacacccaccacagcctacgaagccagagcctacaagagccaagtcgccgggtgatctagtcgaaccaactcgactatgatctcgtcggtatcgccgagttctgttattccctttgtaatctatagtttccactatataatcccatatcaactggattagggctattacctaccaaggggcctgaaccagtataatccttgtcttttgtttgcttgatgtcgtattacgtagatcctcgtaccagcgtaccccaatgccctctatatccggtctacgggtatcccccgtcgacaatattaatccatttttgcaatttaaaatagttaatactcaattaatcatacgctaatgatctatctcgttttgcgtatcttcccaatcttctcaatcccctccttctcaaactcattatgcttctcaaagatcccattttttcggtggggacaggactgtaagcttgtttacctgtataatgtgtatttgacttcgatgtatgcgtctcgtcttagtttgaatcacacccatgtgcataattgcggtgttaagcgtgtgagggtaattttttgaacaaggatgatccaaaaactgctattccctccgtccaacgaagtctttttttattattattttctgtgtccaacgtttgatcatccgtcttatttaaatttttttaaaaaaaatagtcacacataaattattattcatgttttatcatctaataaaaataaaaataaaaatactaatcatagaaaaattttaaataaaataaagagtcaaacgttgtataaaaactgaaaaatggagtctttataggatggagggagtacttcattgcagcaagccgacatgctttgctccctggcaacaaaaataaataatgaaatacaagctactttattccaggtttatgtgtaatttttacaggaaaactgtcatattccgatgcttgaaaggaggtggcctagtgaaaattggtgcacgtcccgttttctttactggagtacgtatttaatcgaagtttaggtttttgtttgttaatatgcttatgaaacccacaatttttaaattatcccttcctctctcttgattgtctcagggctacaaagagaaggttaggttaagtttaagctcgagcttattattataccgaaattgttaggctgacactgttgggattttcatgtcagcttgctaaaagtcaaaatgcttgctgtatggcagcagcttattcagatcatttggtcctatgtatcttcttcgattcattagtactattatgcaacccctgtgctacatccgtatttcagaggggttgtataatatctataagaagtggagacataaagatataaggtgggactttcttctcattcatcattctgtcatcctc

SEQ ID NO: 1402 - DNA, 25336 bp, Oryza sativa
  unsure (1)..(25336): unsure at all n locations
aattgataattaaaacatgattaaaggtgggttgtgagcacatggttttgatggtcgtgctcataacaattaaggaacggttcgcgagctactgttgtgaaacatttaccgtgccaaccacaagccaacatgggtaacggctttaccttttgtatagcatagttcattatggggtgccagactgagaagcggcgagaagtccgtgagtgttgctggggagtccatgcctctggttgtagagggggtgattatgatccaggtatggtgcactgtggtgagttgtgttgtgcgaggggtattgtcacagttcctttccgaggtaccgtggtggtattgaggcgcatggtaacatgttgtggaactgtcttgtgggtacagtggtacatctctggccagagtaaaactattcgaatagccgtgcctgcggttatgggtgggtctaacaatgtttttcgtgattagtctcacattactcattattggtgataatactgtgacaattaaattgactcctggtttggaatggtatattcctggtatggaggtttgatttgtacaaccggggttggttgttcagatgaggttgggcctatgcaacacgggtgtgttgtatagtgtttatttaatattgcttaatttacttaattgttttactattctctcaaatgtttattaaatattgtttatgcaaatgagctttattatgccatcctttgttatcctgtgcacttgcatatttgctatgtggcttgttgagtatgtcatatgctcattcttgcaatattcattcatcagaggaggagtacttcagtgaaggtgatgatctggaggattaggcttgttcgggtcaagttgcttgtggagtggggtcgccatagctgttccgccttttgtttttattttccgctgcgtagaattttattcttttgagaggaattatccacctctgtaataatttattattttgcgaatattaattagtagtttgacattactctattatcaatttgttattgtgtgcctcggctgattcctggacgaggatttaacacacatgtaagcgtttggaattttggatagaaatttcgggcgtgacactcagccagtcttgtctctctcggatagcttcaccaacctctgagacttcgtcaagctcagtactcgggggctactatggggtacacggtacctaggtacccaacgacaagccttggaccgccaccacatggggtgggcccagtgccctaagcccatgtggcatacttgtatacatagaaggagataaaagataaggaagtctatcctatctcttgtaaatagatggcaaggtatccattttataagggatactttgccatgtatgggggggggagccctagctctatataaagggcgctggcgacaatcctacggaggctttttgaccatttttccaccggatacagacaattcatcccactggacgtagggtattacctcatctcgagggcctgaaccaggataatcatctgtgtcaccatctctccttgatctagcgcaccccataaaatatattgccaatcatagaatcgacagaatttatctagcaaggtgtcgactagggtttggttatttgctagtcgttgctaaagttgggtagcataacgactaggtttggtatcttcttgttgatgcgaaaacacgatgcctggaagatctgcttaacttcagtgcaggtccaaaaaaaaatcttgcctttaggttcgtgagcgtgccagttgatttgatcatgcaatcaacaagaaataaaaataaagaaactgcagttaaatccataaatgatagccgatcggccagccgccaatgacgtatcatttatctttgagccgatgtcatatttgattcgatcggcaatcataaacaagcaagaaagaactaaatctattcgatcggctgtggtattaacggtaaataatccctacgtcgatatatacttaaatcaagtgattgggatagatcggtcgtcatgccgagacagtataaatcacttagattgaaatatatactaacgagaggactataagcattcataacatagccgattagatagatctagcatgtatcggctaatactctgataccactctatattaagatattaaagcaggcaaagtatatcaaacagaagcctaacatacctagatgcaacaagatcttaacataaagggcagatctagcatatcaattaagcatatgaaatataaagctaaatcatgtaagatcggctgaaaccccgacattaccctaatcggcaaccaaagacaggctagagatcatggttctaattacgatttataaggtcaaactcaactgatgcagctataagtatgaaaagaacaacaatatctagacaatcaagacgttggatgtttcataaggtggtagatatcctatataatctaagtcaatgttggtatttaacctaatcggttgccttcccgcaatagatgttagccgattgaaggttaaataacagtattgccagagattatataggatatatggtaactcgacgaattacataaacaagattagagtatcataacgatggaagcactaatcccgataacgcaagccgccacaacaagttttacctctagttgaagattgaaaccgatgcagctcaacccgaaagcaagaactcgtcgaaacaaaacgaaagtaaaagggtggtggtgcgccgagattgtattgaacgtgtgtgttagattgattacatggggctcggggtctatttatacccgagattacaaaatatgtccatgtcagacacgactcttatctctaacaaactctaagataccataagtctttgcggcagacttttgcccaaacttatctctaaggaaattacataaaatatcctaattgatagatacaattgccttctcaggacttaatccgtgcatggcaatccacatgaagcacattaactcaacccgacaacgtgtatcgagttacattgtcggaatcggtttaatcggctaaccttgtccgactcgaactctgtcgattctggttgcagccgattcggacttcagctgattcttgctctgttcccggaacgatccatccttagattccgcttcggttttatctccatctccgatactaaaactaccaaatttgatcgttaacacttctctagccggtgtcaacagacaacatatcgactagagaagtaggaggctcatgcaggtttagcgaggcggaagtgttactccgacaaccgtgggtggtgacggagcggcttggatcacacatagcccgagagctaactgtgcggcgtgctgtggaggtcgagggaatagtaaagctccaaccacagtacgcatagaggcgtggggtgctaggagcagcacatttgaccttgctgggctttacaaccaacagtctgatgtaagggccagtagaccgggcaaacatccccatgaaaggcgtaaagttccaaccggcggctctttaggggctaatgggtattttggaatgaaagaagatatgcgataatcaaatataagtttaaagtaagaattcaaatataagtttgaatcaaatataaattcaaatggtaattaaggaaattcaaataaatcttaaaatagcaagtctgatatcaaaatgtagagtttgaatttagatgaatttaggtcaaatttcattggaatcggatatatggtttaggagatatgggcttctaaataataggatttggattaaatctagaaaatactaaaggttactccctccgtttcatgttataagacgttttgactttggtcaaagtcaaactgttttaagattgatcaagtttgtgaaaaaaagtagtaacattttcaacataagacgaatttactatgaaaatatattcaattattgatttgttgaaactaatttagtattataaatattattatatttatctataaacttagtaaaactaaacagtttaactttgaccaaagtcaaaacgtcttataacttgaaatcgagaaatggagacagtactgtttatgggcccacttgtcaggcttttcttttctctctctttttcttgtccttcttcctcccatcaacatattctctgcttcttgccagggaactgagaggagggagagaagggcgctggtgctccggtggacagggaaaggtagcgtcgncggcagatgatgttcccgagcgacgcgcatctagggagggtggcttcatacacaagcactgagagagnaggccggaacggcgagggcaagagctcactccggcagcaaaagaggtagctgtggtggcttgatcatggaatgggtagggaagaggggaaagtaggaaaatggattcacttcattgaggcgaagctattggcgcgagtatttggtcggcaatgctccggtgagggagatcaaccgatggctagcatgggagagagagagaagaggagagctcagagagctcggttgtgtggaggggaggggcgagcttttcgccgtctatttataggcgtcaagaggcggttcgcagaggaagagaggaagggaaacacggcatcggcggagtggggaaagagaaaacggctgacggctttgtctccgattggtcgaccgcgtctgtttgacgtagcggctgagatcagggtagtgacgcaaagctgcgggcggaggtggaggaggaggagcacggcacggcgatggcgcctctggcttggcgaagcagcggcgacggcggctccaactcgatgcgacggcgcccatggtatgttggcgacggcgcccacgggacagggaggaggagcggctgcctctgctgagaggtttcggcccacaactgaaataaaaatattttttaaatttttgttgaagatttagatgattaggtttgaacacaatttgaatttggaggagattttcaaaagataaagtttctaatttatatgagagtgattttttggaggtggaatatatttagaagcactcaaataagaaataggaatattttgcactataaataatagggcttctaatttggatatatttttgggaacgtggtagaaaatacatgaatgaagataaataggattttatccccacaaatgggtggtatggatttagagaaatattttgtggctaataggagatttgaattttggatgaggagtataaattggaattttcttagcacaagagcaatcattctaatatttataatattgctaatcttgtgccgagaagtattagattatggaaattggaacgggaggttagatcaaaataggagcttgagtaaagaataaatgatagaatatttcggatggagaagaattaaggatttttagaggtaaacctagatcaagggtttggtaaagaaataattccaattggaattcctctggtttaggattaaggacaatattggaggatttcttggaccaataattcataaaagtaaaacgggtttttaatagatttgcaacaaggaattttaatcgaaagaaagtaataaaaccaaatcaagaaataactcaatttaaatgaagatcagagaagaactaaaatgtcaaagagagggcttatacaaacaaatttttaggaggttacctctaattataatttcttaggttttggaagttatgaagaacataagaatcggcataattcataattaacaaatggttaattttcaggatgttacaagttaccagtgacaacgtcgcggaagaaggcggcgaccacagctctacccgtcgccgcgctcgaccgccaccgctccactcccgcgctcgcctaccatcgcttcacccgccacccgccgcccgctaccatgctcgcttgccgcccgccggctctcctcccgctgcctgccgcccgcgtccgctctcgcccatcgccgctccgctcgctgccagcctccctcactgaagaagagaagagaagagagaagagagaaaagagaagagaaggagaagaaaagagaagaaaaaagatgtgccgctgacatgtgggccccacgtactttttttaaattttttttgctgcctaagatgtcacgtcagcgaaaccacctatatatactaccataggaccttgagtaaacgatttatgtgagtttaggggtacacatttctagttttgaggttaagggacctcaaaaaatctcgctattaagttgagggacctccggtgaacttactctaaaaccaaatcccggaggaataagtacacgaaggtccctcaacttgtcatcgaattacaaaatcatcccccaaccgcaaaaccatatatatgacatcctttaacttgcaaaaccgttcgctttacatcctttggaggttttgaccccggttttatccgacgtgacgggcgagtaagcatgggacccacatgtcaggacgccacatcattaggctctctcttttccctcctctcccttcctcctcctctctctcactctctcactcatctcccaccccccacgcccaagtgctccccgccgccgttctggccattggccggcgagctgatcagtggagtgacaccggaggtgttcgacctgtgcagatcatggccaatttcgtcagagtgccagagttcaggtgaagagaagaaataaatggttgatgaattgagttacctagtgggagggaggcagaaggtgatggtgtaggcggcggcgttgcaggtgaaggtgctcatgccgtcgttgtaggcgtagctgtaggcgcgcgggcacgctgacttgaagatggtcgagtacgccgtcggccggctgtcgatgcataaaacacagactggccggagaggtttgctttactctagtgcaggtccaaagagatcgctttcgggttcagggcgtgccaattggtttaatcctgcaaataacaagaaacaaagaaaccaaagttaaacccgtaaatgatagccgatcggttggattgccgatgacatatcctttgtgccaggccaatatgatacagatcagatcggccgtaatgtgatgaaagagataattgagtttgttctatcggctgtatatgtcaataacacataatatgtgtttcaaagtatgcttaaaccaagtgtttaggaaagatcggtcagcacatcaagacagtataaaccattcgagtccaagaatactttaaagcagggattatatgtactcacagcatagccgataggcaaacccaacgtgtatcaggtagtactcagataccactttatactaagatatgctaaacaagaatcaatctagtgtcagggtgacctaacagactgatggcaagcttaacatatttggtccaagcgagatattaatataaagggcagatttagcgtatcaagtaaacacatatgaaatgagataactaaatcaggtaagatcggctgaaaccccgatgctatctctattaacaatcataggacatgctagatattatggttctaaatgttacttaacagatcaaacttaactgatacaacattaagcacatggagaaacataggatctaaacaagtccatgagagccttttcgagatggtagatatgctatataatctgattcgacacagctatctaaccctatcggctattttcgatgatagaggctagccgacacggttatatagcaagatcgatctagattatatagcatactagagaatgccccgcgcgtgctgcgggacttggttaacatcaatttgttagataagaggtataatctcaagaagaaatagaagaaacaaatagctttcttggagaaattcttttttagcagccctatcgaaaatttgtagataatttaggtagtacatgtcaactgaaggagcgttcagccataaaactcttttatacgattgatgggctagatacatgtagatgtgtgtggagatgggccaatgtgttcatgtgggctacatttggcactgaggaggctaagagactcacccggttggtgactgatgggttgggctctatgctgcattccatccaacgtctgagaaacaatctaatacattcatccaacggttcacaatttgatgatgatgtggaagcacgaggcttgagcttttggctttaactttatagaaagaagggatatgataactctgcggttttgcataggcagggctagagtgtcatgaagatgtaagcactagccctgagaacgcaaaccgccataacaagctttacctcttcgtcggagatcgaaatcgatgtagcccaactcgaaagcaagaactcgccgaaaacaaagaaaagtagaaaaggtggcgatgcgtcgagagtgtatttaacttgatgttatttgtttacagggtcttgggccatattatacccaaaatacatgatatgtccttgccggacacgactccacttcttttacaactcaaaaatgcgagcaagtcccttagacggactcttaccaaaaatatctataaggaaactattaaaatatcctaattaatagatacaattgccttcttcggactcaatccatacttggaagtacttgtatagcacttcaaccgatcccgacaatgttttcatgatcatcttgccaaaatcggctacatcggcttctccctatctagttctgtatcagccaatccagacggaagccgatgcagtccgtagccgatgcgtactctgtttctgtgatcatcaatttcctcccaaatctacttcggttttgatttcagatccgatctatgatttaccaattttggtcgttaacaccggcacgtcaccggcgtcgcgtacgcgccgctgcagcagtactcctcctccccgaacgcctcgcacgcgctccggcatgccgccatccacctgccactccttcgaactcactgcacatatgctcatgtcaacacaaacacgttcgccatgtacgacatgcgtgcatgacacacggatgtgtgacacgcttgcttgggcgaaggaaaagagactgtaacatcccgccactcccaggccgggcccgcttacatctggcagctttcatagatcaatcaggcttaaccctggagttctttggagatcggcttccgaaaaagaagttgcaacttgtttatatgagtattctattaatcttattaagccctaggccgggatgtcacagagaccgagcgtaatgaatgcatggatgatcaaagctgattggggaccaaaccaagaccctctccaagtctacttctacctcatcacgtcacttttggtccacagaagacaagatataaaattttacacgttttggattcggattcgggccttctggcagcatcaacttcaaatggacctagccgctgattagaaggaatttcggggcccatgagtacttgttggaaagcttatggagtctactttcagatggttttggttccacatcaaaattcctaccgagctgccggcaatctgcaaaacaagccacctatctcatccagtccgaatctgatttgggttttgggccttgtaactgtgtcgcgggcttagtccaagggggtgtgcgccctggggcaaccctaggatgtctctaatcatatttagtcagtagccgtcatcgtttagagtcgggttttacttagattaatctgtcaaaaacagtttcaccgctagatcagtttatggaacccccaaattcgagtgcttaatcattcatatgcaattttgttgcaatctatcttggtcttgcttgtgttcttcgattcgcatatagggattagccttctcggcgaggtcaaccgggtttcggcacgattgataaccagaggagacgtggtgctgcgattacagggctcagtagcgtgattgttcaaagccggatcgagttgtgtcgcccctccacccaaatcgactatttatcaatacctatcggaagatcgggagcaatagtcaacatcatttggtatcagagttgagcccttatttaaggggatgggaatgatgaggacatcctgtcacgcccagaaattcacgaaccagaatttctaagctgaatgtgcattaattccctgtccaggactagccagggtacacaaacgacaattgttgacatacagacccacgtcttataaaaatatagaagattacaaatgcgcggaaaagataaaacgagctaaacttggaagcttgacttcagtagcgggcgactccactccacaggcaacccttgacggcagcgacgaaaccaacctttatgagacagctccaactgggaagaacttccgctctggtgtgggggaaaagagagcaagactgagtactacccactgtactcagcgagtcataccggaagaggaggtatgatgcaggatataaccaaaggaggctaaaggttcatttgcaataaagtaggcatttaaaagcagtagttgaaaatagtaaaacaattgtagtaagtaatcagtattaacccatcactatccaacgctacaccacgttgcaacaggcccaacaaaccacctgaactacaccagttcattaaactaaactaggggtgagactaatcacggtgaatcaggttgatcgcccataaccgcaggcacggctattcgaatagtttttctctggccagaggtgtacaactgtacccacaagacacgattctacacatgtcgccatgccccaaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagctggacaaccggacaccccggccaacccaacttcatcacgcccaccctcgccaccggtgccttggaaagggtcgagctatacttcagatcaagcagttacccactcccgcttgtggtaagcacggtaagtctcccagggtttcccgtgaaccggtccttaactgccatgggtgcgaccagccaaaccatgcacccacagctcaccattcagtgtattttaattaactaacaccactgcggtggcaccaatccaaagctatgctaatagtcaaagtctatgtaataatgtgatccccatttgtgtactagttgaactagacatggctaagcgttttcctaaaccaacatctagttattttgatacccaagctatcaatggcataaggtacacaataaatggctgagtaataggacccatcccacatgacattgtaaaaggatgcaatatttaatagaaatgcgggatatttgtaaattgggtacaatatgatcaattgtaatgcatgacttgccttactctcgcactgatgagatctcagcaacgtcttcgagaaatcgcggatcgacgaaacagccgaaatctacgggacaaacaaagcacacaaacaaaacatgctataagactactgaaacaggaaacaaaaccatttttaatggattctagggatttttatgaatttactgagacttgaatagacttaaacggagctcgaatgaattacttatgaattttagaagataagttgtgtttttactaataaagaaaagtcatcaatcaatttattgcgcaataaagcccagggctgacgccagcgaaaggggggcggcgccagcaagcgggccccgcatgtcagcggcacaaagggtggccggtctaccgtggaccaggtccacggggaggaggggtggtggtgtaccacgtggcgccgacgtggcaccacgtggctggccacgcgggccatgggacggacggccacgatcggtcgagggccgatagggcggctggggacgggcggcaccgaggccagcccgggcatggcgcacggtggcgaccggccggcggcagcggccggcgacgcggacgggcggcggcggcaccttaggagagagcagaaatagggttaggagtagggaaggcaaccacggcggacgccattgacggtcggaggcggaggggatggggaagctcaccggcgttcgggacgaagggggctccggcagcgattgatgacaatcgggcagcgaccgaggtgcaggcaggctcggtgagcgcgacggcggcgattgcgcggcgcggcggcggctctagcggcggcggcgcgcggccggagatgggtggcggcggcggagctcggcgagcgcggcgccacggcggtaggaagcacgggaaagggcggcgagagtgggaaacgagagagggggcccggggagggtttttatgggcgagggaggggcggacgtggccgggaaggtggctgatttggccagcgacgtgggggagtggagggagagagaggggtgttgggggatttcaaatcccccaccacttgcgggcgcgcgcgtgcgggagaggtggagatgggcaacgacgtgggcgcagggtgcgggcgcgaagtggagcggagaaggcggaagtgcggggcggttggagcttgggctccaacggccggaggtaggagacgaccgacaggtggggcccacctgtcggcgtcccagagagaggagggagggagcgggccggcccacaaggggaggccgagcgcggggtgaggtggggtggactggcccgacggcccaagaaggaaaaagaaagaaaagaaaaagaaggaaatggaaaaaaaggatttcctggggtttaaatattgcggttaatgaattttaattggttaaaattacttatagggctctgaaaattcctctaaaaatcatgttaatgtattggagcatggggaactcaagaaaaaatccaccacgccgaattcgattattaaatgcatttattaattgaggattagctctaggttaattcgaatcatttcttcggccgatttatttaacaaatttttaaagcaaggaaaaggggaaacttcagggcgtgacacatcctccactattaactgctggtaaagacgcaacaaggggccaagtggtccagttgtagtcggacggcaaccgtgtgagcctctgaataatcccaccttgcttagcttgggaggaggaagccaccttaaaagggagagccacgaagccctattagactagtcttttagggagattgggcatttccccgaatggatgtgcctaagaactgttggggttcgggcaactttaattattgggcctcggccaacctcacctgggccggatgtattaggtggtggcacggctgccgccgcactccaagcgatcgccgcagtcgctggtctagcacgcggtcgcgccaccaccgtcgaccggcctgcctagggagagaggagcagggagggagacgtgggtcctacactgactcacccgctatgtcggacaaaaccgtgatcaaaaccaccgaaggatgtaaagcgaacggttttgtaaattaagtgatgccattatatggttttgcggttgggagacgattttgtaagtcgatgacaagttgagggaccttgggtgtactttttccaatcctggagtacagtacaaagaccgccactgcctctcgtggaatcgtggcccgtgggtatgtgtcaacgatcggcatcggctgctctactgttgctgttttgggctgagccacgtgagctgctgtttgccgctcgcgtccgccagtagaggatgaaagcccataaagcccaccactaccgtctttcaaagcccacaaagcttcctcgtgttcgagtccgactgcctgtcgtgcttggtaccctatatatgttgagtcttcataatctaaaatcgccaggtctggctaatttttccataataaagaggtttctgtttttttactcaatttttcccacatagaagattgaaccctgttgaaagctcacccggacaaaaggtcaagtagattttggtcaagaaaagatcaagtagattccatcatgcagatgcgatcgtctccgcccatagttcttacgggaagaagtgaaaggttggtgtttctttgaaatttgtgatttacatcgagttactctatgatccattattgctcctaataagtttttttttaattacacacaaacgcacgcgtgcacacaccattacacgtagcaccgcacaaacatcctcgcaaatacgtaccctagaacacactcaaagagatgaaaccaaatgtatatacatgatctcataagaaatcatctacatgtacgtaatatttgtaggcatcaggatttgaattttggtgggtgcctcctaaagagtttgatctgtaagaataggtgaaatcgaagcttgggcccttttgctctgatctagtaattgagaatacatattagtattttaagtactctacgctagtgcatattccccaatggctttaccacatgttaagatagcttgacccactttatacggacgctatccatataatcttttgtgcgttgtgtttacacaataatgtcgcacattggagtagtttacctacgattgcttaaataatgctaaaagacccgctgcccacccaaaagtccgcaactctgtaaccgatccaggccgcagccgtggcccaagaagcccaaaaggcccgctgcccacccaaacgggtcgagtgacctgcgcacccaaactgagggcgtttagttgtcgtcgacaggttgcggccgcgaggggagcggagaaagggggggaaaaaagatggaaactaaccctaatctcgatctcgacggcgagggcggcgccggcgccggcgcctcgtcgggccgttctttgctgccgaaaggaagtggtaggttccgccgctcgtcggcccgttgttcgctgccgaaagggagtgataggttccgccgctcactatcgccggtgaactcgcggtcgctcctagaaggacgggatgtgcgggacgctgttttccccaacaaactcttcgataaagccttcggccagcctcttccgtaagttcattcatgccctccctctccacacccatgaggccatgagcatgacttaacctaagaatcgattgctgccgcagagcgcccgtaacgccgtctctggtaccatcgcccgcttacatcgtgcgccccaacctgccgaccccttccgagccacacggattgaatttcaagttgtgcatgtttacccttagctctattgattgattgagtgattgattttactcccctttatattgatttccttgttcttttattcatctgaagtgccccacttgttggcgatgggaagatgcaaatggatgtggagggtgccccacttgttggcgatgggaagatgcatatggttgtggagagtaccccacttgttggcgatggcaagatgcatatggttgtggaggaggaaatgacaacagctctggctgttcatcagccttcaagtcagagaagtcagaggtacttagcacatcttctgccataaatcattcatatataattagaagtagcttaacacatgatctggaaattcctttaactcaggatcatagtgattgagatgatggcagatgttggctcaccttcctctcctggctccccctactcccctagttccccttcttctcatcgagacgctccctcggtccgcttctcctctcgaggcatccgtaaccataagatgtaagttggttctcctatgtgcgttatgtttttgcatatattagcacatactgctgattattaacattgaaattaagaataatagactaaaaattaaattcgtaatgaaacagcacttgacaccaccatttttgagatctgaagttttatgattcatatatgctacttcctccgtttcatattataagactttctagcattgcccacatttatatatatatattaatgaatctaaacatatatatgtctagattcattaacatctatatgaatatgggcaatgctagaaagtcttataatatgaaatggagggagtagaccctagagatggatggtggtaatgcagccgttgcttcacttatttgtgcgctcacttgttaatcatgttcaccagctggcctcatttctcccactccgatgtgtccatccaagcatgttctactatcactctaggctgtgaatatgttgggtgggggattggccatctggtcagtttgggaagtgaaagttacacgaaccattggtactttgggcagatagtaaatgttgggacctaggagatccacggatagaacagtttagtacatataaatgtttgatatatctaaggcttataatttatttaggtctgtaatcaaatggtatatatgttattgacatgagaaaacattttgtagtcaataatacagaggggtgagatttatcatgttaacctttgaaacttttgatgaaatgttttaggcctcagtgtgatatagacagatcagacactgaagaagatctatattcatcgtgtgaggaggatccctacttcaatagccttgtggatgatttcatcggtgcagttaccagcaccgatctacttgcatcatcacctgaaattgactatatggcagctaatcaaagtcaatctcttttctatgctgaaagtgcattaaaacattataacaacaatgatgagaacaaggtaacttttttgcatttcttttgttgtattttctatttatgtacgaatctggctgctagaaatctgtttagatttgtttcttacctcatgctatggtgattagccctctctattcttgtcatggctttgtcatttatttgtagttatctccaattgttcccagcaataatcagattaactcttaaattaaaagttgtggtaggtcggtgaaatctaattcaattttaacttagagcatggacttagcacgccacacagttgtttgatccttttgaatttttgaaacaatattattttttgtattttacttatcttccaaagtttgtatatggctttaattattttgttgtgataccgctatccaagattcttagtattttttttattttccttaactagcaaagtacttgccttgcaacggatttcaaaagatatgtccgaagttcttcacttggaaattgtatttgccaaacataatttgcaagcaaacatccagcaaaaaaccaagccacacacacaaagatatatttatctagacttggaagatctcactaactccaactgatggcagattcaccaccaccactaggttcttttatatagtagagattttacatgtatatgtgttaaatatttgtttactgacttttattgtctttctatttgaaatatagataaagtatgagttaatcagtgccattacaagcaatgcaattatagaccggagtggttatggtcatgtaaactttgttgcaaaaggggatctacctgattcagtggatgagttctttttcgcagaagtacgttgggacattgattcttatgtgccagtttgcatggtctccttagaagggaaggaaaaatctggttagttcgaaagataaccgaaaactctattaatctgttcttttcttctaaattttaacatgtatatgtaattgatgtgtacaggtggttaccgtgacattgaagtcgactatccaagagaggttttgtgggtgttcccgtcgataagaatcattgctatgcttgtggcgatggactcaagcatccagaggatggaacgttatatgagagtggtcatatcgcttccggcagttattatgactagcagttttattgaaattgcatttttagaactttatttagctagactagaagtgtgcaatcctttatatctatgctaaactaaattagtacggagtatactcaccattctactttgtatacatcttgtttgatttgggttgaactccgagttgtatgtgatacacccgaagacgttattatcgttgcaaatattgaaaaagtcatagaaggtggcaatccactcctgggagtggggatggatatatgttgtcacaagtatgatcctatggacgggactagcaattggacatgattttaggtagattgttgaacggtgtttcattacttgttaaaaaataaaatatttatgtttcatcagttagtgtaaaaatgttttaaccggatgtatttgtttattgattacacacaaataaaccaacagtagtggacataggggttactgggttattcccgggaataccaaaaatttgtgaagtaaaattgatatatatgggtatacacatatgtaagtatttaattagatctaatacttcatcatcgatctgttttttctcaacaaatctattcttctggaatattgactcacatcacttctaactagttaactatctcaaatcccctaactctatcccactttttataaacaaccacaacaactctatcccactaaacaatatggatgaaatacttgcgattgttcagtaaatacccagatatataatccgcatccgccaaaccaacatgtgaaacatcaaagaaaactaactgcaacatcgagaaaaaaaaatgttattcaacacatttaagacggcagagggcgaggcgtcacacctttaacgagacaatgcgcatcatgtgcaagtgtaatatctgaccggatagagtaaaacacttgaatacaccgagatgcaacaaaaaaaaatgataacaacaaaaatctttagactctggtaagatcctaccatctaacttcttcctctatttcgatggtcggatacgttttcttactctagtccagtagccagaaataagctacttgtggatgcgacctagttgcggcagcctccctcatctccttatccatagccatcaccatcacactcacacatgagcctcattgcagtggatattgtctccacttcgtgcccccactgccgccaccagctttgtcgtccgctcgtcatcactgcgagtcttcatcgtcattgccaaaagccttatctaagccatgcacccccatcggcaccgcaagctttattgtcgtatcacccactccggtctccactccttaatgttgttggaaagtttgtttttgggatgaaatgattggggtgagagagaggacacgtaggagatggagaaaagcaaaaaagattatgttagcgtggagctcaccacgctaaccatccaacactcaaatatggcaaatgattatattagaggagttgggagttttcattctgaaaaaaagggaatatgatacgttgatggatattgacagcttcgatctcatgtttgccatcgctcgatgaactcacttagaacatgctcaatgtcgtgaccttaggccattcacagtgcaacatgtttctatgaggagcctcaatatgccacataggacgagatatcgagtatcaattctctttatcccatggtgcaaaggagctctagctgtggctttaattttttatgtcagcccataacattttatatttaagtcctcgtagtttttttaatttagagaatggttcgaattgtacacaaaacaccctaaaaaagggaagcatgtataaaatctatcatttctcattttccacattccccctctagcgccgccgacgcctctcccattccaacccccaccagcacctctcccctccccgccagcgacccacgttccactctgtccagtcgccatcgcctctaccctctccctggcaccgcctcgatccgggcggctgtcgagcagatcaacgcagaaatgaggccgaaggcatctccggcgccacggcaaggaagttgcagctccgtcctctcttccttttccagtaggcggcagcgggggcgataggtggcagatcaaaaatgggctcgacgacggcgggatcggtggctcgctggcaagaaggcgaagacgacgaggagggctcctatggtttagatccgaggtcattgtgaaagggacaacgtacggcgacggtcccatgtctcgccgtcgctgcccctttctctggctgccggacttgggagggacactgggttggttgtgggcgtgggggtgtgggggcccccacgcatcacgagggcacgaggaggcggggacatgacctccccaacgcaagttcttcctgtcgcttcacctttacgcagcctcagcctgacaaaacctgacgtgtttcgcgtagcaaccttgggacatggcaaccgaaacccttgctggcgcaccgaggcaccatgaacgggctaaagtgatagctgtgatctctagctaggcccgaattcctgtttaggggctcaagtgccaacatgggctgtgtttagtttttaaaattggggagaagtttaggaaaagttggtagtttagaaaaaagttgggagtttatgtgagtagaaaagttttggatatgatgtgatgtgatggaaagttaggagtttgggaaaaatttggtgtgaactaaacaggattttgtgaaacttgaccctcataacgaagaaggattataacgtgaatgaatgttttgaggagatccatctgataaccacatgattacggccccgtcgacgctgtgcaccaaacacaataaagacatggacgcttccagaaggagccaactaggcaaccgccaaccgatcggaaaactctccgccacgcgacgcaaacgaatcgcacttcgcagaggcgaagcgaagtagcgctgccttgccttgtcgcccttccccttcgactccattccctcccgcttctcgcgcaacgctatcccgccgccgccgcgtgtctccccaatcccaatcactagcctcctccgtcgaccgtccgccttcccctgagggcggcctgcgtctgcgtggctgcgccgtgccgccgtcgcgcccccgcagcttcttgcgtcttgctgcgcgccgtgccacccgccggcgcctgcgcctgcgccttcctttaccgggctaccaccctgcgccgtctctgactccccggccggcggtcgccctgcccgctgctcctgcacggcgtggctgcaccctagcccctgcccataactccattgtaacaccgcccccagctcgattgccgcctgacacaaggcagacagaggtatgaatctggccttgaattgaatagttgtgagtcttaatcggtacggaactatggataatgatgcaaattgtagtgaatcggcaatgttaatcttagaagagtagattgtggtgcagattaaagaaattgtgttgtacttattttatctatgtaagatctttaatatttgaattatttatatttatatctttgcaactttcaaactttaggtgttgattttagtcgatttgtgatgctatgagatacaattgctttattatgtcataatccgagcaaattttgtgggctaatggcgttattaaattttggaacatgaagtaggaacacccaacaagaaattcctggagctgccattgcggcgctgccttccatggagaccgagggctggcctgccctccagcctctgctgtgcctcgcctggatcgccactacactccccatcattgtcgccgcgctgccaatccccgcagctgctggtggtcacctccttcgccggctgctctcggccttctcctcccgcggcaagaccgtgaggccctcccccgcctcatcctctggttcctcctcttctaaggcggtaagatcggttcaaggtgccgcagcacctatttgctgcttcgccttttctgttatcattcgacaatcccatggagttagtatgattccttggtaaacgaagcttggttagaccttgataagttaagcgaaacttgttcaaagcaaatataggtttgggttggtttgaaaaagatataaccgtggattgtttaaggccaaagtagctagctactgttttgtagtgtttagttgatgcaaatctgaaatattatcgattgattgtgagaagatgatacatttggaagaaattagttcttaaatgtttgggaaccacagttctggacttaaacaatttttttaattggtgtttgtctacaggatatacagccagcttttcttgtcaacttggagatttagttatgctaacttagctatacgaaaaatacataccaagccagttttgtgagtaaaaactaacattatatagtaggatcgaattgattcctcatcggcttttcttgagctatttttcatccaattgatgatcaattgcacatgagaacacgcaccaaatttgtagttcttctcatattcaacttctgtataatgctgataatctcagatcgatcttttctaatctgcagaagttcactgttccacaaaaatacttcatgcatttttatgtggtcggagtgctggcaacaacaattttgcttctggcaatatggttctatgcatatatgaaaatgacaccattattgcctgagtcatcaagttattccacaattgccagccatcttgtaggctcaaattcattctcttttggtcgtgttcactcgcgcaccatgggacacaagtatcatgtctggcgaacagtatttgtacttctattgatggaaattcaagtgctgagacgactatatgagactgaacatgtgttccactacagcccttctgctcggatgcatattgtaggatatttgacgggtctattgtaagctccagcttgctttacatcctttatgttctatatctccatggcacatttgttgtgaaaaatatcccacttgattagttatcatgtcctttactttattctgttgttatgttacatgattttgcttaaaggtttctaaataattcttgtatgcagtttctgcagctcatacatgtaggctgtccacaaaatatacacacatctaatgagttaatttactgcatgatttgtcattgacctgaactgatcaaaagaaataccacttcggtagaaaatagcccaagtgatgctgataactgaattgttcaattcttgacattttatttgctttcttctgccatagtgcttatattaggaagaggatatgcattcatgctacccatgatatttttttcatactattgttgttgttcttttgttttcatgtataacattttcagattgacttatagtttggtttttcttcatgccagctattatgtagctgcaccattatctcttgctagctcttgtatccctgaagcagcagagtatcttcaaggtcaagtagctgagttcatagtaaagggtcgtgcgagaatgccagatcttgtaattgattcatcatctctactacagcctcttctgaagttggggtggacccagtggataggtgctgttatattcatttggggttccctccatcagatccgttgccatgcaattcttgtaagatctatatgctctctaatgtccctatgaccctagatatactagcaagtttcttttacatatatgggcagcatcagaaatcttcctaaaaatgaaaagaaaagaaagaaagaaatccacctatatatgctgtaagttggaactgtcaaactgcaaccataacttgttagtgtaaagctgaaggtatggcttgctggaagtgttctattttttgagagggtggagcccaccaggctttaggaaccccatttacacaaattgcttggtcaatcaacatcaggaatccttcatgaaatgccaatcagattcaatgggttatgcattatgcttgttcagaaactgtggtattatgcattgttgtcttggaaacttctaggctgcggtctatattttgaatttcatggtttgttttttattgcttttacagggaacgttgcgtgagcacaaagattctgatgaatatgtaattccttgtggtgactggtttaatcgagtctcttgccctcattaccttgctgaactagtgagtgtcttttctatgtcctcattttcagtatgtggcatatactgttttgcaaaatatggcaggtcttgttaatctgcttatttaacaacgtcaagttagattaggcctgtccatattgtcttgggtttgtcaataaaaatcatcttggggaagtttggacgggttccaattggtggaagcactagactgattagctcctggtccagcttcaactcctggctggaataggttgggggaaaaacagagaatttgcatgttgcttttgctgggatttagagtttttacactgaagctgaattccagtgcagacttctcatcaaatttgttctgttacctatttcatcactgtagttctctgagtgcaataccatgtgagagtgaatatgtccttttagtatcacccgtactgggaaatgcaaacattctttgcatggcttaaatatgataaaacaggataatattttctgaactttcatattatttcacttgtgtgaagcaactagatgactctaacatgacagcacatatgtttccatgtagcagaattggtgctgtttgacttgacagttgatgcagtagggcactgagctactaaaagagctcctgttgttttaaattattatggcattaacatttacagttactttggcttgtaggtaatatattttggcatgttggttgctagtggtggagaagacattccagtgtggttcctgttcgtatttgtggtacgccctacagtaactttttgaacaaagatagtcagaattcaactaacgcgcaattatcttctacatttagtttcttttgttttttgttccagtagattgaactatcttttttctttttcatttttgcagatcacaaacctgtcatttgcagcagtagaaactcacaagtggtatcttcaaaagtttgaagactatcctcgctctcgctatgccatcattccatttgtatgctagtgtctacgaaatggctacattatgcaaagcttatgtatttgcacacaattacgacatgtaacttagcttgatgtaaatgtgataacaatcatactacgtaccaccgtagaggctggaagtgttgtattgtataacgtagccacgcagaatgtacctgtgacacttcatgctgtgtgttatgctacacacttggatatttatcaacattcttaagcatcgggaataaagttcttgcagaattggattggaaaatcttcaagctgtgacaatctaggcaatgtcagttcctgatttgtgacttaatatcagagcacctatgtacgttaccagtagtaatctttgtgcttctacatatttaaattacatgccaattatgtcatcgatgaaacatgtttggtaatttaaacttaaatgttcgcaactcaaagtgatctagggtatgttgtgctcgtcctttgtagaaggaaaaagaagtgccgtcatgtttagagacctaaatacctgatctggtctggaaaacggaatacttcaggatttatcagagcgataccatttcaactttaagcaagatactttatnnnnnnnnnnnnnnnnnnnnnnnnnnnnnnnnnnnnnn

SEQ ID NO: 1403 - DNA, 1089 bp, Oryza sativa
agggagagaaaggggactttttatagtttttctttttataaaatcattttaactttgtttatttcttaataattataatttgtgctctgaaaattccactaaaatttatttacgcattttaggcttttaggaaatatacaaaaatcctccaagccttatttgacttttaactttgcacgttttaattgtgggaggctttcacacggattttaattattctaggcataatttagaggatgtattttagagtcgttttgggacgtgacagcccacatgtcatcctttctcctccctctctctcttttctctcccccttttctcttccccttcagacgccacgatggcgccggcggcctcgtcgtcaccggagctggagtgtcacgaccggaaataacccaacgggcgttccttacgtgcgtgcattattccttgtcctaggaggcaaggtacaccaaaagttgatacaattcagagtttaacaagcggaagcgtaattaattaatttattacattggaggcgaagacccagcacacaagaagacaaacgaaaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgtagaataaatgcaagggagtacaagggaaccataatatagggggttagggtttgcagtaaacagcattaaaagacacttagttgctcaaagctattttgtaaacacggtcctagagctatacaatattattaatcaaggctgtgaacccacacgaacctgccttaacccaaggcctacgatgattagaccaaactggcaacccaaccttgggtcccagctcgtcccaagccaacccaggccaaccattccacattttagttgttaagcagcgttttaagaattaaaaacactaacttgggtacattgctcggcttgcccataaccgagggagcggctattcgaataggttatactctgatcagagggggacatctttaccca

SEQ ID NO: 1404 - DNA, 7911 bp, Oryza sativa
  unsure (1)..(7911): unsure at all n locations
agtggggcccacgcggcagcctcacggtccacggtggaccggatgcacccgggctcgcaccggccggcgcggtatgccccacacgtcagccgcacccaagggcgcgggcggctgacagcggggccccacgcggcatccactcggcgcgcccgagggcgcccacgccggcgcggtcgcggtaggcggcgcgcccacgccccgatggtcgccgccggcgaccaccggcgcggcggagcggcagccgataaaggggagggaagggggaaaggagcggatggtccccggctcaccccggggcgacggtgccgacggaggaggcggccggaccagagggaggtgccggcgcggctcgggtcgacggggtcaacggcgttccggcggtcggcgaccgaaacggagaggtggacgaggttggcgaggatgcggcgaacctgaaggaggcggcgccgaggtgggaggcggtccggggcgacgacggcggcggaccggagcttggcggcgacggtggagagagagagagagcgacgtcgcgagctcgaatccggcgaggaggaagggcggcgagaggcggaaacggacggaggaggtgcggggagggtttaaatagggttggaagggggagagagcggccggaggggaaggaaaccggcgcgggaggtccggccgccatcaatggcgccggcgagatttgcgggggcaaatccgcccgtttgaacgcaagatatagggaaaaatggggggaaagggagaggggatcacggggagtgattccccccactttattgcacgcggggacggcgggaggcggtaggattcgcggcggcggtggcgggagcggcgggaggaagaggatgacgggtgggccccacccgtcagcgagggtggcgggcgggcccgcccatcatcggcgcgcgcgcggggagggaggccgaatgggccgcgggggagaggagatagagagggggagggagatgggccgaattcggcccattagagagaaggagggattttagggtttttctttttataaaattattttaactttgtttatttcttaacaattattatttgtgctctgaaaattccactaaaatttatttacgtattttaggcttttaggaaatatacaaaaatcctctaagccttatttgacttttaaccttgcacattttaattgttggagactttcacacggtttttaattattctaggcataatttagaggatgtattttagagtcgttttgggacgtgatatggaggccccctcctcctcctcctcctcatcctccgcagagaggcgcttctcgtcgtcggagtcatcggagttgtagtcgtgggcgcgcttccggagcagcttgaagatccgcgacggcgacgacctcacggccgccggcgacgggagagagagagagggagggagagaagcgagcgggagagggagagagaggccaccccacgcgcccctcgccgtcgtccaccccgcgcgcccctcgccgtagtggaggagccgtcggccaccccgcgcgcccctcgccgtggtggaggagccgtcggccaccccgcgcgcccctcgccatggtggaggagccgtcggccaccccgcgcgcccctcgccgtggtggaggagccgtcggccaccccgcgcgcccctcgccgtagtggaggagccgtcggccaccccgcgcgcccctcgccgtggtggaggagccgtcggccaccccgcgcgctgtcggcggctccgcgaggatccgcgacggcgacgacctcgcggctgccggcgacgggagagagagagagagggagggagagaagcgagcgggagagggagagagaggccaccctgcgcgcccctcgccgtcgtccaccccacgcgcccctcgccgtggtggaggagccgtcgtccaccccgcgcaccgtcggcggccccgcaaagatccgcgatggcgatgactccgcggccgccggcgatgggagagagagagggagggagagaagcgagcgggagagggagagagaggccacaccgcgcggcctgcgcccctcgccgttgttcacccagtgcgtccctcgccgtggtggaggagccgtcggccaccccgcgcgccgtcggcggccccgcgaagatccacgatggcgacatcctcgctcccggggtgggggatggggaggggccgtcggcaccgccgtccagctgcgacatggcatggatcgccatcgacgtcgtcaccgttggagagaggggaagggggaagaaacgttggggagaggaggaccatgtgggccccacagtcagtgggtccttgtattttttggtgtgtgaatgacatgtgggtcccacacatctatttttaattctaatattacataggcgccacgtcaacgccacgtgtgaagaagactcggtcaacactgccacgtaagtgccacgtcagcgaaaccaccctccaaaatcactaagggagtcaaattataccggtttcaatatttttgggagtcgttctatctggttttgtggttaaggggcacgaattagattcggacgacttttaagggagtcaaaatggactttttcctatttttttctagtttttctttttaataaactttgctaattgttattgttgcttaataattattttcggtgctctgaaaattcaagtaaaatttgagggctcattttagaccaaggagaatttattaaaaattctccgggccatattcgaatttttcttgtgcgcattttaatgtttgccaatttcttttcgcattttaattaattctattattcctttttagagaatgatttttatttcgggatgaatttatcaggacgtgacaaaagcattgcatttcttacatatgcactacaactcttagaatgtgaacaaagtgatccaagtggtagaagtattttcaaaaggcccattttgacctaaagttaaaatgttgtgaaaatgataaatattcaaaactactagttggacactctttcaaaaggtctttgatatgttttccaagctttagtttgcaaaaaaaactatttgtaggatcttgttttggagcaaaactatttttctctctacaaagatttataaagggaatttgaaatggatcccaaaccaagttagagagagttgacctttcaaatgtttttggtttttgaatctcatccaaaagaccaacctattaaaataaatttgatgcgaaaactcaccaaaaatcttaactagaccatatatggtcactttctagcacttgggtgagtttatttcttaaacctgaataattgcatcttttttggctcaaaatcatatttgaacttcatgcatattagtttatctcaaataccatttcattttcttcttttcgcatttttggaggaaggtattttaaaagagagcttttgtagccttttgctaaaacatggcctttactatcaaatcttgaattcatggagcaaaaaggagaattgcatcaagggggagcaatctgaatcaaacccatatcccccttgcttccaaacatgaatttttcaaaaaggttgcatccataccatttcaaaagagcctattttggacaaaagtcaaaaatcttatttaaatggcccatatttgtgaaaatcctttcaaatgtatcccaatttgtatttcaaatgtttttcaaggcctttggagtcaaaatttccatttgtgaaacaaaatagcaaaattggtctcaataggatcttttaggatcttgttttggctgaaaatgttttattttcctaaatcaaaatctattgagtttttagaaaagttttctatacaaaagttttagagttggtcattttaaacatttctctagttcaaagttttcccaaaataccaaccattcaaactctacaatcttttgaatttcagctaaaatcttgacttgactatttttggcctaaacttgcatatggtgtgttaagcctttagagccaaagttctttgtgaatcttggcttggaagtgtatctataaccctcttaaggctttacaaatgtcaaactccatggatttcaaatttgaatgtgatttgagctctcaactcaaatttactcaccctaaaggcctacaatgctcattttgtcatatcttttgatagaaaaatgatttttaagaaattattttttggaaaagttcctcacaagtataaagatcatatctgcaaggtttcaactcatttcgatttgatttgcaaagattttgaccttttctcattttgcgcagcttgctgatttttcagaaaaagactgattttgggctgatttgtgatttttgtatctccaaatggattgcaaatttgaagtagcttacataacgacttttgatcctcaatagttgaagtttacttccaaatttacttacatttttcagtggtcatttggatgccttttgaacctcatattgggtctccaaaatatgaaaaagcctgaaactttcagttggctaaaagcttgtgagatttgtttcttcaattcggttgagatcttttattttctcccaaaatgaaatttttgcatttggacatgaactatctctaggatttatggcatatttttccgagccttgttccataggtttctattgctaaatgacgccaccattgctatgtgctttttcagctaaacatggattgaaaagtgcatatcacttcttattgattatttgagcatgggggtgaaatataagatgtttcaagtactgagctctatgttattttgaaaacttcatgaatccttgagctcttttggatgtgttccttgcttgaactcttttggtttttgaaatgcccattgatatggaaaaaacccccccaaaaaaggggaaaatctaaatgtattttgactttgaaaccaacctcatggatagactcgaaattccaatcttacccaccaaaatacaaattgatccttgcttccaaagctaactacgatatcttgancctaccatcccaaattcaatcttctatatacaactggtctctcaacaaatggtcgtatctcatgatcatcttgaacccaacatttgctcatcattttcattcctcaccgatattacacacttgagcaacatacttccaatattcttaaccaagctcctcttagtgcttgacattcttgagaaaacctttggtgaggatattttaagagaaagtttaagtgctcaaactcaccccttctacatatggaatctattccaaattccctatccaaatataagcctctattagtaagggggagttttcctaaatggttcttttctaaatttgttgctttgtgcctcaaaaaaaattatttggccttgtgagtctttatttctttttgggcttttgtaattgcctattttctagctctttttcatttttgggtgattaatgtcaaaagggggagaatatttgaggatcccacatttgatcttaaagggagagaatatttgtgatatccttatgatcatagctataaaagggggaaatattctaggatcccacatcatagcattacatatgcatcatatgcataagcatgtcattggcatatatatcactcctatttactcaatgacatgcatggatataaatcaattgccaagcttcaatacaatgataatttatatgcttcatatccaaatgtggttattattaatggatttgtcatcaatcaccaaaaagggggagattgtaaagtcaagtgccttaatttgggtttggtgattaatgacaaatctaataatatgagactaacgtttttatgagcttttctttgactagtctcgtttggatattaaaataaaaattattagaggtatgtattaaacttcacatattctaacttggtctctcttgtggatccaaaatatagtgtgagctccgtcactgatcttgattgattatgtatatatgtgttcctttatatccatatgtatgcacatcttgagggggagcttattctatattttatttagtataatatctctaccttgatttgaaattatctttcatctcatctctctatattgtttatatcgggttattatctatcacaaaaagagaaaagattgaaagatcttggattaaacaatttgtgtaattgttgctttgatgatagatgataaaccgatgtttatgggattaaactctctttttcataagttgtcaactaggttatttcccgatgatgagatgtggtagatatgcattctttggtgatggaccttaatcatgataaggatgaaatgcatggagataaaacgatatgtaccacttcttatctcctactttttgataggttcatatatatgatttccatgttattgttatataagtgtgagactaatgtttactcgagtcgtatcttatttagtctcatttacattaagaacatggagatcatgaatgtatgtgttttatgttggtttacatcattactacatatgccttctctatgtgtataggataaacccccattggtcattctctaattatgcatatacttcttccatctcttgtatatttatttgtatgcatatatttagggggagcaaatcctatacatttattgtgcatgttctagatccctgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctccatttgagatgtgaaaaggaataggtcccactacgatgaggctaatgaatgacaccatgagttaatggtcaccaagccaaggacatcatcatgttggcaagaatgaagtcaagcttgtgatgagaataaagtcttgacaaaggatggtaaagacctcggcataaatatggttcaaccgaatggtaacaagtgttgatgttggctcaagcattgaccccaagttggatggcgcaaggcaaaggtataatggagctaagaatgttttcttagtctttttcccggtttcggtgtttggtgtagaccggatttgctagatagacgccgcactatcaagaggggtctatgaagcgagcatgtgtatgatcttgtgccatattagttcatatgcatgtaggttcatttggtgggctcgtcaagccaagtgtgatgagttttctcatgtcccaaacaaagagagaagtgagcacgtccaataggagtgagtgacatcttgtgggtatgtccggtgtatatcctttggagagtgagccctttctccctgtattaagttgtgtttcttggatgaattgttcatgggttggatagccctttggataagctttccatagagtccaagaacgtcaaattccgagacccgagtcaagagatatcgccgttttactaacggccggttgagctgaaaagtgacctgcggtctaaccgctgccattacggcggtctgatcgaagtatgttgtccggtctaaccaccactcccatggcggtttgactgctcatcctgattttgaaggaggtctcgtcttggcgatccagagccgctagagccgcagccggtcagaccgagcccctggcggtctgactgagccgtggacggtctgactgtccgctacactgcggtcagaccggccaggtagagtaggctcaattattgccctattttctagccgttacaaagtagtctggtctgaccggccacactatggcggtctgaccggcatagcatagagttgggtttttcgaccccaacggctagttttgttgattgggggtatatatacccactccccagcaacaagggcaaggttttggcactccattgcattatcttgaacccttccaagagctctcacacccatgtgcact

SEQ ID NO: 1405 - DNA, 3478 bp, Oryza sativa
agacggcttgtagaggtgttacccggtgacctctacgaggagattgtggaggaggcccggcgccggttgtgagtggtttggagttcaccaccttcggagtgaaggaagaactatcctagtgatcgaggcttgggtagtcctctccgtgggtcggctcccgccttgcccaccccttgacgaagggggcgtgcggtggcttcatggttgagtggtggagttgggctcgcctcaacggggattaggaaaccggcgagtttccgaacctcggtgaaaaattccttgtctcttgtctcctttattttgtgcaaatttactttgagcaactttacatactagagcttatttgtgctattatcaccctaggcttgcaaacctcaacataggctagcttctttgtgcacttacttaagactagttgatttaggttttgaactgtacaaaaccgttttgatttacgcttccgcatacaaaactcggttttagccaaaagttttaaaaccgtgttaacagtgaaatttagtaagcccggagtaatcatcgctttagagtcagcattgtcttcgaagtcctgagattagccgatgagagttatcaagtcatcagttgtcggattcttgctatattcggttaaggaaattgatctactaaaggaagcttatccagaagagaccaagttcaaagagaatgcggcatggcaagttatctattaattaggaatagtttgttagtttctactggattatattgctatattatattatcatcagccgattgccttcatatcattatatacattggacatatagccgatagctcaaaaccctatcgctatcagctggcattggctatcggctggcatcggctatcggctggaactactacatcggcttgtcagccgatcatctatttgatctactgtttacatatcttgtcagttgcaggatcaaactgactggcacgcccgcatctcatcaacctttggacctgcacaggagctaagcagatctcccaggccagtgtgtgtttttcgcatcaacacatttttgtcacgcccagtgggaccacgaattttatatccacatgtctgaagaagaagtcaatggcaagatcatggtcacagtggagaatttaacagaggaacagaggcaacagacggagcagtttgtagctgattttcaaatgcgttgtcttcaatgtttcatcatgacaccagaagggccaactcagaagactcgattccccaagccgatagttgacaaatacttcaagatacagttgatgaagcagttcatcgcgcattgtttgagttttggcgaatacattacaaaatttgatcaaggtaatagttgatgagttaattatttagaaaagccagctcggggggcagattgaagaacaacaacaacatcggctcggggggcaagcacatcagcggccagaagaatctcaaagacatcagaataaagaagattgggctgatagaattgcaaaattagtagaggagcagtttggacttagacctaaggaacggatccatatgtatcggcaaccatatcctcaatggtttgaaagagttccattaccacaccgatacaaggttccagacttctcccaatttttagggcaagatgatatatctacaatggaacacatcagccgattcttagcgcaatgtggggaagcatcggctaaggaagctctaaaagttagattttttccgttgtctttgactggatcggctttcacatggttttcatcattaccattaaattctatcagaggatggaccgatcttgagaagcaatttcatgattacttctttgctagagtcagtgagttgaaactttcagatttaatatcggttgagtagcaagaaggagaatcggctatggaatatattcagagatttcataatgtccgcagccgatgttatggtttgagcctaagtgatgagcaactagccgatctcgcattccaaggattgtcagcacctatcagagagagattcttttgccacgagtttgacagcctggttcatctaatggaaacagtatcggctcatgaaagccgattgcaagaagcaaaggaagattagttttggagttatcaagacaagaaattttgaagcatgaattctcatactccaaaactaggggggcatgtgttaacagtgaaatttggtaagcctggagtaatcatcggtttagagtcagcatcggcttcgaagtcctgagattagccgatgagagttatcaagtcgtcggttatcggattcttgctatattcggttaaggaaattgatctactaaaggaagcttatctagaagagaccgagttcaaagagaatgcggcatggcaagttatctattaattaggaatagtttgttagtttccttttttcggaaagttttttctttagtttctttcttgtccgacaaggactagtgtctccctatgggtataaatatgtatacccggggtcattgtaatctatcaatctatcgatcaatataactactctcggcacatcgccaccctctttaccgaggtttttacttatcatccgatggaacttggtacctcacgcggggctgcatcggttcagtttgatctccggcgaacgggtaagtcctacgttccgccggccctggtgaatctattggctacattggtgttgttcaagggttttgttgatatatttgcctacctgatatctcaattctatctctagttgcattgtgtttagagacgcatcggtttagttggaactgtctcggttaggtccgatctcctgtcttagccaatatatctctacaatcacattgctgttataaatagatttgttatatctatcacattagacatatctatcggctcatcgagtactatattatcatatacaatctcgtgcaacatcggttaggttcgacctactagattgttgttgataatataagtcttgttaagccgataggttcatgctagtgttttatcggggtgctagccgataagttatctggatgttgcatcggcttataaggattgcatatacatataagttggatttagcaaatccgcagcaaaggcttcattgatcaatctaatcttgtggattttactacatcggacctccagccgatgtatgctttaaccttcggatcaatgcttgttctactatatcatattgttagccgattggtttctactggattatattgctatattatattatcatcagccgattgccttcatatcattatatacattggacatatagccaatagctcaaaaccctatcgctatcagctggcatttgctatcggctggcatcggctatcggctgtaattactacatcggcttgtcagccgatcggctatttgatctactgtttacatatcttgtcagttgcaggatcaaactgactggcatgcccgcatctcattaacctttagacctacactggagctaagcagatct

SEQ ID NO: 1406 - DNA, 1480 bp, Oryza sativa
gtgtgtttttcgcatcaacaaaccacctattcagcccccctctagtcggcctccttgatcctatagctccgccctctttcctttgcacgccttcctctgcacatcgccacagctgcgcccccgcccagtccgccgccaaatttgcccctcaagccacagcgtccttgcccagatcggcgccggcaccgacctaacgctcgcctttgcgcatttatcaacaccaccatctgcccaccgcaccaactcgccctagcgccatcgccgattcaactttagcgccgtcaccgtttcaccaccgccacgtcgcgtaaatcgtctacccgattcaccggcggtctccggtcccatcaacgacaatgacaaactaatttactgcaacgggtgaaaaacttatatacgtttttcatacataacaatgccaatgacaatatttgtatggatcatttgtagctaagacaataaaaaaatggaacatcttcaatgaaatagcccaacctcgatgatgacaacatcaccgatgcttgctttacctaaaaataattggattattcatgtgataacatgaatataatctaaaaactctttgaatctcattcttgcaaccaataataggatcaatcaaatcctatattgtctcgcatggtcaagtctacacaaaatagagtcattgtgcactcttctctaaataacaattaaaaatatgtttatttttaatattatatccatatcatatgttatcaagaatagtagctatacttaacaaatatagtctgataattgcatatagatacatgcagggtctccaatacaggagaatagatgatgaaacaaaagtcgtgtaggagatggaaaaaaaatcgatggatgctatctaacccaagcatccatcaatttagcatttttttctgacagttttttcatagcagcttgtttttttacgatgttttttcttgcgaggttttttcaaaccagtttttagaaaaatttttcctcgcatgtatttttttaaaatttttacaaatgatggaaatattttttttctcgcccatttttttattttttacggatgatggaaacctttttttagcacttttctctggcctttttttctcacgcgttttttaaccgttttaatttctcacgcctttttttctttttagttgtacgatgaaaacatctaattttaaatagttagattatattagagatagagaagagatatatatgggctactaaaatgaatagaaatcgaacttttttgccgcgcttttttccacccttattattatttttttctccttcgttttttatttttacgaaccgtttttttgccacttccttagggaatcgaacagacctttttagatgtgaattttttaagtagggatgaaagtagagataaagatgtatacaaagtttatatatgaatgcataaaaaaatataaatgtatacaaagtttgtatacgtgtatataaagtt

SEQ ID NO: 1407 - DNA, 5228 bp, Oryza sativa
atcggactttctttttagttttttttcgctgttttttttatttgtgacggacaaaggaaacatctcttaaaaaacttattttttaagtagtactagaaaataggcccgtacgttacaacgggtgaagactattttaatcatattattgttagattttttctgaaaagtatatgggatttttatttgatagtattgatatctaatttagcacccttatttgggatgatggtcatatcatgtacgatgctttcttatgctctaacaagaattctgaagcaattaggagtataactcccgtcccaagttagatgcgagtttttaaaaggaattgttgtacgactccttatgtatttttaaaaacagataaacttaaaaaccgacttaaatacgaatgacgttgcaaggtatcaacagaaacatgtacattttttataaaaatagagatttccgtttgatttgagttttgtgctgtatattttcttattggtgaaaaaaaaagttcgttggagcaatttatgtggtatacttacatacatgcaacattccttgctgttgctggcccgttggatacgtgggcaactataaagagtgaaattcacggcgcccatgaagaatggatatagatataatagtcggatgataaaattaaaaaccaattcaaatacggatgatgtatcaaaattctgacgaaaacatctttagttttataatagaagagatagaaatatagtcatatagagataaaggtgtagaatattcaatttcggtgcagataatatcttaattcaatccatatgcagattccatgatttctctcgataatctataggaaagggaaacaattttatccaaagagaattacaatcattaatcgatagggagcagaaaatctccttgtattagtagcaccaactaatagcagtgcagcatgtatcaacaccgatccgtgccattacgtgactgattaattaaatgcaaccgtaatcaatcaagtctctggttacgaagtaaatccatgcggacgcgcgacgccaaccaacacaggagacgacgcatcgtcgcacgcagaggcgatacgtacgaaaatcaggcaaaaacatcttaaaattttataatagataaagataagtagacagatttattttagttagtaaccaggattaatttgcatatatcacgtttgccatttcatctaacgccatctgaattgatttccctgctatgctgtgttccatacggtgcaggatacaataccacgagctgattatccctcctgacttattcctgggctagctacgaacaaagattctataaagatgtatttgctattaatgtaagcgaacgcccagcttttctatattggtgagaggtgaatcagcaatgtgtgccttagtgcaccatttacctctacataagggtggaaacgagcctggctcggctcggcttgtaatggcttgcaacaaggtaggtttggctaggctcggctccggtaggaaaacgagctaaaacatgagctcggctgtttcttggctcgagctggcttgcgagccttccgttgaagctatataatttggtaatcattaagaaaaacaataacaaatcatcaacatgtagaaataaaataactttatatattaaattcatcaaaatatagatgataaattacatattgacaaataatatgttggaaatatagtcatatatcggcatattttaatccaaaatattaagacaataatcatagcatgaacaatgtggggtgatttagtgataaaatcaaacataaacaggagcatgcttaagatagaataagcatcatcatcatacatagaacgcaatagcattgcgactaacagaaatatcaaaaaccgaaataacagtagagggttataccctgtgaattgaaagtccctccgctggattgtgaggcagaactgcctccgttggtgttgtcgatcggtgcaccagctccagctcccgctcccggcgcgccatctccaggcgcggcagacatgggtgatgcagacgaacggtcgaagacgaacagaggacgaggagcagtcgtgcagaagcactccccaaaaacctgatcacccacctacccggtgcagatctcaggcgaaggtgtggttccagaggccctgctcgttccgatctctcgtgcacgcaagcgattagaaccggggaagcagtagtagcagcacaggcagcggcagcgcgaggaggaggaggaaccagtgtttggaaagtaaccgaagagatctgatcgggttgcctctttccctatagcgcaggagagaaatccgcccgttgtcgcagtaacgacgcgatcaataggtattgaattgcctacccgttacagaggcaatcacacggggttggattccgatccgttgcaaaaggataaagagagagagagagagttgcaacgcacgccacgcctctccctcgcccttgcccacgcccatggcctaggcccggccccgcgcgcgcgcgcgtgtggctttctgatccccacctcaaccggtcaacagggagcctctaataactccctatttaagttgagatactcctcttttaattcctagggtggtattattatccttaacatttattatgggcccttgagatttaatagaaaaatcgggcctagcccatttattctaacaatccccaccaaatttcatggcacataagaaatgttctcaaagttgtgcctatttgatataccagtgttttggtggagactgttaagttgaacttccacctaggaaatgagctacatcagaccacaactgaacaatggactatgccttgaattgtcagtcttgtgtgatcaggtttcactcaaacccttgactggtactgggatgccgtttgcatcccctctgtttggagcatataagtcaaactccagccctttcatgagtatctagagatcgcccaaatctcatagactgtgactagcaatcgaactcatataggtgtgttccttctgagatgttctgcaggtcaacacctctgcttagaaaagccactcggatcacattaaggcataagccatcctaccatgcagagtagaagagaagtacatcatgaaaatgagcccttttcaagggtctcttatctcagccacacaatagtttgtttcgccatccaaattcacgggatctccgatcacaatggacaggtttccactattgtgcaaccttaggtgggtatcaagccaatttccctcgatgcactgtctatcacattacgtagtagccccttggtaaactaatctaccagatttttatccgtttagacatagtccaatgctatcactccggagtttttctgctttctgacagatttcagtcttattttgatatgtctagatgacttcacgttgtcctttgaactgttcactttaataatcactgtttgattatcacagttcgttaggatagctggcactggtttttcaaccaccggcaaatccatcaggagttcacgaagccactcggcctcaactgtcgcagtatctagtcctgtaagttctgcttccattgttgacctcgttaagatggtctgcttacaagacttccaggaaacagtgccacctccaagtgtgaacacatatccacttgtggcttttatctcatcagcatcagatatccagtttgagtcactatacccttccagtacttttaggtacccggtatagtgaattccatagctcatagtgccctttagatagcgcattactctttccaaagcctgccaatgatcatccaccagatttgagacaaaccggctcagcttgcttacagcaaatgagatgtcaggcctcgttgcactagccaagtacatcaatgaacctatgatttgtgagtatctcagttgatcccttgctattcttcggtttttccttaatagcacactgggatcataaggagtaggagctggcttgcagtcgttgtgtccaaagcgactcagaaccttgtccacatagtgggattgcacaagtgtaatcccaccctcatctcctcttagtagcttaatgttaagaataacatcagcctctcccaaatccttcatttcaaaactcttggacagaaagtccttgacctcctcgatcacattgaggctggtcctaaagatcaatatgtcatcgacatataaacacaagatcactccttctcccccaccatagcgatagtacacgcatttgtcagtttcgttcacaacaaagccagcagatgtaagtgtggtgtcaaacttctcatgccattgcttaggtgcttgcttaaggccatacaaggatttcaacagtttacacaccattccctcccgaccttctagtgcatacccgtttggttgatccatatagatctcctcctccagctctccatttaggaaagctgtcttaacgtccatctgatggacgagaagagcatgagaggctgccagagcaagtagtactcgaatcgtggtcaaatgggcaactgatgagtaggtgtcgaaaaaatcctcgccttccttttgggtataacccttggccacaagccttgccttgtacttttcaattgtaacctctggcctaagctttttcttgaaaacccatttgcatcctacaggcttggacccatatagacgctcaacgacttcccaagtaccattagacataattgagtctatctcactacgtactgcttccttccagtagtcagcgtcaggagatgaatattgtcacgtcctggtaaattcatcccgaaataaaaaaaacattctctaaaaggaataatagaattaattaaaattcgaaaagaaattggcaaacattaaaatgcgcacaagaaaaattcgaatgtggccggagaatttttgttaaattctccttggtctaaaatgagctctcaaattttacttgaattttcagagcaccgaaaataattattaagcaacaaaaacaattatcacagtttattttaaattgtactttaattatttacttagtcaatttactttttagggtttattcctaactaattattcattattcatgatttataacctccgaaatcaaaattcaataaaataatcgaacaaaattggcatgatgcaactttatttaaaaagtttttgaagatccgtatttttagagtttagattttgtcgtcgaatttttagggtgttacaaacctacccccttaaataaatatcgtcccgagatttcttaccaa

SEQ ID NO: 1408 - DNA, 9607 bp, Oryza sativa
  unsure (1)..(9607): unsure at all n locations
cttgttcttccggcactcgtaagcatttctttaattgagacacatggaagactgggtgcacatcagcgatattctctggtagctgtaactgatatgcgacttctcctcttctagccgtgatttgaaagggtcccacgtatcttggtgctagttttcccttaaccctaaacctttttgttcccctcatcggagaaacctttaaataaacgtaatctccttccttaaattctaggtttcttcttcgggtgtcggcataactcttttgtcgtgattgtgctacctttaaacggtcacggatcaagcgaaccttttcttcggcctcattgataatgtcaggtccaaataccgcccgttcacctgtctcagaccacatcagcggcgtccggcatcgtcgaccaaacaatgcttcattgggggacatcttcaggcttgcttgaaagctgttgttgtaggagaactcggcgtagggcaaacacctctcccagtctttgctaaaatccaacgcacaagctctcagcatgtcctccagtacctggttggttctctccgtctggccatctgtctgtggatgataagctgtgctaaaagcaagataacttcctagggcttcatgtactttttcccagaaatgcgaggtaaactgtgtgcctcgatcggatataatcctcttaggtataccatgaagacacactatcctggtcatatacaactcggcaagtttagcactgctatagtttgtcttgacggggatgaatcttgccgtcnnnnnnnnnnnnnnnnnnnnnnnnnaaatggaatcatatcctgttgcggtcttgggcaatccaacaataaaatccatacctatctcatcccatttccattcaggaatcctaaggggttgcagcaagcctgccggtcgctgatgctcagccttcactttttggcatacgtcacagagtgctacgtattctgccacatctctcttcatgttgggccaccagtatccttccttcagatcttggtacatcttcgtacttccggggtgcaatgagtatgccgattcgtgagcttcctttaaaattaatcccctcagtccaccctgttcgggtacgtaaattctctttttataccatagaacatctttttcgtcgattgaaaattcctttgcacgtcctgcagctaagcgttccttcaactctcggatttcctcgttgtccttctgggcttcttctatttgggttctcaaaagaggttgaatgtccagggtgtttatctgtccatgaggtactatatgtaggttcagctaagctatttcctccctaagctcaaggaccatcccttccattctcagatgattgcaatggctcttacgactcagagcgtcggccacaacgtttgctttgcctgggtgatagtgaacctctagatcatagtccttgattaattctaaccatcgcctttgcctgaagttgagatctgactgggtgaagatatacttcagactcttgtggtcagtgtagatatcgcaatggtttccaattagataatgtctctaaatctttagcgcatgaaccacagctgcgagttctaggtcatgggtagggtagttttcctcatgtggtcgcagttgtcgcgacgcataggccacaacttttccgtcctgcatcagtactcctcctagtccttgccttgacgcatcacaatatataacaaagtctttcctgatgtcgggaagaactaaaataggcgccgaggtcagcttttctttgagctgctcaaagctttcctgacactgttctgaccacataaaatttttttccttcctgaggagttgtgtcattggtcgggctatcttagaaaatccttcaataaaccttcgatagtatccggccaaacctaggaaactccgaatttcggtcaccgacttgggtgctttccattctgtaacggcctctacttttgcagggtccactgctactccaccggccgagattacgtgacctagaaaagcgacttccttcaaccaaaattcgcacttgctgaattttgcatataacttgtgctttcggagtttctggagcaccaatcgtaagtgttccgcatgttcttcctcatctttggagtagattagaatgtcatcgatgaatactaccacaaacttatctaattaatccatgaatactttgttcataagattcatgaagtaggctggggcattggttagaccaaatgacatcactgtgaactcatacaatccatagtgtgttgaaaacgcggtcttgggaatatccttggtcctaatcttcagttggtggtatcctgatcgaatgtcgatctttgaaaacaccttagctcctttgagttgatcgaagagatcatcaatccttggtagtaggtacttgttcttaatagttacttcgttcagtgatcggtagtccacacacattctcatgctaccatctttcttcttgacgaatagcactggggctccccaaggtgacgaactggggcgtacaaatcccttttcttgcaactccctaatttgctttttaagttcttctaactcattaaccggcatccgatatggtctcttggatatgggggcggttccaggtatcaggtcaataatgaactttatgtcacgatctggtggcattccaggtaaatcttctgggaacacatcaggaaatcgctgcactacaggcattccctttaggggtagcatggtaaatatacctccggcacgttcggttagcctaggatcttgatccatggttgctctcatatccgatccccagggtgtggttaaggtcacctctctacgcccacagtcaattacacctctattctttgttaaccaatccatgcccagtatgacatctagggtctgaggtattaagatcataagattggagggaaacaccacgtccctaagacgaattggtacgtctatgcaagcatgactcacagttatctcgcccccaggtgagtgtactatcataggctttctaagtcccactagggttaagttgtgcttttgactagccttcagagatataaatgaatgcgatgcaccagaatcgaagagaactttaaccggggtagaattgatagagaacatacccatgagtatgccctgatcttcctgggcctcttcagctcggacatggttcacttgtccgcgcccaagtccagtggcggtcctgttagattgcggagtcttgaatagacctcgcccggtaacaggggtagtagtgccacgaacagtcattgcattcgtgccggtccggacaggagtcttgcgtggatgagggcagttgttggcgtagtgcccataccccccgcaattgaagcagttcacattcatcttggctccaggggcagccaaagttggtgtaggggtgcggttctgaattgcaactggcctgttgaagttgctaggtgcagcgggacggttggttgccacgatagggggcttccatccggatgaagtggctcccttgagtcgctgaggcactatctgaggtaggcgactcatagcaagcctcctcttgcggttgtgttccaccgtcctttgatcgttctctagcctgacgactttgttgatcaggctctggaaactctcgtgatcctgcccgatcataggtccacgcaattcatcattcagcccttctatgaacttgtcgatcttttcttcttcatccgctaggtctccaattgcatagcgggccaactgagtaaacttgttcagatattcttgcaccgttgtattcccttgccgcagccatctaaactcgttcttcttcatgcgcatcactgcagcaggtacgaagttctcgcgaaatgctgcagtgaactcctcccaagtgggttctccagcatcgttttcccgagcttccttgtaggtgtcccaccaatcactagcgggtccttccagttggtttactgcgaagattactttgtcggtttcgcgtaccctgacaagagtcagtttcttctctatgatgcgtagccagtcttctgcctccataggctcatctgccgtagcgaacgtgggtggcttggtcctcataaactctccaaagctcgatccgccgcggttgccttggttattcgcaatggcttgtaggagttgggtttgagtggccataattccggccagggtggttaggtccggtgtctgagtttcttcattgctggtcgacgcccgacgtcggcttgccatcagtgatgtctggcttgatctctgactcggtgttggtcccctctgtctcggagtcgacctggatcggagtgtccaaactggaacccagctgcggagaaggtgtagggatcagtcgggtgtgcacaatctccggggcaggtggctgtgtcgctgccgggtccactaggtaaggtgctgactcggtagctagcatactagcctctcccaaaagagcgtggaacgccggtgggtacggcggggtgaggaagaagtagcggtcacggcctactgctgtggaagtagaagcccctgtggtgctgatcttggctgctcgaagctgctcctctagctggctgacgtgctcctgactctctctcagctgctcctcaagagtatccatcatcctgcggcgatcgttatactggttagataactgctggaactggtcgccgtggacctggagctgtgccttcagtgagtctatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtggtgagcaaactcggtactcgctaactcagctcggtggatagagctgagtcggaggaaggcctcccgggctgcatcctgcatcgcggtctctggcaggtctcggtggtgacgtgtctgaaagctgtagtccaactcggaagggactcgggggtgaacctcgaccagagcctcccaaactgagccacactgtctcactcggtatgacgggaacccagagtatcgcagacgcctcaacatccgatgcagctcaatgacatacccctctgattgaggtaagctcaactcccaggtagcgggtgaatccggatctgccatctaattttaagaaaaacccaaagtcagttgagagtaaaacttgttttgtaaagaaaatagttaagagtaagatgaaaatagcgtttttatatagcgtttttatttttgaaagtattactaaatgggaatttctcccttagccaacttagaaaaggggtggggcgccttttggtcttttcctacagtcgtatggctctgataccagctctgtggacccccgtttttataacaggaatcaatcgtgtaaacagtaccatttccctggatcaaatagtctggtacacacgaattcatagctgaaataccaaatacacatacacgaatgtctagtacgaattattacatcataagcctgcaggcatagtcttaaatcatcggaccgagcggtccggaatacatccaaaagaagaaataggtaaggcaacagaatttaagcaacggcatgccattgccacaggcaacgaccgtactaagacctactgggcgccttcgtcttcatctccctcctggtagtaggcatagggatcctccgaagcttcatctcccgcttctgataaattttatatttgcaagggtgatgagtaccaaccgtactcagcaagccaccacagcaatgatgcacatgacagaggatttcaaaggatggctatggttcatttgcgcaaagcaagttttgtaattcttttcacaagcctaagacctagcaaagactaatcaagttttaataccattgttcatattaaacaatgacggttctgtccaccatccattgtgatcccaaggatagcttcccgccattgagtcgttatgattttctgaggacgtccacgtttccgcctctcaagaagtggctccatcagcataaaaattatcatgcaatattccatcccactcaagttaaagaatttagagtctagccaagtgtaatacatgtcccggtgctcattaactgcaagcacggctattcgaatagatttagtttactcacactgcagtggatgtacactttacccgcactccgcgactgcccaacacatgagcctcatcccaacacaagagacgcgtcacggcaaagcttttcgataacctcgcattggcagtacccgcttcgtgaactttacatcctcatgcactctaggcgtcatacgtttctagcagtgagaggagttctggcgctcccgggaagggaaaaacacacactcctacgttgcttcttgtcgttgaacccagtccatcatgattgttctcttatgggtatcctcatgtagtattgccaagccagcctctgaccatccggaacgggcatccgccattcacctggccatccgaaccgggcatccgccaacagactgcttgccacatcacacacctaaaagaagaccactacgcatggatactgcctccgctcagctatctactccgctaggtctatacccatacgagaagtgcggttgtacggggggtcgtttcatgcttaacttcatggttcggtccttaattgaccagggacggcactagccttttccggacaccacccaaatcctccagccgccccagtcgaaaacagttgtttaactttattttcctttcacaaatcatgtcatcaatatcatggcaatgtggcgctcatgtctctacatgccgcatctcaattaccttcccaaaggtaattgcccaagcatatagcatttgataaatatgagtatgcatgattctagaatagcatttctaagcaattgtcataattgactagagactcatacgtaaacatggttacgaaggaataaggggtaaacaataatcaaggcatggcataattacaagtaggatgttcataattgcatgcaattttatttgtaaacaaaacaatttcgcaattgggatcaacatgttcaaggaatagtgatgacttgccttactcaaggtcttgcgggtcttggccttcacctggatccgcggctccctcggtctctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattacatgatttaatttagtctatgactagatgattaaatataatacacggctaaaatccctaggaattaaatccgaatttctaccgtgaattgattacttatagggattacccaaaaaaataatatataataatccataagaattcatctatttgtttagttattaactacatctaaattattaccgcgaattgatttcttatagaaattgccaagaataatccataatttatattaaattttgcaattctatgactataattaacctataaaattccaattattttaaattttctaaacttccctaatctccctctaattttctatttatttcctttttctttttctccctttctttttctttttttttctttttcttttcctctctttctttttctctctctgccggcctctcttttcctctccctctctctctcggctctctctcccacccgagcggtggcggcggtggacgcgaggggaacgaagggcggctcaccggcggcggcagcggcgacgacggcggcagcgacggtggcgcacgccggcgcgggagtggcggcacggcggcacgagaacggcggtgcgggggcacgggaaaaatggcgcggcaacaccttaaatgcgnncncggtagcggggagatgaagctccgncggcantnnggngnnggcccggtanaaaggnacgtcgcctaggggaatgggtgtggggganaaaanaagggctgggggttttatagggtgtgagagagagaaaaagaggggcggtaaagagggtagcaacgcggcgccgggggggcacaaagggtccggccaaggggccgcgaggcggcgatggtacgcgcgcggcgacgggacgcacgtggcgatgggacggcgcggcgcgacggcgatcgcgacggcggtgtagggctcgaggcggcgacggcaacggcacgtggcgacggcgacggcgcgcggcgcagcggcgggcgatgggacgcgcgcgcgacgagacgggtggtgacagggcggcaacggtggcgcgcggcgcgaggcgggtcgcgacggcgacggcgacaacgcggcagcggcggcacggggcgcaaggcaacgtgacgggcgagcggcgacggcgacggccaaaggcgacggcggtagcggcggtgcgcggtgcgaggcgtggggcgcgggcgcggcgtcggcgcggcagcggggcagggttaggctaggggacctcgtcgaacacctggcggccgacgaatagcgtcgttttctatttacccgatttaagcctatttatttatttaaaattgattctataaaccttaatttttgtacaaatgaagttcactcaatatttgtgttattccaaccaatgggtccacccttgattaattttacccatattttatttttatataatttccttgaatttaattagagttaattcttattccgacacttttcaatttaattgatataaatatagtcgtaataatattttactcatttctatactcactaaatattattttaaattgtactttaattatttacttagtcaatttactttttagggtttattcctaactaattatccattattcgcgatttataaactccgaaataaaaattcaataaaataatcgaacaaaattggcatgatgcaactttatttaaaaagtttttgaagatccgtatttttagagtttagattttgtcgtcgaatttttagggtgttacagatacggaggaactcggcgagtttagagtgttgtgggggtggtggtggagcattatgttgtggcggattttggatgtggtggaggaaagcagccatcatgttggcctgctgggcgaggatttgggtgaggatggagttggtgtctggtggtggtggtggaggcgggggaggaggtggaggtgggctgccatggttgttgtggttgctaccttcgggttggttgccatcaccggtagtagcacttctcctggttgtcaccttctaaaaatcccacacagacccagcaaacagagagagctgactattaaaactaatcacccacgactaccataattcttgaatttattattgctattaaatgggttcattaaggttcaactggcttaagcaaataaaataaagacaggctccga

SEQ ID NO: 1409 - DNA, 786 bp, Oryza sativa
aactgggattcaatatgttcaaggatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgcgttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggaacgcgcggaccgggtccacgggagtggggcccacgcggcagcctcatggtccacggtggaccgggcgcacgcggcttgcgctggccggcgccgtgggtcccacgcgtcagccgcacccgaaggcgcgggcggctgacggccgggccccacatggcagccgcggggcgcgcccgaaggcggccttgccggcacggtcgacgggaggcggcgcgccagcgcccctatggtcgccggcggcggccataagcacggcggagcggcggccgaaagaagggagggaagggggaaacgaaatgggcggtccacggctcaccccgggtcgacgacgacgacgggaacggcgactggagcggaagaaagcggcggcgcggcaccggtcgactgggacggcggcgttccggcggtcggcgggcgaaacggaggggtggacgaggt

SEQ ID NO: 1410 - DNA, 574 bp, Oryza sativa
cacaactcagtcagctaattcattataatatgaacagttttcctactgatctactccatgttcatgtgaaattcaaatttttaatttgaatttggtgaggcgacgattagttagttggccaaagtgtgggggtcgcaggcgtcgaccgcgcaggcgagcacgtccttgtagcccctggtgatggagaacgcgtcgagcacctcgccgtcgtcgctgcggatgaactcgagctccagccgcgagtggtcgcgcgccgtgagcttcacgtacccgtagctctcgctcctcgccgcgctccactgcggccactcgccgccggcgtaccccctcagcctggcgccgcccgtgccggccacgacgtggatcgtgccgcccagcgcgccggtgtacgccgccgccggcgagctcccgttcccgccgccccccgccgccgccggcgccgccgtgcaggtgttctcgtagaccgggcacgtccgctcgtagttgtggacgtggccgtagacggcgaggtcgacgcggtgcttctgccacagcggctgcagcgtccgccccatgggctccgagaagggagccc

SEQ ID NO: 1411 - DNA, 264 bp, Oryza sativa
acaaagcacatgcaaataaatctacgcaacaggaaacatcttacatccgcccatgaccgtgggcacggttgttcttacagctagttaacctctgcagagggggtacactttacccacacgacattactaacccggatgtagcgcccgttccgtcgtggcgcctagcgggaaaaactatcttttaaaaaccctatttgcgaaaacagtttccttgcttggtgtctaaagcccgagccatctcagatctcaaatccccgatctatc

SEQ ID NO: 1412 - DNA, 709 bp, Oryza sativa
  unsure (1)..(709): unsure at all n locations
tagttctgaatcttaactcttgaacggtgatcatgtaccagtcctggttgctgtatattctgtaccactctagtggcaatatattttgcatgttatttctttgattggtaaataagcaaatcctgttcttcccatgttcaggcatagctaacttcccgttcactatatccagcattacatgtctgttttctgcagcatgacctgcatcgaagatcaagagacatttgtttaacaaaataatgatcaggtctcaagatacttgtgataaggagctagcaatttactgcctaacctttttttcctattgaattcattataatcatattngtggctagcaacttcactctcacttatctgaaactgatttctgacaatgctagttaaggctgtgggcatatcttgctctgtgagtttcacgcatcatcaattgttctattgataacaaattcttcaggtggaggcagaaaatcctgttgaattggttcttgttatgacagttgaacctggctttggtggtcagaagtttatgccagaaatgatggaaaaggtattattactgcatcaagtgccatttagtattcctgattgtttatagtttatactgtatttttgtgtatctatgttttacaactattctgatcattttgaaacatgggcgttaggtgcgtgccctgagaaagaagtacccatcccttgacatcgaggtaca

SEQ ID NO: 1413 - DNA, 9104 bp, Oryza sativa
  unsure (1)..(9104): unsure at all n locations
nnnnnnnnnnnnnnnnnnnnnnnnnnnnnnnnnnnnnnnnnnnnnnnnnnnnnnattagcaccgatcaatggcctagcttttgtttgttggttcgtagtcacaggtttgaactttgaagtatgaattttcttttcgtaattaagcagtgttttgtggcagaaagttagctttgttgggttttatttgcttttggccgtcgctttcttgatgattcacatcttgcatggaaagtgcgaaataacaccattcacagtatgttccttagttcgatgtaattgtagtagtacctactccatgactaagtgcgatatcccgcagaaatgagtctaattctctgtttgagagagcttctagcagctgtaatttctcttaaagtcttcagctcccgcaaacaatgcaagattttcactcagattcttaaaatataaaatatagagtctagagaataaattaaactcagaaactgtgaaacctagttttctaaaaaactaactatcaaccaaccgtttctcagaatcttaatccattatttatagggcctaattaaactactagagtgggatcgcccaagcactagatatatcttcatcaagcatgtatagttgtctactccctctgtccctaaatataaaggattttggttggatatgacaaattatgtcatattcaaccaaaatcccttatatttagggacgaagggagtactatacaaatatagcaggggaagtggctactatgtccacatctcaacgaaaagaatgacatggatgcctgacttttaacaaagagaaacttccttacgccctgtcgcctttccgtccaattcttcctgtgtccctagttaaattttgttccatctttaaatgctgcttttatacattaatctatgtaccaaacatatatattttttgaaatgtaatattgccctcgccagtaactataattgataagcctccccacaaaaaaaaacaattacagcaacaaaataattttagttatgtcaacttcttttgaaaggaagtaaaaattacccactttgacatatacttaaaaaacaactaaatttgaacttttgtataatttgcttaaaaatgtggtggttttcatttaatcaaatttggtttaaattaattcagtcaaaaggtgttattaaaaattccggtgaaaaataccattttcttatatgtgattctgttaatttcagatccacctatgaattcttcaaaatttttgaacttcactcaaatattaaaattttggtttcacatttgaggaaacaaaaattggttactagggtaatttttttccatttgaaatttcgtttgatttgtttaaatttatttgaaaattcagtttttttttcttttcaaatttgggtgaaactgttctttcttgtgctttggtaattccagccctacaatttttctcaaacagaatttcttcttccccttttttcttgaggctaacggaatttcttcctagcgagggctttgatttcggtgagaaggctaactaattacttacagtcaggggcggagccacgtgtgggggcagcttgggcttgggccccacacgtggcaaagaatttcaatggcaaaataccaaaatttagatagaaactcagtggaaaattttgaaacagcatagctcagtcctactctcggtgaaatcttgcctccgcccctgcttataaattatacttaggctctgttcttttggttaagttgggaacccatccctccggtacgaaaaacgaaacagtccattagcacatgattaattaattatttgctaatttttttttcaaaaatggatcaatataatttttttaagcaacttttgtatataaactttttgtaaaaaacacaccgtttagcagtttgaaaagcgtgcgcgcggaaaataagatgggggagttgggaactacaggaaacgaacagagcctaagtatggttgttcctaagaaatctaacggctactcgtacaattggcatgtggggattaattaatacgaaaactcatgattatatcctctataaactctgaggcgtccagtgattgagaagagaacgtagggacacaaaatatttttttctctttcaaaaagagacatactccataaactaaagaaatgaagttgttggaatgtccatcatatcaattcaaacccggatcgagttgcagagaagcatgccaatctgttctctgctactctaatttaatattggccctgccacgtttgatttgttgatctcatgtcggtggtgaacctcctgcttgcttaattaaactgttaatctccaatggttagcattgctctagctgaaaccaacggccaactcgagccaccaattcctctcaagaaatgaatgtattttgatagcaagattatttttgcacgctccatgccctccgggattaagaatcatttttatattaattcttggctgaaaacaatattattttttgaaatagattacaactgcagacgccaatgtgcacaatcacccatatgagtgcgtgtatgcatcctatacccttatatatgcatgtccaagaattaactagaccattacatcttaagattaacgaagctacataagcgcgtctcgttgttgacgggttagttagatatataaatcactctattatgaaaatcttttttcagggattttgaaagtattttgtacagatatgtcaataccattctgcatgatcttcggtatatgttccatccaagttttccagcttaaattgccctcaacaatttctaaactgggccaggctttcacttctgggcccatactacaatttgggccttctaggccttcaatgtcaatacacctcgccatatgcaaggaaggaaaaagtccaattagactctctcgggtctgattcgtatccatcaaccacaaaaccgggtatttcgatccctctaggacaacaggcggttctacaacaccatgagcggccggagcaccatcatcaacctttcattgacgaaccgtaagatcgatctatccatcatctcctgcaaatctcgctgcaagcaagaacactaattaaatccattttgttgtatctgattaatcaccaggatatatatatatatatatatatatatatatatatagacctattcaatatgtcatttccgaaaccgtaccccctgctcaatcttagacactgtggctacgtgccttcaaaccactgggggttccgtcttatgtcagccgacaggacttctagagccatagagagagtccttggtccgagtggatgaggtgctggaagatgaagtgctagtgctatatttatcggattagtcggattcttatatgtatggctgggactgtggtgacgaaccttactctcctcggtcaagtggttgacccgtctgtccaataagttgactaagtgaatggtaatcctatagtttgaccagcctgggaagagtagtcagaggcaattcgctaatatggagctgtttatatcggctttctttcctaactaacaggaaaaaagagacatgctatatatatatatatatatatatatatatatatatatatatatatatatatatatatatatatatatatatatatatatggcgagtgatcaacgcagtgtagggagattgtcgtacaaggggtcgggaagaaggctcaactacaatgggtgggttctaggaggtggttctggcccaaatccactatatagacatgacctattagactatttatgttgtactttttaattcttaaactaaaaagaaaaggtagttttagtgaattatttaagaaaattttgcatatgtatattgagttttcggcgttttgaaattttgaagtgtggagtaggtttctggagccgccaactaagttgacccgagctttgcactgcaactgcattaggtgttaccacaaagatccataagactaacgaacccgtcagcggcgctaaatcgagggccctgttggggtccttattgctgtagagaagaggagcgagaggaaaaaggatagataggaggaagagtgaggatgacatatgggccccatacgactgacatgcaggctctgtagaatatccccatcttcctagatttctaagcgtttttttatcgtggttaacatattacatattacatatcacatcagccaataccatcatcaatattactctagaaatcatttttctaccagttttaacaattagggaagttattatcatacccggttttgcacttcagggataagaatcagattcaacctatattgagggactcaatgtggactttttcctgcaaggagttcctacatgcaattgcaatgcaaaataggccacccacaacccggcccattgataacaatgtcgcctggtgtccaagatgagggacagaggcctctttctccgatgactcgaccaaaacaatcacagatatgctaaacaatgcatacatatgtacacctcaagaacaataatcacagatatgtagaagaatactgacgtggcacaattagttgataaataatctgcacaaccaccaccaccaccaccaccatcaaccagaggacctgagctgttatttatctacaattttcaccagcctgaattctgcaggctcacacaatcaaaaaaaaagcctcagtcattttcaccagcaactctgcaggaacagcaaaatcacagcctctgctctacacctgccaagagaatggcattgcttgggaaggatcttcatatgtgacagcaggaaccaagacatggtcaccggcaactgatcctccatctgatgcgaatgcggtggttacggcttgcgacgaggcggcgattctgctgaaagaagagggggcgaactgcggtggagctgttgcgctggagatgccggcagcgggggagggatgcagcgacgatgacagaagagagagagcacactccgggtccagcccgtgggggacgccgttgcatgcgctgcgggttgtggtaatgttggctccatcttctggggaagagaagggccgcaggagatcgtggcgcgctgcgccgaggccgctcccgccatcttgcataaaggggaactgcttcggttcccggaaggtccctgagaatgagatggagaagggagggtgacgatcaagcggacgcattaaggcgtcggcgttctgatcagctatcggaaatgtttgcgggtagactgaaaactgattcgctgcaaagacaaaatagttttagtcaagagaatatattggatacatttcttgtgcaagcaattcaagaaaaagttgatagctctagtgaatgaacatgagaaaaatcttagtttaatagaggtccatcgaaatctactcatcttgacttagtattattgtgctatggtttactagaaattttctaataagctaatggggaaagactgagcatgattgggttccatttgacatcgattattttcagcttctaacaacctaacaagcatatcgaagcaatgttcaattcttcaagcacagtaagcatgcctttttctgccagacctaaaagatacataatatgtacattatttcctgtgacaatataagtaggtaaagatgtagtttgttataactgcagacagagaatgaacagctaaccaattctacatacagtaacggtaatacagtatcgaaatgtaatcaagaaacagccaggaaaaggatcactacaatttttcaacatatataactcagtagttgcaatgtacaaaccttgatgatacggaaggaaactcctagggttcaatgcatcatgctgtggctttcttcgacgcctgttatgaccatccagccgtttccggcaactttttttcccatcgtcaaactcagccagattgtgaaatctgcaaatacagagttatgttgtattgttgttacatggccctcaacatattcagaacatgtacactgaacctgtactgcagattcaaattcacactaacagttgtatttgcatagttctcatacgccatgtaggattcacagaagaaaatttagccaagtagtagtcataacagaaatggattattttaactgactgtcccttaatcactatgcttatagtgcactgctgattagcagcatagacttcgtggtcaattctaaagttaaaagtagaaaatataaaactgactacttatagttctgcaattcgattgggattgtcctctagtccatgatgtataaaccagtggtaggtaatataaattcagttatactaggagttaatcttagctttagaatgcacaccagatatcaagtgtaatttgtttcaaaaagctactaagtgtaatttcatatataaagccaacatcagaaagatgaacaaaataatacaaagccaatatcagagagatggacaaaataaagacacggaccatgagattttgtgttcaagaaaattatgataagcatggaagcaaatagtttcactttcttctttgctctgagctatgcttgaaattctcaggcaattattgccaaattttgaaatacatgttcactctagtgttgatattacggcatttacaatatttatctttgtaaatgtcacattgtgtgctctcatggaatgtagtagaaattgtaccggcccagatgtctttgtggttctatctgatcgcaataattagttcctaatattgattgataacaaagattgaatttgcaaggttaatcaccatgtaatgtgaaatttaaaaatatatcgaacagatccatgtaatttagctggaaaccactttatcctgtggctattctcgtttattgttctcccgttgataaatggagactacaatgcctggtagcaccttctgttgggatgctccaacatcaacttttttaatgagggggttggaagatggaatctgaatccaaataaaccgttttcagttcattttatatatctggtttttaataaattctgctgacaactttttcatacaagatcattcgaaatggtgaattgccactgaaaattaagaatattttattagagggatcattctcactaaggacaagtatggctcatgtgtttggtacaggggcagctgcctcatcgtacacaagataatgttctatgcgtataactgaaaaaacatgtggtctgttttccagaaaaagaacgagtgaactagtcaagtagatatatcagggaggaaaggatggagggttgcatctgagagcatgaggctagagcaatgtagcaggaaagtctacaaattgctagctgctgaagtcttttttaccagttgatatagtttattctgttaggctgtggtgatgtctttgtctctttgaaacttgtgtggttataattagtatctctggttatatttacatgtcaatatgggagacagaaatgttgctttatcttcactctaagcaatgcatctgtatttgatgccatttcctgaactaacagaagaataaattatctataattgtttgcctgtcatattggtaagaaaaagggcatgactatgctgcccaaaaatacagatgcaagtacctttgaagaccgttacaaaaggtcatgccaaataactacagcaagttaggaactctcagggtttacctgatttcaaatttagtttcagtgaatgggaagagcctcatatgttgttgtgttgtaggttacaaagtggtatcagattttttttaaaaaaaaatgtattcttgaagtggcatatcctcaaagtcaatctttagagtggcatttctttaaatgccacattaaaattagattggtgatcttgtacttaactgggacaacatatatcaaactattggctctcatgtgtgctctgcacagcaaccacagtttcctagctactcaaggtcaagttgggcattgggtagcgttattgatgaatgtcatgctgtcaagtatattgttgtagcccagaaaaaccttggctgattcgcgtgcaccagaggggcagagggtgctcatggctgctgcatctcagcatgacacgcttacacgggctggttggattcacatgcattaaattgtatatatgcagatctgcttggctactgccaattagtgtatcaaacttacatgtttatgcatgaaattggcaatctaaacgtgtcaattgtgaatccatgtattcatattaagccaagcacaaacgcacatatgggatccaagaggaaagaataagaaaaacaatcgtctagaagataaaaggaaagatcatgcaagctaaaaaatatggagttcagaactgcttttcaggatgctaatgtcatgcctaggactggcagcccaggatatccaaggaaaattctgccttagtttatgtctctccaagacatggtgtgggctcaggtcgacaaacagtcctagactcctagttagatggaacacaccttcaattatctaccaagtccatttgcttacttggttgtttatcttttatattactagcttaactatgtcgctctgattaatagaagatgagtatttgtgtcaagtccaagtcaagtagagccttcagccaagtcctatcagtgttaacccaacatgtgatctgagttttcagtatgaattaagccaccatactgtgtgttgaccattgaccattagggacttagggtagactcatgttatcgactttgaaagttcttgttaaaagctttgcatctgttcagcaaaattctgtatgtctgttcttgacagcaagatcaagttttctgtgttcttggttccaattccttgttctatgctcccttctactctgagataccatgcccccaaacacagcacgatttcttatcgaggtttcgtcgtcctatatgccccccatttccaaccccccccccccccctcaataaaaaaaaaaaaactaaatgagaaaaagacaggggtaccattagttggagtacaaggtaatatgaaatttatcattgcaattcttatgtaaatctaaccttttcatgtcttcgcacattataacaattgttgcctatataaatgcacgtaagagtaagagctcaccaaacccaaagaaataaaggtacctttttttgagtctggtccgtgtgggagctgaatcaaa

SEQ ID NO: 1414 - DNA, 4299 bp, Oryza sativa
aatgatagtttgcagaagtatatgtagttttgtgaaacttactcttctacacatgtgctacaaagctatatttagctgtctgccatacaaatacccttatattaaaagtagagttcctttgttttttgggtaatgcgtatcatatgaatataatgttattatcgatatatgctagtattcaccatttgttaggtccataaaataaacattgtagaccaatctctttttcctatttacgagagaaactatagggtgccttttagattatcatgaggattccagatcagaaagcaaaggcggatgacgatggtgttttgatttattttatgatctactagttaagcacatgtggatttgtgaaaaagaaaagtataaatttgatggtagagagagtagtagcagtaaaccaaactcttccctaacaatgattaaacacgcttcattaccaatgtaacttgagatgttgagttgttcatactttggtagagattataccataccctcaaacagaggggacatttacttccatcctgcttctgcaaaattgctgcaacatggtgtgatgaggagagagtagtgacaatcaggaggttggatcttgagaaatctaaaaggtatttataacattagcgtgagcaaatgacacaaccataagctcaagaggaagcttcaaagggttgtcaagacacacaacaaggaccattgaatgggctctcgatggagatggtaatatatgaggaggaacttcacctcctagttagtctgctcctccatttctctttttgttctttgggccatcacattagtctacttacctgaacttttgccatgttctaatcttctatatcatagtacgcaagtgatagtagtctttaagaacaaattacaggagctttcatagtgaactgtttgcaagttctcatgtgcacgatcctttgtctcaacattggacgctccttttttctaattccatattgacaagcaggccaggaaggttaaaataaagtggaaacaagcaccttactcatatggaaattgaagtaaacatttttatagttgatttcaaaaggtaacaagactcatttgctcatagtatagttgataacctttttatccttgatttcaaatggtaagattcaaagtttggtttgaaatcttgaaaggagttttcagcttttcacaagaattcgagtttttgcagctccagaaaaacatccaaaaaaaacgtagcttaaggcagcaagtaatcgaagcaaccgatgagtggtcagttagttgataattgtcattggctagtcaactaggaggtagcatggcaacttgactagactagttaccggcttaatgccctttttctaaatgcccatggtggggcgataaattggtcatagtgtcattaaaatcaaatgatttgggtataccaagaagaacaatacaaatgtaggtgcaatgatttttaaaaacaaaatacagaggacagatgtgctatcttcttaaagctctgatggtcgtgctaacagaaaccacagtaagcaaagacaacatgctgatggttttaacagaaggaaatggacaagtacggcatcttcttatagttgggaggatggaattgcatataagattagtttgattacatctctagattgtctaagattaatactttattctaatgcaaggtcaccttcatagacatgataaatttctgctaactcaaatacagataaggtgtggttatgcacaaaggttgagcacaacagatcactgaggtaaataattcttttttcttactgatgagtctgacaatatgccagtaaaaagaggatgacaacaattatcagattttccattgggttactatgaggtctctgcagtttgtactgtgccatccattgctccaattcggtgttatcttactaaccagtgtcatacaggaatgaataattaggagatcaaggttatggcatgatttcttccttcctaatgtgtcattgaaggatgctttgatcaatcagcatgacttatctattctagactacaagggatataacgacacttcaaatatgacaggagaatttgtaaacaggattactcaactagagttatctcctggcgtcttcagtaactgtagaccaacaagattgaaccagagaaacaaagacataaatattgtagatgcatgccagaaatttgatttaacaaacaagatgtttcttagttatacccagaaaataaacaagatgactcaactgtggtgattctctcagtaactatactgtcaagcacagatcatagaacacccaaaatacagccagctagaacagatatattctggtatcatacatgagaatgcaatatgtacacagcctaattggatgagacatgtaagaggtaaaataaacccataaagtaatgatcatttgtaggttccaggaattgaacaagatgagtggaaaaccaattttgcagtataagtaaaaatgattataattgttgtcctcaaccaactatatacacaatgataatgtattttgcattctcttgaggtttggtaatgatggaagaaggatgaggggatcgcaacatggaatggaaatgacaattggatctttattatctcaaaattgagtttgttagcctgtttccccaagctttgaacctgatcaagctcttggaattagcacatcccaccaattggaaaatagaattgttgtgtgggagatgagatggtaatatctaggaaagtccgaatagaatagaggacctatttggcttgagcaacaatcctattcagcacaatcaaaaccttactgcgcttatttttacaatgagatgaatcttgagttagaagagtattgtcatattctgaattctgatataaaatatcacaagatctcttttgatacagaagtggagttatcattctatgtcattgcttaatttagtagttgagaaattatatggcctaagaagataataatcactgtttattcacacaagagtctagtttgaaaaactgttaaagaattattatctgagaacaaagcggaaatcatcagtgcatattaaactggatgtctgaacctctccaactcagttatgatgcagtcaaatggttaacagttcagtcaagatttcactaaatgatactacgttttactttctcgtaccactttcagtcagatacacgcctgtaatagaactccaaatatttttagaaaccatataatccacccaaaaatatgttcagctatttgttttctcctactgtcatgaaactccagaatagtttactacgctaaacacagcaaagaaactgagaatcagggaggagagagtataacacaaccaaaggtaacagctttcggttttgcatgcccacgctctagcgagtaacccatgaaataacccgaacgctaacgggagtacccactgaacaacactactatacaatactagaccttaactagtttcatccagatcttgtgaactgaaactgcttcctgttcagtctcactgaaacacaacccagtttgaagaaccaaaacttaatttgcatggtctctaagcatgaagccaatttcaacacccgctccaccccgtcaatcataagaaagattcggcgatgagttgcggaataatacaggaagaaaacaaaaaaccctacacaagcaagcaaagcatgtcatctgcccacaccaacagccttcttaaaatagtatcccggtgagattaaattatccgcgacatcagagccctaaaggccaccaaattaccaacccaattgtttaatcctcgacaaatagcataggtgagattaaataatcccgggagccatcagatcctaactggtaacaaattaccaactcaattgtttagacagctaggccttggggacccaagcagaccacctaaatttcttttttccctttctcccccccaaaatcgtcagagaatgcaccaccaaagtaagcaccaaatccccatagctacagttccccgatgaggaaccaaattgggggcagcaaataaagcaggtgaaaaactattaacaaatgaccctcatcgatcgagagcacatcatcgatcgtttcttgattaatggatcacataaagtggatggatttagaggatttgggggtgtgattaccggctgcattgctggcagaagcgctgctcctggccggcgacgacgaccaccggcgtcttggggtgggcctcgcagaccttgtggcggcggtggtagtcgcggcaccggctgaggtccgaccggcacccgtcgacggagcacgcttccgcgcc

SEQ ID NO: 1415 - DNA, 17269 bp, Oryza sativa
gaaatacatcaacaacaacagcaacaaacactctcatcttcctccaacgcaaggtagcactagcaagcaaagccagctccaaccaagcaaccaaagtaaccaaaagaagctcaaagaggaggcaatagcacatacgattggaggagaagaagaaggagacgaggaacagcggcagcacacagtggcgagcagggtcgtgcaacagtggatgcagctgcgtgcgcgcgcgcgtgtggcaatcgatcgggctctgcgtgtccgagctcgggagaggtggtgggggagtatatatgggcgaaaaggatggatttcgatcgaggagagtgagttggagttggaggaggaagaagaagggattaatgagtgtgagggagtgatttggagggctaatctctgatttgacctatcactgttcgtttcttaattaaccctcccttacctttgaaggggaaacatttgttaatctggtcggctttggggttttgcagactagtcctccagtaattttggattttgatagcggtggatgtagtatctttttttttttgggaggtaaaagtgcaagccgaaagtgagataaagggcatttttttttagcttctaaaccagaagctccctaaacaatccggttttttatctagattctgagaagctatatttttagatttcataaaataaattagaaaccagaagttgtgcttatcagaatcttaatgagttcgggaggagttgggtccgcgcatgtaaaatgatgtagctcattaatgcacaattaataagtaaattagttacaactttaaatggattgattttttttttttgaaatatcttgactatagaaacttttctgaaaaaacccaacgtttaacggttcggaaaacatacacgtgctgttaaacatacacgtaaaaagagggagtagaagttataaaaagggagaaaagaatacaccctttagcatggctccagactagatacacactagatttgtactgtgtaatttgaatcaaaatgatttaatattctattattcatcttaaataagaaataaaatgattatataaatgttatcaatgttattacgtttcagaccgtggatttctagagctagaaatacttagctaacaaaaatagatctaaagttctaccaaacaagaccaaagtttgataatgttatgaattttgtttgaaaatcaacattaaccgtgcggtttggaagagcttcgaattttttgtgacaaagtccacgaaattgttaaccattatgtccacaacatgaaaacaaattaaattggaacgaagaggaaatctgtttaaccctcataaaaaaattgtatggattgattccacatcacaatagatatagaattaatctcatctaaatcccaattaatgccctgaaggattaaaggaacaatgcctgaaggctgaaggtactggtttaatcttggtagacgtgggaaaataatttaattggtagcataaaaataaatctaataggttcaacactacaaagttttcttttcttcatgtgcattcatgattgttggatccagatatcaaattatgatgttagggagaaagtgtgataatgtggtcctctctagtgtactgcaccagacttttactggagtgaagatttgaaaaggcaacaaaatgttatttaagattttttttttgtttcattggatagattaggcattgtcgtcctttcagacggacatacggttaattaaattaaattatcctcccatctatttggatcagttcccgtacatatatccataaaaataagctcaggaccactatttttgaaatacttgtggacgatgatgcatgattacaatttgcaaacaaggttaaaaaaaacgtacatttcttttcttgacaggaatatgcaagacagaggatacaacttaaaaatgaggcacaaggattcttacaccaattttttacttcctcctattccaatttccaaatacaaggtctcgtttttcataggaatcaaggaactggttgaaatttgacataggaatagatactctgttattttacacgaggatgttaaaatttcctaatcaacgaggtcatatgtaaaagcaaacattaagtcagacaagtgatccccgcaacaaaaaaaaaagtcagacaagtgcatcaaaattatatattgacctgtatttccgaagactcgtatttaaaatattgacctacttgtgaattacgcactcctttcaaaaacgagataatacaatcaattgacaagcgcccaaatctaagaaacatcatcgacaagtgtgagttccaagaagtgccatagttcaaacgactttgtccaaaaatgacatcttcgttagggttccgtccatcccgcgccattaaagtgttataggatgaacaatgtatttaatagcgtggaatggacggaaccttgcggtgatgggcatttttggcccaaaatcgtttgtatgagggtattttttttagaactcacacttatcaatagcatttcttgaatatttggacgcttattaatgacatttcttcgattatctcttcagaaatataaggcacatgttaactatccaattttgagttttgacttaactgttcatccaataatttttaggttttgtctaaaaatgatatggttagaataaagttcgaaaatattttcttattaccacgaatctgttactataagcgaaatattgttagaaaattttacagtcaaagtttgttttaacaaacaaagaatacctattatattggaattaattcctattatacaaaagggtccatatagactgagaaaaaagggcttcatttcgattctccaatttggatatactattttaataaagggtaatctaaaactctagtatggctagtacttttgaattgatcatcgactgaagtatttagaccacaatgtccaaatcatcgtaaacgccatttaccttgggaagctactagacatggtacctaattggggaaaatttaacactcttggccaattaagcttgaggtgtcatatataatatcatgtacggcggaatctaccattaatctcgaacaaaattaaagccaccacaggttaccatgtcacgttgtcagtactgcgatagaaattttggcaaagacgatgttttattccactagcaatattccctctgtttcatagttttaactacttttgtagttgcacataaagtacagtactttttatcgattgaaaaaagaaaccaatgcaatttttcagtcccaactcccaagtggccaaccctggcttaaagagctcttgaatgaagtgaaatcagtaaatcctcctgtacaaattctactacaccatccatcctaaaatatagtaaaaaattttgattggatggggcacaacctaatactgcctagattcgtagtattaggatgtgtcccatccaactaaaatctcttatattttgagattgaggaagtagatacttgtatgtgaggagtaattaaataaaacaacaaatttatcttccttgtcattcatttatactcagatcagataagatgagtaattaatttatttatgatagtagtagaattatatagcaatgtaaaatgtccagaaaaaggtcttggattaagttgtattaaaatgagaagtgtcgataaagttacaataatagacttatattttataccagaggggatattgctatggcaccatcaaaaatccacataggttggttttcataaaatggattagtctgatgcataagaaaaaaaaattataagtaggagggaaaatttagagaaatcagacacgcatagacaaagatattatgcatgccactggttttttccatcatgcactctactccctccgtttcgaaatgtttgacaccgttgattttttaacatatgtttgaccgttcgttttattcaaaaaattttgtgagatatataaaattatatgcctacatagaaatatatttaacaatgaatcaaatggtaggaaaaaaattaataattacttaaattttttgaataagacgaacggtcaaacatgtgataaaaagtcaacggcgtcaaacatttcgaaacggagggagtatgtcactatttattgtacccctccctctatatcgatgggacttctaattggtatcatcaaatgaatgcaactcatctcaaatgtgaccctcaatggtatggtggggtaattctttaaattttcacatttgttgtttaaaaaaatattcatatgaatgaatggttaaatttcatctatatatactagcacccctatcactagtatgatgcaccctggaggaactcctacagaaaccacacctacaaaatttatacattaattgcaggtgttagattaaatctgaacaatcgtttcacgcatactctctctaccctatactagctagttatatgtcaggggcgttgcaacggatccggagagaaatatgatttggttttttatatatcggttttcaatatgggttgattttttggagcgtttttttaaaaaaagatgggggaggggggttggttcgagctgtgttcgttgtgggaggtttggagcaaatatcctaagcacggaaaacagagtggtccattagcacgtgattaattaaatatttgctattttattcaaaaatagatcaatatgattttttaagcaactttcgtatataaattttttgtaaaaaaatgcactgtttagcagtttgaaaacgtgcgcggaaaacgagggagagggttgggagctgggtggaacgaacggcagccttagagcaagtttaatagtatagcctactgctaactccaaaccatctatagccaatgtaatagctaattcatacaatagttgcttactatactattaatatctggtcccacctgtcatacacacattacgttttggagtccgaactgctactcttctctctctttctttatctctttaaaatatggttatagctggtttatagcctgctattatacctgctcttataggagaacggatcggatgtacttttgaagtagttaatataccagtacgccatgtttcacactacctattgggattgctcttatttgatcacggactatatatcagcatgttatctaccaaagacttgcgtgcaacttgtatggccattttcttttttatttgttttggtggggaacatgcttagcaatttgatgttaagttttttcttaaatctggtgtctttttgttcctggacaagtattgtggaaccgatgggatggagggcacttgctgggtccaaccacttgtgtgttaacttttctgaaacaatcacacctctgaattgtccacctaagattgagtttgagctaatctctactgcaccactattttagaacaggaagtacatttgccacctgtaaaatttttcaggctttaaacaaacaattggtgataaaatcataaaactataagcactgatgagtgatgaatgactggccttgtttagttggtgaaataaaaatttttggatgtcacatcggatgtttgatcggatgtcggaaggagttttcggatacgaataaaaaaactaattccataactagcctgaaaaccgcgagacgaattaatccgtcattagtacatgtgggttactgtagcacttatggtttatcatggactaattagacttaaaagattcgtctcgtgatttacatacaaactgtgcaattagtttttctttttatttatatttaatgattcatgtatatatcaaagatttgatatgatgttttttagaaaagtttttgagaactaaacgagtccgaagtctctttttttttctttctctctccagctctcctctctctccatttggcctcttcccaatggagccttttattttgggtgaattttctcatggacctatttaagggcacaaatttcttagaccaattgactaatcaacaccagtacagtactcctccaatcaactaacagcagagtggaaggaaaaagggattatttaagtcaaatcaatgacaccacgcagcaattagctgatccaattcgtgtccaattatacatagatctgtctgtaaagctctagttggcagtattaaactctagtgaactacagtgatctccctaaacctttttttcctcattaggtaccatagcaaactataaactaactataaacatattttaaaaagataaaaaagaagagataagagcagcaggctgcagatttttagctaactgcagcacagacttcaaaatgcatgtgtgtatgacagatgagaccggatattgattgtgtactatatgtttataggtaactattatatgaattggccattaagttgactataaatgatttggaaccagtaattagccgtactatcaaacttgctcttatccctgctttgcattttcaaacaaggtgaaggcccatttcgcataatttagcaagtggccgggcgcgcctaccaaccggagggaagtgacaccaagtaccaatgctcgtcctcgtcgtcgtcgctttatttgcgagttttcttgctgcactctgtgtatatacaatcttgcaacttttggcctaaaattccaccaatggaaggagcaaatctttgcagaggagccggcagtgcctctgcttttccccgtgcaggaaggcaaggctacaaaaggatggtgatgaaaggaagcagatacatatactccacatatggccttgtgttgtgtgtgcttcctattggaagacagccctctcactctctctccactcagctaccattgcaagctgcagattccaaaagcaattagggtgttgtttggaaaagcttatagtggtcgcagcttttcttagaattttagtcaacagtctaaattcttatctaaattttaaaaatatatagctatagaattttaggaaataaaataagagcaagaagttagggaaaccggctattaatcaactattcctttaaatcttaaactctccaaacatgactttaaactctccaaacataacttagatctgtttggagtatcttaaaattttgagaggcgacttgttggtagttagtttatgagaacctgtaaaactgagatttttagtttttagttcattttttgaattctacaattaccactagtggggaaaggcccttcactcccgggttacaaaccgggatacccaatccgggactaaagatgcccggttaaaacaaccaggagtaaaaatggatctttagtcctggttggtgtcaggttggactaaagatggagccaggcatcaggttgcttttatatttttttttaacattgaataatgatttcattccatccacaaatcatccctaaatcaatcatcacataacaaaaggatatctccaaatactcaaatcaatcatttccaaatacatcacaaattctaaaaaagttacatcacaagttctaaaataatcatcacaaatacatcacatattcacatcacacacaaatcaaagacatctcatatccaataaaaaattctcaaaaaaaaaatcaaatacatccttcgcgccggccgcctcccctccggcagaggcgcatgccgctgcctgccgcaccggtcaccgccacgcatgccgcctccgcgcggccggccgccgcccctggccggccgcccacaggccctccgcacatccgctcctcgatctgctctagggatgaggagaaggagaggataagaataagagagaggaggaataggaatatgaggaggataagggagaatatgaagacgagtagtttgggaggataagtcttaaggattatatattgtataaaagatctaaataatctttactcactaaagtagtgatctttagtcccggttggtggccccgtgacaggccactgacaggggatgaaccggaactaaagataacaccaatcgggactaaagatcacatagcttttaacaggcttttttttcctggttcttattaaaaccggactattatagtttttggccgacccagcaaagatcaattttatagtagtgtacaacttcttagaatgtaaaagaaaagctaaactgttttaagtaaacttctcattctacgaggggtcgcgattctaaaacagtttatacgctatagcgcttagtggagtgtttttttaaatgattatgcgccggccatagccgcatgggtgactaccggacggtaaaaaaaaaaaaaatcgtagatctagctctttttggataatggaaaccgatccagctctacatataatccaaagtaagaagctcttctaagcatgcttagcgtctaacctaaatcagctaattgttgggctccctgagaatatcagccggtgatcgataaggctatctaattaatgatctctttggatgttgtttagtactgtagataactaattgaacctacggaacaactctgagccatacacacgagcctagatggtgcctaaaatttcacagggattttgcacaaaagtttcttttatggacaagattctcttttaaaatattttccttctctctgtctcaccttgctagggcagaaaaacaattgggtaaacagaatctagcctcatggcttgtgcacaagaggacctttgctggctgactataccggtctacatccatctgtactgcttttgggagataaaaattattgatgctcttggtggatatggatgatgagctcatggagatttgcacagctcacacaatatatatatatatatattttttctctctgttgtgctgtgatcgtgatcgatgttggtacctaaccgtctacactgctaccaaaatgttaaaattgcatagggcacatttttactcgccagcctaagtggctctaaggacctatttaaaacatatgaggaattgaagtagcatgtatcttcaatcctacaggattttaaaacatttaaaacatagaaaacaggaatagatatgatgttcttaaataattatagtaatgggaaaacgaaggaataggaaaacccataagattctggcaagaatgcaaatgtttagattattgcagatcacaggtaaaacatggaatttgagaagagataaaaacttaaaggattttttccattagtttttacctcgtgttaaatttcctcaaaaacttacatggaaagagacattccataagaattttataggattcctcattcctttgattcaaagggttatataggaaaaattcctatagaaataaaatcctctaaaatttatatgaatttcttttgaatcaaaagggcctaaaggaaggttttcaagggggcttttaactatttgccactcttacggatgttgcttaatgatttgccactaggcccacatgtcatagacacatgagggcccacatgtcattgacagggtgtggcaaatcgttaattgtcatgtcacaagagtggcaaatagttaaatttcccgttttcaagagatctaacatcttacttattttttttatggaattaatcatatgaatacaattgtatgtaaaaattcatatcctcatcaaagagtctataggaaacaaaattataaaggaattgaattatccaaaaatccaagggacccttaaagatcgaactgagatccgatagatagatctagaaatttaattttatccaacggtctaaataattatacagattcatcgtcactatttcgtatcgtagctacctagattattattgtttttttatttttaaaaaactttcatttatatagatgtttcttgaaaaatttcgaataaattattttccagtgtgtaagtagatactatttaattaattatgtgctaattgattatcttccctggttcgtccaaacttcacatcctcaacgctatcagatttcttctacagtgtttgctatatatatagtatttttggtacaattaacaatatattagcgaatcttgaaccttccgtcctattctttccgtgctgctaattctgcatatgcatgtcaagaaatcagtagcagctagctgcatgggatccggattgctaactacagtgttccaaagttcaaaacatatccaacaagtcattgattaattattgtagttttgccatgacataacatactagctactatagttactttgggtgaagatttacaaccagagttgaataaataatatgtctcctttagtctttaattacatccttagttcctggattgtatgtgctctgttttgagtgaattgtgtaataagtggctaatttcatcgaagcaaaggctaggatttaggtcctatttagatcctccaaaatggcaaaagttttaccattttgtagcactttttgccattttggatctaaacactagtagcaaaagttggtaatttggcacttggcatttgctagtctatagtagcaaattgtgccaaaaagtgctttgggaccactccctttctctctctctcactttagtgctagaatggcaaaattttaacatgcatctaaacaccaactagtacttttgcaatgccaaaacttttgccaccaaaacttttgccatttgctatttgctatttaccattccaaatgatctaaacaggccctgtatatctctaaaaggcgtcaaaaccatctcttaaacatctatacataaagtaaaagcatttatggtgatatttatagtgcttgtaaaaaagtgcatctagactatacgaaattcctattattttagatgttatttgaaaattgccgtctttggaatttttttataccaagtcttttgttgcaaacttggagtgactataggaaaatatgttgatgttatttcctaaaacaaaacaaaaatatatttatgttgaggagatccatttttcaaggcttgatttttttttcaaagggccattgaaatgctaatggagggccatctttgatcactaaagctagacagaatcactacaacacaatatgagacatctgtaatgattcatagttgttttctctaacagttcggggaatcatctaaataaagttagtgataaaataggttagagaagaagggagtcctttcagacatttcaaaaactatatactaaaacaatttctaacatatctatattagttactacatctgtattttaattttaatgtatgatgttattgacttttgactaacatttgatcattcgtcttatttaaattttttgtgcaaatataaaaatatttatgtcatgcttaaagaacttttgacgataaatcaaagtcacagtaaaataaatgataattatataattttttaataagataaatggttaaatattggttaaaaagtcaacagtgtcatatattaaaatatggtgggagtaagaaccatgagagatatggtataccgagacgaaaagccttcacagcctagtaggtgccctgcactgtcaaactattttttcacacgaggtaagtgggaatcaaactcttgtaacatgaaagtatgaagatttgtgtgagcccacatttttttttactgaatgtgagcccacatattatctgggcaacatgcatgattgttgactaattataacgttcttaattaaaagcaatgttcttccctatctttgactacatatattttttaatttggagtcatttcttctctactggttcttatcaaatcttgtgggtaactcagaaaaatatgagccaaattacaacaaatggttatcatacaaatcatataaaattggggatcggggatggcctagtttataaccgtgaacaattaatctagcactgcaataaaatgattatgcagtaataaatatcagtaatttaagtaattttcagctaataaggcaatattaattaggacaaactcttagttaattaattattgttgatatgagaatgatgatactatagaagtggacttgaactaactgtgcagttgctcacaaaaacggttagtaccttaactaacaattgagctgtaacacacaagttttagcctttggtgcacgatgataacctgagcatattgatcattagtcctctttgtatctaatcttgtaatttttaagccaagttgctttcaacgattaataattagtacaagttggtatatacttaatgtggcctgtcaagtcacaataatttttcagtctaaacctgactatgtttgtgtacttagctaccttaagtaatgtgtaaatgcaggtacacgcatctgcatcggaataggtttcgctttcgcacgagttactacttttttttccactttgtaccagcctctttttgggttttggaaatttttgctttatgacttgtagtgccttgaggagatatcatgcaaaaatatttgaaaacgctttcgaaatattatgcaacgacatttcaaaaggtatatatattcggcaacttggaaaactgttgaatgcccaattgtttagaattgcatagataatttggcaaaattgttaacccttaaggtgaaattgttggaatatgtgggtttatatgttagcctcaacctatctaaattcttcatatgagatcaatcccactgataacatatcacaatgaccatgcatctaactactaagagattgaattattacattcatcccccccttaaatggcaataataatgctcacaacaacatgctatagatgccctacaatgtttagaaccatcccgcgatattttttttttaaaaaaagtgcctcgtatatattgatagagtaggaaatcctgtgatacatgactatatatgttatatacgcactatgatcccaaaaacacacatggccgtgcaatgaaagattatgttctaatatcaaccataacactttaacttcacaatcagcattagcctatatatagcccttccatttggagtccatgcgggcatatattagcaattaattgcacttaattttgttcttgctttggataaaatggttaagctgaaagtcctattgttaaaaccacttattatttctttctcacttgaaaaggactaatatatatatatatatatatatatatatatatatatatatatatatatatatatatatatatatatatatatatatatatatatatatatactacagttaaaatgcatagtttatatgccaacccagcctatctaagttatgatttggttcatggcaccagctggggacagagcaggtctcatccatacgtttgggtggtaggatgaaacatagatggtgcgtggccactgtttggagaacttgagaaatattccccttagattttgtactgagaaatatgcctagtgaaggtacaagaagaaggattgataagggtatcaagtgacaaattagctttgatgagtgataattagcatgctttagggttaattagtgcatgttagagtaatgtttgcatgcataagtgataatcatataattagtatcaatgagggagattaactgatgagtaactaggtctcgatcttttgataggtattgataactctcgatttgggaaaacttgatacacacaatccggcttccgatcaacacgatccaaatcctgcaatcgtagcatcatgtcttctctatcaactgtgcactgcctagttggccttgccgagaaggttaatttcagcatgcgaatcaaagaacactagcagaaacaagtcagattgcaactcaatatgtagatgaatgattaagatctcaaagttcgggttccacgaaccaaactaacagtgaaactgcaattgtataaataatctaaggaaaacccgactctaaacgatgacaggctactgaataaatataattagggacatcgtaggattagccctagggtattcactccttaggcttagccacgacacaattatagggttgaatgtccaaatcagactcgaactggatgaggtatgtggcttgttttgcggattctcgacagctgaggagaaattttgatatgagaccaaaaccattggaaagtaaactccataaactttccaactagtactcatggaactcaagattcttttcagattaatggctaggtccatttgaagttgatacttttaggagacccgaatctaaatccaaaacgtgtaaaacttaatcttttgacttctatagaccaaaagtgatatggtgatataggagtagacttggggaaaatcttggtttgatctccaatcaacttctttgatcatccaagtacttcgtgaggctgatcttctttgcttcacccacacaagtatttttgtaaatgagaagatacaaaactcatggtgtagtaagtttgttcaaacatataataagtaaaccttatatagattatatgcacttttatattgttaagtaaaccttaacataagcatggttatatccgagacagtgatgtcctcatcaataatataaaattatttattaaaatttagttccaagggatagcagattaaacagatggtgatgagttcaattataagaaacatgcatgaaaggctcaatgtatacgaattagtagatatatacaagttgtcacactgtaaagctcaataagtgatcagtcgactgcaaggtagtggaggaatttagcggagagcaataagtgatcaagcacaatagcatattcatggttaataaaaattgcatgtgacaggtcaaccatgaaaaaaaatagtttttcttataaatgctattgttatatatataccctctctctgtagaagaattatacagcgtattattttttgagaagtcaaactttgtaaattttgacaaaaaaaataccgatggattcatctttcaaatagctttgataaaacattggctctacagattttatgaatatattttatgcgtaactcatggtctcttaaagacccctttcaaataaaatacaccctataattttctacataaaaaatgttgctttttttccccaagtgttacacttactagctatatggagggggttatggctttgaagccatccttgggttatggcttaccctcactaatgagtagggggtttagatatctcagtcaaggatgaccccaacttatgttagtggttaccttggcaaagcttgtttgccaaagttataagtatcctcattcatttttaattatttgtcgttagttttgtcctaagttgaatatttctaactttgactataaattaatttctaaacatttgtatagtttaactatacatgaattatatattatgaaattatctcatggtgcaaaaacatagattttatgatgttaactatataaatttctaaaaatagataattaaagttaggaatattcgacttagcataaagttaattaaaatgatgagtaatttaaaatggaagtgagtaatatagttatgaaccatacacgccctcacagtcttactactactgaacccaattaattttctatcttattaactcttattacccaaattcatcaaccaatatttatcctcaataacaaacttacagtgtttgtgcccatatgaaacaatggaggagcagctgtgagatgttctgtacttagtgcaagacaagaagtgaataaatcttattattccattcgtttcaattcagttgtcgttatagtatttcatttttttgtcaaaatattgccattctcacatatttcgaagtatttttagagatgtcttgtcctttccacctttcatcaattcaaacatattagtattagtattctcacaagaaactttcattaagatactcccttagataatttcttatatgacgtaacgtcatataaataagaacggaggtagtaataataaatgtagcaatataatttggcatatttagcaatttaatgtgagatttgctataatgacaagtaaattgattcaggaggagaaggggaaaggatcaggctatccccgggttaaatggtcattattcatgatttaagcccctatcaacatcaggatccactaagcatcccttaatttactcaatgaaagactaaaagttgtctaatcaaccgattttttccaacaactcaatcatagatccagcagccaaactaaagtagcaattgaataacaaataaaagttccccaaacaagaagcaaataaaccttaacacaacaaatgtccaaaacaaatcccaagttagttcctaatattgtccttgcattgacttgtttgttcacgccaaatggtggtattcttgcatcccggtggtggcgtgaaggtatataacactgcatccagagagtttgtgtcacccagctggccagctgtttatttcttatgtttaatcagaaatttagaatacacacatgtttacatcaatttcagagaagtttggtcagtgtgccagataaaagttctacaattgtcaaatttgagcctaactttatgaattcattaatttggtctttcagtttttaacaaaccagcttctgacgaccagagttttttcttatgttttttggaaaaatatcggtcccggatagtgagatctcaatgagatttacccaaaaaaaagtgtgagagataataaaagacctttttgtgacaaacatacactttggatattatatcttgcatcataaacctttgaatcatcaatattaaacttagtaagttttagagttgaaatgtggaattaaaataatgtcaagattcaaaattctaaaaattcatttttttaataaaagagggggccattttgccctctttttctcatgtttctcttgaagctaattaaaaacaacgtatattgtgtatttttttccaaatgtttttgcaatggctgccaattggagtgcctactactcctatgatcttattctagctaagctttctgcagagacaatgtggataactcaggatgtcagtgtatacatgtacctaactcgtaccgtacgtatagagtagagtattccagtagcttttttttaaaaaaaaaatcagctatatcactatatcaggatagctgcaaggatttgctgcatgttccatgcgccacgttagtcttcatcatataattttaaattttgttagattggcctatacggtttaattatcatatgtggcagcaggtaggacaggggaacttgcagcaggtaggacacctctcatgattcagatgcagagaatgcatgcatgtaatcacataaaaaatgtgattcagattaagaggattacattatctaaaaaacagattatacactgtcatatacgcacctcagtgtgtttttgtggctgatatgatgtacatcttgat

SEQ ID NO: 1416 - DNA, 25213 bp, Oryza sativa
tgccgcccagcccccagccctcattcctccccctcaaatccagcgaaaaaaaaagaagaaaggggaggagaagagaagaaggggcgaagccctgccagattcagacgccgatttcaggtaatattcatagatcctatatgtgactattgagttaaatagtgtgtatttttttaaaactttgtttgaataaatgcattatatttttagggttttagttgtactaatctagaagtgtgtattatagatatcggtaactacgtagatctgctagtttggaatcaatactttaccgttgcattggcaaacacaagaagatattacgttgtagatgtttattgcatgaaagagtaatgtgatctagttatttcgttgacagatatgtcaaacaaacaaatattccaagtttaccatggcccaggaaatgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgtcatagtaagtcgggcagctgagggtttttattggcaactaatgccagttcaaaactctcgagtatggagatggtatgtggaaaatgcattgcaacgcgggtggcctctagctatggttccgtttgttcacccgaaggatccatgtgtgcagatgaacatggatgatggcgagggactaagtgctgaagtaaatgagacttctgtggaggaggtcaacgcacgagaggacgggggtgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccaacagaatgggctagtgaggatttttctgagctggtcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtccaaccggtcgcaatatgaagttcggtgtgttaaggaaaaagatagttgtccctggagagtgcacgcgtataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatacgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctagcaagagtgtgctgcaaagagcattcttagctctacatgcatgcaagatggcattcgtgaactgtcgtcctgttctctgcattgatgggacattcatgacaggaaagtatcggggccagatactaacagcaataggggtagatgggaacaatcaggtattgcccttagcatttgcttttgttgagagtgagaatactgatagctggtactggttcctgaaattggttaaaacaaaagttgttggtatgaggccaaatgtgtgcctgatacatgataggcacgctggcattctgcgagcgatagaagagttgcagtttgggagtatggaacgaggataccctggtgagtgggaagatgtacagagcaggtggtgcatgcgtcatatgggagctaatttcttcatgcaattcaagaacaaggagctcatgaacatgtttaagaggctatgcaatcagaaccaggagaaaaaattcaatgagctttggaagagattagatgagttgacagccaaatgcagtgatcagcgtgcagcggctccatcgaccgccgatgctgaccctcctcaagctcttggacctctcccaacggatagtccaacattggttagaagaactggattggagattcggaaattttctcagtagattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtgaagttcattttacatgggacatgcaggtattttagggatcggttccaggcagttcttccctctatgccgaacaacaacattttgtttggaactttcatgaagaaaaagctagaggagttgcgtaaaaaggccatgaaacatcgagctctagtgcaaggtacccaacagcacaggtttgagatactatgtcaagataaggtaggcaagggtatctaccgcaagagagtgaagcaggagtgtgttctcaaagccgatggcacatgtcattgctcttgtgcaaagccgaagctgctccataggccatgcacccatgtcattgctgccgcagcagagtgtggcataccagatgcagtatatgtttcacagtacttcagtaagtaagcaatatatcatacatggagcggcgagatttatgggttcggcatagctggggagttcacagagactaacgatgaagtactcaatattcctgacccatcgaagctccgaggcaaggctggaaggaggaagactcgtcgcatccgcaacgatatggacgagtcggaggctggcagggtgaagcgttgcagcaaatgcgatgaacgtgggcacacctacaagcattgtcctaaagacaaggagaaaccaagtgcggcggaggcaggactatcaggatcagcagcagatggagctagccctacgggtgaaggcactacctccactcgataatgtcctaggcgtcgtcgtgccacgtctggctacgtggtgtagttcttatgttctatgttggcatgtggctttgcttgtaatttgtttcgaacttatcgatgtgtttatatttcgtcgtgtaatgtcaaacttcggcatgtcatgtctttaggtctcgtgatgtaacgtcagactaaggcacctagtgtctttaggtatgctgatgtaatgtcggacttcgacatgtaatgttatgttatgttatgttatattatcgaactctacatatatgttaaattgcacgtcatcgttatgtacccttagtaacgttttctatatttaaatagcatgtactcttgttgtacatcattattctcatgattttattattatttcataattttacaagttatcttttgtttgacattactactttttgaattgttctaacacgaaacactatatttttcacagatggcacgtcaggatacctactaccaccttggtgccagcgtcctctctgcctatgcggtgatcgatgccaactaatggcttcgaggaatcctaatattcgaggaaggcgcttttttaggtgccctaactatgaccgtgaggtattttattatctgcatatgcttattcattccgtatgggcaatcgctttattcttcgtaacactactctattcagcagacccgcactacggcttgcgcatacatcgagtggatcgatacagaaaatcccgttctcgacctaaccacttgtttacaagaaggtcactggtatttcgcatccgaaagtactgagcaatacttacagagaaaagcagcttatgaacgacaatgtcgtgaacaatagagcgactggcgggtgctaactacggcactccgtccaagatgcaggtgtggtgatcgttgtcaggttcttcgttccataaagcctacaacattgggtcgaaggttctttgtttgtccaaatattcttgacgacgatttcatggtaagaatattttgattacatgaatccttattttctcacaacatttactaactttgctcgctttacatctattctttcctcctaggaaccaccaaggagatgtcaatacaaagaatggatagacaccagaagggttctaactccacctagccgtgttgtgcagcttgaactaccagagcaatacagggtaactaaagcgcgttttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatataaccacaatggaaatagttgtatcatgttcaaattgtactactatttcttcatgttacataattctccttgtttaagtccatataatgtttctacgaccgagactgcgataggcctattaattatccgagtactaatacgtcgaataagttacaaaataataccttacttaacatatgaaattgcgaaacaaccaacttcaatacatttttataacaatattaacaagttttaccaataaatacttctttatttattattaacataacatagaaaaatcgtttggccgtactttttgcatctgggtcctttgccgccctctactggagcggcaagtggcccaaatacaaaaagtacgagcgcaacctctttatgggcggcaaaaattgcaattagcccattgccggcggcaagggggtaattgcaattttggccgacggcggcagacggcgcggtcgacccgccgtgggcggcagggtctatttttgcaatttttttggccgatagattatttctgtaaatattaaaaaaaatctaaaaatgaaaaaaattcttcactcaagcaataagtttactttggctccctcaacttgctcttaagttaattcatattcccagctgtaaattcgggtataacgtcttctccatctttaaaaaccggtataaaatggcttcttcagtggcttgaaagacggtttcaaccgatgtgacagctttgacccccatcaacttgctgagtcaccttatggatccacttggcagtgactttctccatcataccttcttcctcacccctctctctctctctcctctcttccctcgacgatcgatgtgttggcatggcggtggccacaaccagcgatggcagatgcatccgtgctcgtgactctgctgacactctccatggatggcgctgcggcggctggggcggaagcggcgtggtggacaccaagaaatggacaaacaaactagtgcgtctgagttgaggaaaaaaaatactactactggtactacagtactactgcactagctttgcgttcttgctgctctcagcttctctctctctctcttctctctggctggctgagtgagtgagtgagtgatctggttaggacacacataatgcatctgatggtagtttgacggcgacagcagcgatgacgtggggttgagagcagccggaggaggagccaacaccagtgacatggagcggcaccccctggatcggccgcgccgccgtccatcagtagagtaggtaggatgcagggttgctgccaccgccacggcaacagatcggtcgtcggggaaagagaggacgaagagggaatagagagagggggagaggtgaggaagaagataggatggaggaagttgccaacataacgactcaggagacagttaataggatcaaagctatcacatcggttgaaaccgcctcccaaaccaacgaaggtctccatttgtaccagtttccaacataggaaagacgttatacccggttttgcgattggaatgtgcgattcaaccatgagcaagagttcattcagtgatattggaccggagtggagatccataaataacaggtgcaaaatgatctctctctctctctccagatacctgttaaactgaataatcactgaatggaccagcaataattatcatgcctgttctgtcttttggtttctacctaccagtactcactcaattaaccaagatattaatcgcctcagatattaatcacacggtggaaatcgaagggtcaaattaaaaatcgcctgcttctttcatatgtagccactcggttcaccgttcacaccatctcatttctctgaagaacaggagcttaacagcagcatatatgcagctgctttccggcgtcctctgatttgccacgaacaactgctgctttctttgtgtgatggatctctccaagtttgtggcgaatttgataggtttcttccgcaggtatgcatgcgaaattaaattggattcaaaccatttttgcaaatcaggtttttgtttcgtcattttttatggttcatttggcaaaagttttggtcagaaagttgatagaaagaaaaagaattgccatgcaatgcaggtgcgtctcttctgattgtggtgttcaacgagttacagcgagttgaattactgctaattttgtttggaaggcaagaattattttacaagatattctataatgtacatgtaaaaatcatacattttttcttcttcaaaatatttttttcactcgattttacatgaatataccgtttacacgattctatctgaattacacgattttacatgagtataaccatgccattcggtggcaaggtgctcatcgcgaattcaacaggcaatatagcaatatgagtgtatttttgcataattgtgtgaaaaaatatattttgaaaaaaaaatctgataaataaagttcttcaagaacaaaaacttccgaaaattttctagtgcttaaatttatttacttgccaattgagatcctggaggagggagttggtgaagggattggtcattggtgttttacttttactcccaatctctcctttttttttcttttttacatcacaatacaaatgcaggcgctaacgcacattcacccccctatgaacgaatacacgcacaccctatctctatgagagtaaggatggatataaattgaattcgaagtgatgatgtacgctaagatttagttcgtcgtagtaaaaaagggaagaagataggatagacgaagttttgacagagctgacttaggcagtcaacgtggtcaaagttgtcacgtcagtcgaaaccgtctcccataccatcgaaggaaccaatttgcattagttttcaaaggtaggagacattatacccaattttgcagttaagaggtgggattcagccaagagcaagagttgagggaggcagaatagacttattccttcattcaatgatattggaccggaggagtggagatccataaataacatgtgcaaaatgatctcattctattttttagggaaaaatgatctctcttttagtaggcagaaaatacttacaaaaaataacggtttcattttccctgcctgttcatatacctgttcaactgaataatcgctgaatgaaccagcaacaataatcatgcctgttctgtcttttggtttcttcaagtactcactcaattaaccaagatattaattaatcgcctcagatattaatcatccggtggaaatcgaagggtcagattaaaaatcgcctgcttttttcggacgcatccagtcggttcacaccatatcatttctctgaagaactagtatatggataagatcgtattgatccagttcgttatggtaggatagaattattttccatctctatctcttcaagtttacttaagttccaatcgtccctaaggcttattcgcagtatctctctccctatactatctaacactggagcataacagcagcatatatacatgctttccggcgtggtctgatttgccatgaacagctgctgcgttctttgtgtgatggatctgcctaagtttgtggcgaatttgataggtttcttccgcaggtatgcgtcgaattttctctggttcgttgctgtaaattagattcaaaccacttttgccaatcaggtttttgttgttcattatttggcaaaaagtttttgctcaaaaagtttgacagaaagaaaaagaattgccatgcaatgcaggtgcgtctcttctgattgtgatgttcaacgagttacagtgagttgaattactgctaattttgtttggaaggcaagaattattttacaagatcttctataatgtacatgtaaaaatcatagaatttttttcttcttcaaaatatttttttcactcaattttacatgaatataccgtttacacgattctatctgaattacacgattttacatgagtatagccatgccattcggtggcggcaaggtgctcatcgcgaattcaacaggcaatatagcaatatgaatgtattcttgcaaaattgtgtgaaaaaatatatattgaataaaaatctgataaataaagttcttcaagaacaaaaacttccgaaatttttctagtgcttaaatttatttacttgccaattgggatcttggagaagggagttggtgaagggattggtcattggtgtttaacttttactcccaatctcttctctttttttttaaatttttaaaacacaatacaaatacagacgctaacaacgcagttacacccaccccctatgaacgaacacacaccctatctctattagagtacggatgtagataaatctaattcgaagtgatgatgtacggtaagatttaggcaaaatttgctacaggacacgcaaaaaacgcgtaattagctgagggacaccgagaaaacgtgaaactgcccgaggacactgcaaaaattgtgtaattgggcatatgacactggtcgcattattttattatttccaggtcaaaagaggtgagatacttttctaaatgcacggattgccccttctctttccttctttccctttcccgttgactttaccgggaacgcgtgatgcggcgaggtcggcgcgatgtgggcggtaaaggggggaagcaccggcgtgcggtggctaggcgcatccctttcccctcttcctctctctcttctctctctctcacggggcacgcaagggcggaaggtgggcggcggcgggcacagctaggtgccatgtggcggcgcgcgcggctgggtgccgagtgtctggcggtgacgccgtgcccgtccacctccccgtcgattggttggttcttaatggcttcctcaagcgggagaggggggagcacggtgtcggcagcggcggggggagggggcgtcgtcagcggtggttggtgcggcagttgcggatgcggaagcagcgccacctcgatggcctcaccgcacaggtggcgcaccttcgccgcgacaacgcgcacgtcgccattgtgcttggcctcaccacccagggcctcctcgctgtcgacgccgagaatgccgtcctccgcacctaggccggcgagctcgccacgcgccttgccttggcaatgaagaagaaaatatacttgccattgggggcaatcttgtcattttgaaaaaaatactcgccactttcagctagaaaataataaaataatgcgttcggtgtcatacggcaaatttcacatattttgcagtgtcctcgggcagtttcacattttcacgatgtccctcagctaattacgtgttttttgcgtgtcctgtagcaaattttgcctaagatttatctcgttgtactaaaaaaaagggaattgccttccaagcatggagtttgctcaaagtgcccctcccaactccaaaaaaaactcttatatatccaccgatcaaacaatagacataagggtatccacaatgtggtgtaaaagtagtccataagcaataaaatatttcattcaaccacctattaccattgtgcaactagttcatatagaaaaaaataacaaaaggtatccatatacatatggactacccatatggaataaattatattatctatctctactcttctctcttctcctaatgataccttgtatccatatacattgtggagattaccataggtaaaaactatttatgtgggtcccattcatatggatcattttgccatatacattagtgatgccctaacaatctccacactccaaactctcattccctctattatattcccctaaccaaacaagctgttaattagtgacgcaaaccatcaaccatagggcctggcccatcagcccatatagcccatcatcacctcagggccgaaactacctgctgggccgttcatccaaggcccaaggcccaaggcccaaagcccaaatcgcagccgaacagaaaaaaaaacaaataaaaagagaaaaagaaatagaatgaagtgaaagccatcatctactagcagcagcgaaagccaagaacgccaaaaaccctcgctttgctgctgctcctcccccttctccttcggctgctgatcggattcgcggcgtcccaggctagggatccgggcggtggcggcgatgggcggcggcggcggcgcggaggaggagctgacggcgcaggagacggcgctctacgaccgccagatccgcgtctggggcgttgacgcccagaagaggtatccccggctccgcctctctctctctctctctctctctctctctctctctctctctctctcttcccctaaaagtcccgggttttctttcgctcttcgcttatgtggaggaaattttgttgagttgatgcttcttctttttcttctcttttaatcgcaggttgtttcttgcagaaaaggaagaaaagaaaatcattcttttgggggatttcatggtttatgttagaacgaatggctgttgtttgtttctttaaaagaaaaacttgagccccaagtgtttgtatttttgaagtgaagacagagatatccgctgttttcgtatcttgtgtctgctattgaattttcctaaatcttttttttgagcttgtttggtgctttccttgaatttctcgtaactttcacccccaaattattcttccattccatcgtatttgttagcttcggaaccaaaacttttgatgtctttcatctgtttttgactactgaatctgtgctgcttggaacaggctaagtaaagctcatgtgctcgtgtgcggcatgaatggtactactactgaggtaggtattttaagattttcctctccaattgttgcgttttgtttgtagtttacaccgcgtgggcattcaaagcattgaaacgaagttgcattgagttatggagtaataggggttagtttcatgggccaaattgcccatgtttacctgttgcttttagttcgttattataactcattagttttctgggcatttgattattgctctgttgttcttgtagactttctagtgctatggatgcattgcctgcgagataaaatctcaatgttcttatttactttttaggctggctttttctcttttgtaggacccctgttgtaccatctgttaaagttaattgcttttagttctcaacgtttaggctcaattttctgtagataaattctttcatttatttatgctagcttacgttgttccaatatatgtctatttatccttttcttttacagtcatatcccatgattatctgatcaatgcacttcgctttgttaagaatatgattgctattatactatttactacttccttcgtttcatattataagactttctggcattgcctacattcatatatatgttaatgaatctagacatatatgtgtgcctagattcattaacatctatatgaatatgggcaatgctagaaagtcttataacctgaaacggaggtagtagttaaagtatatgccttagaaactagatttctgtagtcatagagtatcataagcagctgcatcctgactcaattgtatattcatctaggtacttaagtacctcagttcttctggatatattgataaagcttaactcataatcgaaggcagccttatacactaaatgccatttctctcttaccctgtagttctgcaagaatattgttctagcaggagttggcagtttatccttgatggatgatcatttagtcacagaggatgatctcaatgcaaatttcttaattcctcatgatgagagcatatatggtggtagatcacgagctgaggtttgctgtgagtccctgaaagatttcaatccaatggtccgagttgcagtcgaaaagggtgagcctagtctggttttcttcattggtttgggtgtcagaattagaagtacataaagtaggatgccttcttgcattcttgaattgctctcgtcctaatggttaatctttgaataaaatgttaaagaagagattctatttcaatttgtaatcttacacttttagctgcactttaacaaggaaagttcttgtaagaaatcatttaattttagtaacaggcacatgttactatagtgtatcattgtaccaagaaatcagcatatatgttactgagagaattctgatatatctgtggccataacaatgactaattctttggatcttcacagcatattctaaaaacaaatttcttactgtttctgctatttcctttaggtgatccatcattaattgatggagaattccttgacaagtttgacataattgtagttagctgtgcgcctattaaaacaaaggtgtgtattcttctcccgtttagttcttcatcctattgcaagttccaagtcactcagtgtcttttaaactaaaattctgcaacaaatttctctttattgcgctcagttctcacaacatttctgcatgtgttgtactgctttagttgttaattaacgacaactgccggaagagaagcaagcatattgcattctacgccattgagtgcaaggattcctgtggtgaaatatttgttgatttgcagaaccatagcaatgttcaggtatgggcatatatgacatgctatatgttttgttgatttttcagtttaatttttttccagcagtccacatatatatctgtaagcactaagcatcgggcagatgtcttaaattggtttattttctccataatgtttttcatatactgcttccaatattccttcctgtgtacatgcatgtggtttgtgtacttgttagtacttttcttcatgtactctagaggcactcattttttttctatgatatgtttgaactcaaaattgatgtcattatgtcagactgttcatgttaacatattaaatctgatgtacttagcctgatgaaggtgccattaaggatgagaattgcaaaggagcacgtacttttttttggtaataaaatgtagtgtactaatctgctctcactgactggttttcaaccaagttattgtatctgttccttttctgcatcattgaaatggtgatacaaagaaaggttacttagttttggtgcttaaaatatggtaatgtgacactttctagcatattaagttttgtaatttgtaccaaggattcatcttgcaatgctagttttggttcaatcgctatgaatatataagcacttatgctttggaaatcatgatcactagaatgtttcaggaattattttctttgttcagtagtttgggccctggatacttttttgaaggggtatgtgtttttttttttctcagaaggttggaggtgaacccaaaccaaaggagttggcatatccaagtctccaggtaaatgacttgttaagctgatcttttttttatatgtttgagaggaagctgatccaacttgagataacatctttcatttaatattacatgttttgtattgcccctgtagtttgttctctcttggctgccataaatgtagctgtggaatatttatgatgcaccttatacaagctacatggtatatatacatgaaaaccatttaacctgaaaaaataaacaatttgaatagtgtcttcatgttttaataatagtaaacttatgttttcctctgaaaaaaatgattttctgtaagacaaaaaaataaatagacaaaatgcttactctgctgtttttttgttttgactatcagaatgccagagtgcttatttattcgaataaatgtgtatcatatattatatttttacaatactaagaacagtcatcttcaatctaaaacaaagtaaaaccatatcagccggcaatctacatgtatacatgtgccaatttgcagttaatcaaatcctaaaaaggacatacttatttacatagatattgacggagatcagtgtagcataccaacaccatctccttactccttttaaggagtaggtaaactaagtatgattgacaatctggataagacttgaatacgtagatacatctacagaagattgatgtagagcacagcaacactattaccaaatcctcttttcacggcatagaaaaatacacttatttatgctcatgtagcccagccttactattggaggtcttcatttcatgtggtaattaaattggttccacagaaatcccctttctgggttataggtgtttttggaataattttgtaagagttcaaatctacactagacaatgtgctgatgctttctggtttgttcattttgcatacatccctagaagaatggagtagcgtagcatgttgaccttgactttttagctttctttatgtgtatcatcacttaaatatgtgttcaatttgttgccatatgccaccatatatcaccattttggatgcttcagtttggaatgttacagtttgtttatcattggaaatgatcttttatacaggaagctatctccgtaccctggaagaatttaccaagaaaaacaactaaactgtactttgccatgagaggtgaggatgtcagacttttgcagcactgttgaagattcattagtgcagttttatctccccaaatactcaaacaaatcagccagctttctaacttgtttttccctgcccctgcgcatatgtcctcttgaaatgtccttttgcagtactggagaattatgagtcatctgaaggccgcaatgcttgtgaggcatcactttctgatcgacctgcagttttggctctgaggaaggacatgtgtgataaaatggtatataagtttttgtgttccttaatttcaatcatgttctttaagatttttttcatggtgtggtaaataaactgcagtctttaagtgagtctcaaattcctactgctctcctggaacggcttttagcagctggaaagaagcaacatcctcctgtatgtgcaatccttggcggcattcttggtcaggtaggtaccaatgttccattacttgaatgtgaaaattgagtatatgtggttgaactagatggcaattaaggatttaccctctagtagatggtaattgaagtaaactactaacttcacaataaccatttcccccaaaagaaaaaaataaactcctcaacaaatactatgcatccacattttactcctgcagtaattcacttaaaccacattacttgggtccatgaacttaggaactacatattaaggtccttagtgggtcttttcggacatattgaaagacaacttaatttataatcatgaatgatggcccctggctgagggtgccttgcttgtcctggttgtgggtctcacagcctccaggcccaattcccatgacagacactttgcccagacatgtgctgaagtttgactatccttttgctacgtaagatcgatgtaaagctagcagaagtgctgtgtcctctaattatcagttatgattccctagctcagccatacaattttgggagcatgaatgtgtagttctcagtccaggggcccaagatgcatacttggatattgtgttgccacaattagatgatagttacacatggaattggatcggtactctcactggacaccttcaaagatgtaaatattttatctacagccttttggtggaatacggattttgtattgatggttcaaggaattatacacaatgaaagaactagcacaagaaagatttgaacattctgtagcaatgtaaaattttctgaattatttagcaacctcaactcagtgatgtctgaaaggagtccaaaagtagtaatattcctttttttgccaagaaaagtattctgtactttgtcaaatgttaatcttcaaaagcagcaggaacttaattttgttctgttccaaacaggaatttcatctgtgtttatgcacagttctcattgttttgcactctgtttttgcctaacaggaggtgattaagtcaatatctggtaagggtgatccgatcaagaatttcttctattacgacgccgctgatggtaaagggatcgctgaagacattcctcccctttcttcagactgaaccagttaactgctcgactcccattcagcctggcttcactaatccctgtacccattaattagcttcaaattagattagcagtcaatttaagtctgagagatacttagaactctactatttgttatttaagttgtgccagcttagaaatggtatcagatagaaattttacattttgtgccaacaatttcaaagctgaaaccaggaaaggttttgtgctgattgaaagattaaatgtgttgctctgtattctcttccaatgatgtgcctacaactatgccatgcccgtgtactaatctacccctttgttctaaaatataatcatttatgtgcgttttccaatatccagatacattttaaaacgcccaaaaatgattatactctctttctaaatatttgatgtcattgacttttttaaatatgtttgaccgttcgccttattaaaaaaatttaagtaattattaattcttttcctattatttgattcattgttaaatatacttatatgtatacatatagttttatatatttcacaaaagtttttgaataagatgaacggtcagacatgtgctaaaaagttaacggtgtcaaatatttagaaacagagggagtattttggaatgaaggtagtataattttattggagttggcttggttggttataatataatacggtaacaccatatctttgctataattagatgcgctcctttcagaactattcaccgaaacttgctgtgatttgattatagaggaaagctcaagacaacctgttggaacttacaaatatgatccaaatgctggttaatttactgttaccatggggtagcctttagccttaaagctgggcagctggcagtgttgcatgattgtgataccactgaatgagatttgggcagtatacttaaggcatatcaaatctagtttctgaaaattgccatcccaaccacctgtctgtagccacttcagaacaaagtccagttcattcctggctttctttgtgatgaacttcacttcacttggtagggtattagtctattttgctatggatccagtcctgtctgtccttatggttgctgagaaggaaggccaagaaaaaatattgaggatctagagctgcatgtatggtcgtgttcaacagcagaatggttcctgaattggacagggaagaaaggcacctgccacctgaatttgtgatcctgatagttgagcttagccatgaggggtgtatgcaaaacatgtctaatttttctctcattattacaatagcctcaaaaaccaaaagcacaaaagaataatgcatttctacttaactttcttcaatgttgtatattgtttttcttccctctcattattaaaatatcctcacgaaccaaaagcacaaaagagaaatgcggttctactttctctcattgttactttcttcagagttgtgtatttggttgctttcattgaaccatatcctctttttatgcaaagatcatggctgtaggatcaagggagtacttgttagtacctatatattctacatgatgttttcttaattctttccttggacattcatccaagctgtcacacaaaagaggctcacccaacaaacctaagtcttgacaagcaaataacatgttcataggggaccatgcaggccacccttctttcaaatgaaaagggttcccaatgatgagccatgtatttagtatctagtacaataatacaatttgtagaatacaataagtacaaactaacaacccctcattagctcctaatcatagtctctggtgcacaactctcacccttccctttaattcttttgatagcccccatgattcaccaattaagtagattccaagcattgtgcaatgatgctacataacagaggatcagatagacagagacatacatgtataatgtaattaagtaagcattttttttaactcccaaaaggaatgtgcacatctacttgatcaatcatttgatcaacagaaaagaaaagaaaaaaagagcttgtaaatgcatatgacctactccaccaagatgtggaaccaagttaataaatctggtactacttgtcatgtagcaaaatgtaccaatgatgggtgatggtagaacacacacattgacacatatgcataatgcacattgagtgtttgcaagctaatgagatccagcacatgctgtgacacgtgtcccaaattaaggcaaggtcattgcatatttgcatttatatacatagagctgcgtagtgagcgtagctggtcaggttacttggtctacccgagttcaaatcctaaatttgacacagatactcatatttacggttaattattctttcaatggtaggtgatgtacccgtcgacagcaagagatccgtggtgacttcgttaatctcaagatatgtcgactcagttttcccgaggtgctcataggagtagggtgtatgtgtgtgggatgagtgcacgtgttgtgagcgaatgcgtttgtagtttgtttctttagaaaaaagatatacatagagctactccatttaggcaggcattacaaaatgggagaaaaagctggaaaaaggaaggaatatacacttggaaaaagaataaacaatgtttctgtgtgcttgcttgctagctaggagtatagctcatgataaggtgtatgcattgcctgtatttttatgtggaaaaagtgggcaaattgatgatcaagtaggcaagcgcgtgggctccaggatcaaggatgggccacgcatcacccgatcaccgccatgatcaggaaaaaaaaaagagaaaagtttttaaattaaatcatattatttcattgctttttttttttttacttttcaagtgtgcagattggacttctcttttcagatggttctttgtgcccaaaaccccgaagtcataaaccggccatgcattactctgattttttttacaaacaaaatattggctatatttgaataacaatgaattaggaatgcttagaacttgccaaaaacaaatgaactgcttctaattgaattcccaaaccatattctcaaagggggagaccttttcaaactgtgcggcgggcgtacgctcaattcaattcaaactgtgcatggatctcgagaaatttgacttgcaactcgacatacgaatacgcgtttcaactcgtcaaacaacacaaataattgagctcggacacactatcccgtttgctcgagagctgctagcttcaattcgtacgtcgtatttgcagtgatcttgtgctcgtttttttcgtctctcttgtcagaggagcacatgacatatactcttctttactttgacgaatgctcaattatatatatcagcagcctggcgttttagaaatatctccggaccagtgttctgactccatctgactgacgaattcagttcaacagatacgcatgttaattttttttattcgaactaaaataggtcctcaataagtagggggaataatttggatctgatcttatttggcacgaatatatgatgttaaatttacagaacaggaattaatggtcaaaatatttatatggtgcaatgcaatggcaattttattacacctttacaagactcgagtagtgctggtgagcggtgaatctatcaacacccaccaattgaaattttgagcattaataaattaagttggtgagaatctgtcaccacatactcccaccgtcagctgacatgtagggctactaaggctgcgttcgggaggaggagggcacacaaaacaaaatacatattattacataattaattaagtattaactaatttttttgaaaaatagattaatataattatttaaaataactttcatatagaattttttttaaaaaaacacaccgtttagcagtttgaaaaagcgtgcgcgtggaaaacgagagagttgagttgagaaaactaggaaagaaagcagcctaaacactgatgcattttggactaaaaattatcaaggctatgagagagggaaaacgtatacttgttacaatacatgggtatttagcatttacaaatatatacaaacaagaactgaaaaatcaaaatttacactacacaaacaaaaacagggagtgctcgcaggaaattaactttgatgtttaagataaaattttaaaagtttattataaacaaggggacatatccggtgaaaaccatcaaataagtgaaaatccatgaaaaccagacctaaaagttttgtaaattcataaaaaaatttacctaagataggtatagatatgaaatatattctcactaaatttcaagttcaaactcaactttattatggagtgacaaaaaagaaaatttttgaatgaataataacataacactattcacctaaaatttgtcttttttttatctctcaattgaagttgagttttggtatgaatgtatttcaggtctatacctatctctagtcatttttatgaattttagatatggttttagatatggttttcacggctttttcacttatttgatgtttttcattagatatttcccctttaaacaaacattaaatatttatgaattgtgtacatgataccagctgatccagcccgaggtttaattggccaatcctgacgattcttccacttggaccgtgcgcccctattacgagtactgatcctctccacacggtaagaattaagataggaaaatgacactggcgttttgcaccgaccagtgtacggagggcaaaaatgggacacttcaccaaaaccacgtactaccatataggcaaacaactgatctgatctatcttaattcgttgaccttaattttcatttccaaatcaaactaaatgcttaaaacaggacacaattaatgaaaagatatgttggagtttaatttacttaatctcggtcttagtctgaccatgatcatccctgctaaatgtggaattaatctaactgatctaaagatgaagccgttgaaacctattcgtctattaatttcctttgcttgcggttctttcgttattctttcttcttgttcttatgatccagtcgtgtcgtaggaaaagtaggggcgtcgacttaatcatgaatcggtggtcaatactttctgagtgtgtctagttcatgctaaaattaaaatttgattaaaattgaaacgatgtgacagaaaagttaaaagtttacgtgtgtataaaaattttaatgcgatgcaaaagttaaaagtttgaaaaaaaaatttagaactaaactcgacctctatcgatgtagcgaaattctttctagatgtcagaaactagtcagagacactgtacgaacaccttcctggtacgtcaagttgatcgggcgacttataataggattttaaaattgtgacttcaattcatgtattatcccttttatctctcctctttctttgacaaagataatataatggcggaggaactttgttatataccgaccgcacaaaacataatttatctttaactttttttttcttgatcaggaaggaaacggtggcttatctcctccctaatcgtatcaacagtgaaccgataaaatcaaccaacatgataatgccatttcacctcaaccattaattagcacaggtatgattatattaacaaaatcaccagattttgatcgtgctagcttatctcgatgaattaatcgatgatcgactagatgcaccccatcaaatcagtcacaatacacacaatcatggcaggcccatgcaaattcatgggcaacccatgccaagatcccaaccggccggcaaccggccaatcatgcacacgccggccggcgaacaattcaaatctgacggccgccggggtaatcgtcggcggcggcggctggccggccatccgccgctcgcaattatggattggatcggatcaccaacaaacaagctaaaaagacgtagtagctagtacgaaccatccatatatatgcatgcatggtagcattagttgtgtgtgtttgtgtgttctactagctagctagggccggctcacatggctctcaatatatctatgcgtatttgtatctacctatctcttagctaggagctctccagtttcttaattattaatgttttggatagatagaattgatgttgaataattagaattttaactatcaataacttctaaaatatttagcttaaagacactagaaacacgagtctttaaaagtatgtgtatgaataattattctcatgtttcatattataagtcgtttgactttttttagtcaaactttcaaagtttgaccaagtttgcagcaagatataataatgttttcaatacaaaacaaactcccagcctcaacattaggcttatcatcatatttgcaaacgaaaaataatttatgaatacaatttttatatacatgttcttaatgatctaaaagcaaaggctaaaaaataaactacgatgaaaaaactccaaatttaaggttgaaaatttaaattttagctaataggtataagcataagtgaaaagatgaggcctttcgtatcaaaatatatccaatgttaaatttaatgaaactaatttagtatcgtagatattgctaacttttgctataaactttgtcaaacctaaagaattttgactaagaaaaaaatcaaatgacttataatatgaaacggtggaagtaatctctttaaaagtatgttaataacattaaatatttatcttatattagaagaatgcccgtgcgttgcaacaggtgaacactattttaatcttattattgttatatggtttagttaagatgtaatttactataggaatttgattagatatatttttttagaaaattatgagctacaattaggagtcctttctatatttaaaaaatgaacgaacttaaaaatctactcaaatacggatatgtatttccaaaagcgaacgaaattaaaactaactcatacatggatgacgtaccaaagtaccgacacaaacatctttaatttttataatagtaaaaaatatatgtaatgaaattataatcaaagatatattctagcaaccgtgttgctgtctaaaatatcgagaaattatatatgtaatcggagggagtactatcacatcatcaatgatctctatgtgtgtgtactgtagagaactagacagagatgtggatgcatgcatgatggatggatgggtggctctagttaagctctagctaggtacattgttggtagatggcagtgagccatcgatcgagtgagtgatgcgtcacatagctagcttcctttcgatctgatgcatgtgtacgtgctctccagcgatggagatcgatggagctatatgtgcttaatttggagcctattggttgtaccatgcatgcatgcagatgctggcagtatatagtcttcagggatgcaggtcctctgcagtactgcacagaggatctcaattgagtctttagatacatgtttgcctgcgtgtactgtggtctgtggagaggatgtgtgaagaagcctcccatgcaattgagctcgaaattctagtgtttcatcaaccattttgtaaaaaagtactactccctccgtttttttatacaagaatccattaacttttaagatacatttgaccattcattttactcaaaatatttatgtaattatttttttattgcgacttgatttattgtctaatgtatttttaagtatgacttaattttttttatattcacacaaaaagttgaataagacaaatatttaaacgtttatccaaaagtcaacgacgtcatatatttaaaaatggatgtagtagtagctactctctccgttccataatattataacctaggactggacgggatgtttcatatagtacaatgaatctcattgcactatgaaacgtctcatccagtcataggttttaatattataggacggagggagtagctacttagctagttaggtttcagaatgcatgtgatctatatatactccctccgtttcacaatgtaagtcattctaacatttcccacattcatattgatgttaatgaatctagacatatatatctatctagattcattaatatcaatatgaatgtgggaaatactagaatgacttacattgtaaaacggagggagtatctatgagagagactccttgagatcctggactagctagctacattatcatcgatcgatttgggttggaacattatccagttaattagatggatcgtgtgcttaaacttttttttcccacaaccaccatgaaattaaagacgatcatcgtggcaagggacaacaatggccaaaaccggtgaacatatctgtccttggttttagaccaagtagacttctcaacaaggtgttatgatccgccagcgtatatagacagatctaacagtgcacgttcgctacattaattaccggccaagattgaagatgagtgtgcaaccgccacagcaaaactacgtacaattcatcaccattgagggcatgcaaacaagattgtacaagagaggagaacaagaaaatgatcaaggaggactcgtgcatttctatcatcgacatgtccgatgagtacatgtgcactagtaataatgtactatcttggcaatatatttaggtcgtctctaccaagccaaaaacataggtgaccaactaatcttattggtttttagtcctatgatgatcattgattgcaaaggaagcgtaacttaaaagattgtgacatgtcataacgatccatcagaagaacattgtttttggaaagttagcgtgatacattaattgtgttctcatatgcaggggcggatcaaggaaaaaaaaattgggggctttattacacagtttcttcaacctcagctatttagggacctttagtttatcattcatggtgaaaaaattgaagggggtgctccaggggtatccatgggtcttgtggatgtaaggg

SEQ ID NO: 1417 - DNA, 26359 bp, Oryza sativa
  unsure (1)..(26359): unsure at all n locations
atctctacccctgtctctctatgtaaaggtttgtatacatacgagcactactatagaaaacccttttggtgccggttgccagccctacataggtgccggatttgacaaccggcacctcgcaggcggcacttatgagtattgtcaatggtgccggttcaaaaaccggcacctttgagttgtatggatcgcaagaaaaaaaatacggcttggctcgtgtcggagccgggaactaacaacttggatccgactatgattaatgtatcaatccctggatcagtaaatattgatacatacaatatatctggttcttcattgcatatgttaaagttttacaatactaagggttttacattaataggtactcacctaactaattaatacacagcggaagtttctatacattctaactgggaggtataacctttagggattctctaagttatcggggtcatcgtagtaatagtcataagggtcatcctcttgacccaaatctgaaaaagaggttataagagcaaggatgagtattcacaatacttagcaagttatcatggaaatatgttatgcattaacatatagtagggttctttgcaaaaagcagtaataaacaatctgaaagagttatagcaaaaatttataaaacatatagactttagatttctaaccagggtaccacatgagtcccggtactcaactccatgagtacagctattcgaatagtttcaaagatattctactccagcagatgtacgctttacccgcaatccacgacttgctgataatcatcggttttagtcatggcccagtattaagtcattaacaattgtggcacctgttccatgaacttatatcctcatatgctctgaacgtattgttaacagcagcaagaggagttttggcgttcccgaggtatttaaggggaactgatcgtatgacaccacgtcatctcgatcagggtttagaaatataccatataatttatactcgagtatcacaaaccatttacctatacatggtaatggttaaagttgcccttcgcggctattgttgcctcctgcgcgaggacttaaaaatatgaaccactatacagaggagccatattgctgattaacataataactaggtctgtccccattctagaaactgcggcgtactcgttcgttcgacataagtacctggtaaaacttatatcgattgagatagtactagccacccggaaatcaaccaaatcttacgtactgtcccaatctaagtataaggtattttaaccaaattgtaagcaaagtaagcaatactaaattatctgggtttctatgattgatttatgcatataaaatagaatattgaatagaaggctataaataaataatttgtaaaatataggcttaaatgatcaaaaggtttatggtaacttgccttgctcgatgtcctgagattgattgatattatctattaagtcagaagaatcctcaagacctagggttagacatatataaaattcaaattcaaaaggaattcaaataaaatccaaaaatatgaaaaatagagaaaataaaataaaatgcaaaaatagcaaaaaggggatcaaaagatagagaatgattttagaagaatattggtccaagtttcactggaattgggtctatattttaaaagatatgggcttctaaagtttgaaaatcaaataaaagtgaaatgttactgtgtgcgggtcccacctgtcagtctctctctctctctctctctctctctctctctctctctctctctctcttctcttcttctacctctagccgttccccaaaagcggccagcggtgctagggttggcgattacggcggtgatggaggggaaaagtggttgcggccaaagaggggagggagctagggttctctggctacggcgagcggcggcggagagattaatttgatgtgtggatgggttggcggctagggcggcggtggcacggctaggccgtgatggtgatcaagatgatatgagttagacatggctaggggaggggttctagagcatctatagagtgcctagatggattccgatagcttgccgacctttggcaaggcacggagaatagttgccgacgagcgcctccattggcggcggccgtgctcacgtcggcagctcagggggtggcatgatagtgcaaaaggattgttaaaatggaatctatgtagtatgtagatggttgaaacggaagaactcaccgagatcggttgaaatgacaaattgcggccggaaaaacttctcggcggcgaagaacagagcagcgcgagggcggcagtgctcggcttgatgtggtgaggtaaaacttgatgtagggctttggttaggacttagtatgctagaacatggtaggatataggtgctctaagggatatttagggcggaggatggatggaggggtgtggagtcgatcgcgcacaaggtgttcgaccgatgggcgagagtggttgaaggaatgtttggggaagcatagcttcggagttgtggggttatggttgttgatgatcgatgatgaacaagcaagggattggggtcctatttatagggttagaaggagtggatgagctcgggcactgtcatcgccatggatgagctcaatctttggatagggctggggcggcagaggttgtgagagggcggccaagatcaatttgagtggcaggaggccacgtttgaatacttaccgtcgaaggattggcttgaccgtgtgcgaattcggctggcgacgtgttggcgccaatccaggcgcgacgcgcggcggcggcgagggtgaaaacggccgactagggagtgaatggtttgaattgtgagaggggataccaccgtatatcttcaatccaaccgtgcggcaagaattggcgtgattcaccccgggtagaagcgaaattgcactcgacggcggctttggacgggcgcgcatggcgtcgagcagtgatttcatgcggcagtcgtcgtcccggctttgtcgtcgtcaagattggtgcggcgacgacggtctgagggcgtcggacaggcgacagcgcgccaaggcggtcgggcacgcgtgatcaatccggagaccgacgcgcgacggctcggcgcgtggcaaagtcggacgccaggacggtgcgcgcaaggggaggagaaggccaactaaaccatggtttttgagtgggatgtggtcccctaggatcaattctagactttgcacaagattgggtggggattgggctaagttagttgggctaggcattctgtcaaacaccttgaaggcaatgaacagtgtttttcaggaattttgaatatttcactagggtttgaagtgtagcaaatcctcactaatattaaggtagactaaagaaataatttataatttgaaatttgagagaatttgctcaaatttactaaggtttggaataaaggaaataattagagtaagttagtagggttctaaagaagtaatacttgaaccaatttaagaatcaaatagatttttttaaaaaacacactaatttaatcaaaagccagcatgatgcagtcaaattttagtttaaaatttgaggatgttacagctcggctcaattcgagccgatgcctccaagccaaaaaaaataatcgaaaaatctaaaagaaaatgagataagttcttgttcatatagataatcacaaatcatacattaacatcaaacaaatttattcacaatcaatcaaaggagaggaaggagaggccactgctgccgttctgccaagccgccgagaggccctactgatggtagacaatcgccgatggcgagatcagcgagagagaggagggcgagagaggatggcgagggagagcgggaagtagggagaaaacgacaacaagaacaagaacaagaacaagaacaagaaaacactcgtggggcaccgccgctacctcccctcccgtcagatctggcggaagggagggcgccgcccgccactatcacctctcttcctgccgtcgcccgctgccgccacctcccgccgacgccaccgccacctcccgccgacgccgctgccgctgcctcccgccggatctggcggaggggagggcgccgcccgccgatgccgcctttagctcctcccgctgctgccggtatcgctgtctcccctcccgctggatctggctgaggggagtgtgccgcccgccgatactgcctctcctcccatcgccgcctgctaccgccgtctcctgccgctgccgccgccacctactgcaaccaccggggaggacgaggcgagagaggaggcggaggaaagaggcgaagagacgagttcgagagagagatgagagataagaacgtgactctgttgactctggatggtggatggatggacaagaatggcttcccgtgtggctcagctcggtattactgggtgccctttttttaaaaaaaaaactgacacatattccttttacaacaaagatgctcgttttttggtgggccccgcgccaactactctgatgggatggatactacaaggtaccggattttcaataaaacccgacatctttctctgacaccagtaataggtgtcggttctttttaaaaaccggcatctattgagaataaaggtgacggttctttggatttcggcgggctgacgggctcatgtacggagaaaggcgctataggtgctggttttacctactctggcacatataatgccagcatctatttgatattttgtagtagtggagcgtgactgagggcaccgtaccgagaatgaaatatgggtttcacaatatatatttcaccaagaatgcatgaggtggagctaggtagattaatgtactaaaagatattccacattcattagtatcatggagagacaaactggggtacctaggcacatgttgcacatataggccaggacccaggaccaacttaggtaacaatagaccagttggtagctcatctaataccatcaattgttgtcaagtttgtagggcataagttttgagtaaaccatagaaagtttagagtacaactttttctaggtgcatattaaggaatatactcgtgtattctctatccattacatccatgagagttccccacaaagggttgaaaactttttagtttctctaatctgctctcatgctttagttgaaacaccccgttttcaaagctacagtatatatatgtttcttttgaaagaaagcgttgttgattggttatactgaccttcactaataaagtcgtgcatatctaaaaccagttatggtgaaattgataagacattcagacaattaaacggatccgtatgttgtcagtgtcctattgtttcgacataaaactaaaatccgtgcgtgcctatgggaatttatgccgatgaaagaaactaacaataattcacaagcactgcgatctgtggcatatttatatatagtttctactgacagtgctatgtcaaatttctcatcagcgatctgtaatactatcatcaaaaaaaaggttcaaagaagatataacgtacagggttcataaatctgaatcgtttctgaaaaccactcctgaggttttttggttttcatgaaagccgttgactacggtgaaattcgaccaaaatttgttaaaattttaaattttagtttgatttttttacttgatattgtacaatcattgtataaggatgtgtcacatctcgtactagatttgtttttatttgggatggaggaagtcacatctcatcctaggtttgttttttatagaatggaaagagtatatgggtgtgtttgattgcccggtatgcacctggctcgcacctagccagcagattagatttgtgcctgtttggttgtgtgcaactatcttagagccagacccgatggatgcaaaaaaagacccatggagccaggctgagaggaaatggtcgaatcaaccttcgcaactcagcctacctcgtctcatgctgtgaggctgcactcacaggtgcactgtttgcacccacgcgtgcagaacccgtggatggggtcaccaccgtcccttctctcctcggcatttgttccaaaccagtggtttagttttgtatatgtggttacactactttaaaaaaaatgtataaggaccggctttaaagatgccggttggacaaaatccgggacctattaaacgtttttcgccaaaatccagctgagagatgagtatttgtatcggtcttaattcaaaaccggcacctattacccttccgccaatgcccaccaacaaaattaatgtcggccgctggtaaaaatcggcacctatgctataggtcccggttgtaatcaatatccggtaaaaaaatgacttgccatgagcacgtatatttgtatgcttttttgaattgtcaaatataccagtgtcgccgatgaaattatgtacatgatttttgctataataatcactctcttgcattttgatctagtaagccaggccattccattatggaccggagcaacttagtaaaacatacatacgtagtacatcgattctctaacagaaacatgagctcaaaaatattagtaggtgggcatagacccagagtaacacaatttaatctataacatctattgtggattaaccttatcacccataaacagatttagggacttgaaaaaaatctcgctccacaaactttatatggtaacttcaccactcacaagaatagatatctatccaaccaaacatctcctacatacaaccattccatcagccctgtgctacaactaaacacttgcatatgtatacgttaaaccaggataaactgatcaacctggataagagaaatgagccagacgtactccgggaatacaagcaaccaagcacaccctatatgcatgcatggcaggctacattattcgttactaaaaaaaagcgtgaactgtacactgatggagaaaccctttttactcccgattggtaatcctctatagccaaccgagagtaagaatacgggactaaagatcgctatctttagtcccgattcaaatacccgagactaaagatcgatctttagtcccggatggtaacaccaaccgagactaaagagagagatatttagtcaccaaccgggactaaagagagggtagcggcagtcagatggttcccttttctttttctttcttttttattttctcctggatacataccccaaatcaaagtaacatcctaaatctacatcacaaatcttaaagttacttatacacacaaatcaaatacatcacaaatcctaaaaaatacaaacaaatgaaatacatcacagatccatacaaatgtgcaataaatcacagaattatccatacaaaagtacatcttagtgaatcacaaattaataaaaaaagaaaacaacgcgggctgtctttgccgtcgcccaccacagccgccacctgcggccccgccggccacccgccgcctgcccgccgctgctgggcgtggccccactggccgccgccgccacccgtccgccgcacgtcgcctgccacgcggccgccgccgcccgaccggctgccgcaccccgttcgccgcacggccgcctgtcgcgcggccggctcgctccgccaccgccgcccggtcgccacagagagggggaggaggaggaggaggcgggaaagaggaggagaggggaagggggaggaagggaaggaggcctctctctgatcgagagaaggaagggggaggggataccgagtcttaatgaaggagagaagaaagggggaggggataccgagtagataagatcggcgcacggctcggcagtttattttggtcctagtagatcgttagtctcaattgtttataccaaccgggactaaagataattggagcctgactcgacccaccaacctctttgaaccgggactaaaaatgatctttattcccggttggtgttaccaaccgggactaaagatcaaaatttttttaaccggaactaaaaatgatctttagtcccggttttattgcaaccgagactattgtgaaatttagtcgaccgaccaaatatgatttctccaccagtggtagcaagtatacaccgtatactccgtggacatggtaccggagatagaggtggatgatatgatattaatgttaatttcatgggatttaattactggtaagacatgctgataatgaccacaatatgttcagcccctcgtagatccttaatcagacattttcaacgacacgaattggttaaactttcgagtgatggccaaccgccgcttagtgcagtcgagtaggtaagtgaaaccatgactatcaatatcgctgcttgagtttaccagagatgaaagattaaacacgcattagtgtaattaagttttaattatattaaacataaaaatagatttatatgatagtttagtaattgttacataaaatgttttcacacaaagtacacagttttgtagtttaaaaaatggtaaaaaaaccaaaataaaatctatatcttaataaaaaacagagcagaagccttgtgttcacttcttcaacttgtgacaccacattttagattgccacacctccttagcgttgtatttgatggcttgccatacgttctgagcacctagcctcacgtatcataaacttaattatttacctaactctaccacaagtatacaagtatagcttgtaatttataggcctaaaaaatataacatgccacacttacctaaagtgaatcctgacaatgttagttagggtgtgtttagttcacgctaaaatttaaagtttggttgaaaatggaacgatatgacggaaaagttaaaagtttgtgtgtaggaaagttttgatgtgattaaaaagttagaagtttgaagtaaaatttttgaactaaactcggccttaaaaacaaagagcactatttgctattttgttccttttgtgtaactttatttcaactttcttttaaagtagtactagcccaacttcaacttcaccttcccaaactgttaaactgtgtaattttttttaaaaaaatccatatagaagttgtttaagaaaaaataaataaatatattttcataactaacacttaattaattaattatatgttaataaacttcttcatttttacatgaagtggaaatatttcttcctaagcatgcatgaaaatcgaacgagtccttaataaagttccccaaaatgccctcacgcttcccctccctctaccccacccacagagccacttcccggtgggtcccacacccccacctctcataactgcatcagaaaaatgggagggcgtgcgcgggtcccacctccccatgtgtccctccctccccgcacgccacgccatacaaagcctcgccattcccccccaaccatctctcctccatctccaagaagcagtctccacgccgatccgagatggccgcagcagcgcagaggcggcggagcagcagcgcctccccggagttccgcttctggcccctcgacgccgaccccgccgcatccccctcctgcgccgacgagctcttctccggcggcgtcctcctccccctccaacccctcccctacccccgccgcgacgccgacctctccatgtccctcgccgtcgcggatgatgatgatgatgaggacgaggaggaggaggaggtgcagcctggtgcggccgtcgcgtccagggcgccgcccactgctgcggtggcggcgtcgggtggtggtggtggtgggtcgaaaaggtggacggatatattcgccaagaagcagcagcagccggcggcggaggagaaggagaaggatcagccgacgaggcggcggagaccggcgggaggcggaggcggatcggagctgaacattaacatctggccgttctcccggagccgctccgccggcgggggcggcgtggggtcgtcgaagccccgcccgccgccgcggaaggccagtagcgccccgtgctcccgcagcaactcccgcggcgaggcggcggcggtggcgtcgtcccttcctcctcctcctcgccgctgggccgccagccccggccgcgcaggcggcggcgtgccggtgggccggtctagcccggtctggcagatcaggcgcccgccatcgccggcggcgaagcacgccgccgcggacaggaggccgccgcaccacaaggacaagccaaccggcggcgccaagaaaccccacaccacctccgccaccggcggcggcgggatacgcggcatcaacctgagcatcaactcctgcatcgggtaccgccaccaggtgagctgccgccgcgccgacgccggagtcgcccgcgcctccgccggcggcggcggcggcggcgggctcttcggcatcaaggggttcttctccaagaaggtgcattgagccatggaagcctttctttcaccttagctagagatccaaataacttttaattttctcctctcttttttaccctcctttttttacttttctttttttttttaccttttgtaacttttttgtttaacctttggggtgcttgtgatcatgatgatgatgatgatggctgttaattacatgtaattaagccaataacctgtttttgtaagtgtgagtgattgatattatgtactatagtttaattatgattaattaattagcactacatatataatataattagtatgcataattaagtatggttatgcagttgagcactgcctacactctgcagccggccggcacaaacacaagcagatgatgatgatgagatgcagaagaagatgctctctgcttggagaagagatactactgagtacattattcctttgcataataatgctgcatgtggatatgattgtgccggcacaaatggttcatatttttgcaatgaatttttgttatgccgacgcttgttttgttcttggctaaattttttttttcaggatcatcctctgattggatctttgcacatttttatattgctctgaaagggagaaaagaatttctgcgttttatgttcagtttaaattcagcccccggaaactgaactttgtgcagagatttctgcattttgcactgatgaatttatgcaaaatgtagaagtattttggtatgcaaaatttctcccttttgaggctttgacaaaggtggcaagtggaattcattaattagagcaaattgcatgcttcataatggatatctctgcctactaaccacaccagtctactagttggaatatcacattagctcatccttaatgaacaagactttggtctactcaaggtgtgttccaaagtcttcgtgacgtctgggaccatcatggtcactccaggattacaaaatgtaagagcaagtcgatgtcgattgtagttctattatgttgggcctgctcgtttgataattcggatatttatttttctaagataatagaaatgatttacatcttcggtctcagagataaagacatacatcctataaattttggtacctaaaactagaatttagtcttaggattaatttaggcttaggccaagtttagatccaaattttttcttcaaacttccaacttttttatcacatcaaaactttcctacatacgcaaacttccaatttttctgtcacatcgtttcaatttcaaccaaattttcaattttgacgtgaactaaacacacccttattcttcaagttcttctttttaagtgaaacactctccatgcgtaattgagcaaaggtaattaaaatctagccttattaccattttttcttccacaaacgtactaccactacatattattctcacattgactttgttggaatcaaaccaaacaacatcccaatcttcactagccatttttttatgatattaaataaaaaccaattcatattggtgtcaacctggcctgccggttagaggaaaattttgtcaacttgatactccgaatcacagccctcaagtaatcaagttgacggacagcatatcaacgttgttctgttttcttttgaggtaatgtgtagaggtgtgaatgaattaaacctaaattaacaagttgttccggtccataatattgttaacaagttgactcttgcttacaacttggccattaataaacggattttcatggtacgacagcatctcgcacaattcgcctcaaaaaattcttttaaacccaaaatgctgtgtgatgatcaagctcgagtagttccagcgacgtggcgacgatcgatcagccacgtgcgccggcgtggcgttcgaggccatctggcacggtttaaaattcaaagtttcgaatccacgttttttttaaaaaaattcccgttccaaaaatctttttccgttccaaacttttagtacgaatgtgatactccagcgctgctagtaacttgtttggactgttagtactgggatctatcatatcttatactgatttaaggtcttagggcccctttgaatcaaaagatttatgtaggaatttcataggattcaaatcctataagaaatttttctatttggccctttgattcaaaggattgaagcttttcaaatcctatgaaattcctatggaatggcacattgcatgtagattttggagaaaatttagcaagagctccaacctcttggaaaatttcctttgagtctatctctctcatccgattcctttatttttcctgcgctccaatcaaatgacaattcctgtattttttctgtgttttgcaatcctctgttttacacttcaattcccatcagaatcctgtgtttttcctattcctccgttttttctaccctgcgattcaaagggggccttatcgtttggcttttttcgtaataagccaaaacgacttattagagaatacaaatgaatttgtagataaaacttttatatatgtgttcttggtgacttaaaagccaatgctgaaaaagaaactacgttgaaaatatctcaaaatcaatgtcaaaattaagtttgaaaattcaaattttggctttttctttgactgaatagaccatccgatgggagccttacttagtatatcttgagataaaggatgtcttatctttacactacgtagtaatatctagtactatatggcatgatcgacatttaaacataattatttgacaattccttttatcaaaaattcagtgaacatatgtaaaactataagttattcttagattatattattgataaaaacaaataataacaaactaatttgaatggtcaagtgtcttgcagaaaagttaacactgtcacatatttgaaaataaggttgcagtctattggttacagtgacttgagtagtaccttaaggtttgaattcaaatctccaaagaagcgaatttcatattgagttgtttgaggggctaagtttccaatttaaatggttgcattagcaggttgaatctagaggtcgagtgaaaaagtacccttctcaaaaagaattttgaaaacagggtttttaagttgaaccaatctataattttgggctgttgtttgattctccttttgcaacaagctttgttttggtttgcttggcttggcttgcaatggatgtactcctacacgtactggtagacgtccacttggcgagttcgattggactttggagggagggcattggggtcgctgcgtgcaccgtgccaaattaggtttagtttcgaggcgtacgtacgtgtttggactcttccttcctggaacacgtacatctcgctgctgcgctcgtgcacatggatccttttgcccatgggaaaaaaaatactcgtaaagagtaagggcctgttagtacatgtcacattggatgtttagacactaatttagagtattaaacatatactaattataaaacctattttataactaaggactaattcgcgagacgaatcttttgagtctaattacgccattatttgacaatgtgatgctacagtaaacttttcataattatagataaattaggcttaaaaaatttgtcttgcggattagctctcatttatgaaattagttttttttattagtctatgtttaatactccaaattagcgtccaaacatccgatgtgacatggactaaaaagttttaaccccatctaaacacccccttactagcaagtttaggggttgtttgggaacttgggactaaatttagtccctctcacaaaaatataagtccttggtagggacttatatagggacttatatttttttgagagggactaaagtttagccccactttaatccctctaactaaacaccaccttaatagtatatagctaaccattggctccaaattatctatagttaatctaatagcccattcatacaatagttagctataaaatcatgctacaccattaatatccggtcccacatctcatacacatataacgttttgaagttcgtgttacagctaactacaaatctgtagtccgctttcttcttgatatgtggttatagctggcttatagcctgctattgtacatgctctaattaagagatttgtgtggaatgtcatactcataggccggttttgttttcaagctgcccacggtgatgtatggctgcggtcgaatatgaggtttgggctttaagcttatttaacgtaaaaatgagatgagttatattaagtaaacatactgtttaagaaaaatacacggtttaacacattttcgtgataaatcagcagccagtagcttaaaaaaaactatgaatcctaagtaaggcgtataaataaatcgaactaataaaacctttgatgtgacccgtggttatgaagggtttttaaggaaaccattgttgttcttatatgaactcatgaaaatatgttgtatgttagtcaatttggtgttgttgtaatgataaagtttttaatggtaaataattatctaaccttatgcatgttatcttcatattagcttcacttttgatctacattgctaccacaggagcagcaggatattatgcacagtgtaactacactcttgaaatcagtagttaagatttcttattccactataagcgacgtagttccattaaaattgctagcttaaaaaaaatctatgtggtttaacgctagtcaataataaaggggagttgaggatttatcccatcacctcatctcttattttgatttatttttatctttaccctttttttagcaaacttacggttgtgtgtcttatgataaaaatcaaagatataatctattttcattattaaaaaatgaaaatgtgttattgatatgtgggatctgtttatcagactgtcattctgtcccccttttcttttcctttgctttgtttatggaaaagaagtggtctctcgctttgcccggtgtccctcgggaggtgattctgaagtattgaagctcaagctcttgggacttgggaggggggggggatagggagcaagcttcatcattccctgtgctcctcatgttcccctgtttcttctttggttttgttctagacgggcccttttgtgtcattgtccctatccaaagtgtcatcgcttgttgctggctacggcaacagggccatcgtcgattcaaaaggtttcttggtgttttttgtacgggcaggtcagcagcactgcatggatgcttggctgccttgcaaggtcctctctcttgctcttttggttcttgtgtaggagtaaaggccagaggagaggagtttgcactgtcgttgtaacgtgctggatttgctactatatgctaacgatgtacatcttcgttatcagaaaaaacgaacttacaactataaatctatatatatagactatgtctaaatttagaagatttttctttaagacagtggagtagacctttttaactagaaactctagaagagtggacgacctaatatatgtcatatggatccagggagatggagtcatgaggtagtccctgtcacatcgaatgtttggatactaattcggaatattaaacatagaccacttacaaaactaattgcataaatgagagataatttgctaaatattttttaaaagtttaattaatccataattagcatatgtttaatgtagcatcacataggctaatcatgtatcactacactggccaaggtcacctgtgacgggcccaaaccctcatctttgacggcttcgcgcatggtcagtgatcagtggtcactggtgagttttgacgggtggccggccgtcacaggtgacacccacctctgacgggcaagttactagaaggccgtcagaggtgttggtctccgctagccttgagcgagttaggacccgtcacaagtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcaccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacttgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcggggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaacccgactccacttaggtacgatgactaggagaatccaatgtcgcatgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatgtacgtattagaactaatttaattaggagatatagtccagtcatatcacaagtatagaaggtatgcacttacaaggagtagcatttaagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctataaccgagggcttgaaagccatgccctcagcgacttcaggagcgaaagttgggtggactctcgctagtaggacacactgtgctgcgccctgcataaggtgaaagtttgaatttaatattggaatgtgtacatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggatctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagtaaccaagcccaactagaaaagaagatagtcgtttatatgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtatcctgcggtgcccagccgatgcgggtgctcattccgctgttgcagtaggcgatgtgcctcgcttgattccctaaactcttgggtggtcttgagagagcagaattcctcccaaaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcatgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatatgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtatcaacagcatgggtatataaatgaacaagtgtaggggcaaaaaaatgaacaagtgtagataatatgttcttattgagcaattcatcactggccatttaataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagaacaagtgtagataatttgttcttattgagcaattcatcactggccatttaacaaggaacacattgggcagcagcaacaggggcaaagatactccacaggggcagcaacaataggggtgtattaacaagtagcccacaataacagcagtggcaggggtgtattaacataaaacatcactggccatttatctagttaaaatcatgcaaaattcaaccaatgcagcaaaattaatcctaaaatcatctaatacaaaaagactaattcatctaatactgcatatatttcatccacaaatagtccaaattcatcacctcatatatttcacatctcaaatatgcatatatttcatcaaaaaaaaggagacagtactactaacgtcatgtaaacagcaattcatccattcaattcaatcaagtgtagataataaaacagcccacaatcatttatgtggcagcagcagcaagggtatataaatcatgtatataaacaacaattcatgcaattcacctattcatagacaaaaagggtatataaatccacaaagtttagataatctgcaaagttccttaatcatcaaagaatgacagaaaacaaaatgcatggagaattttggtgtctaggtcggttccgttcatggaatacactgaccaatccaccaaaattccccatgcattttgtattctgtgatggtttgataacctcggaacaacattaaatctgcggccaatcaatcaatttttccatttgaactaaatttcaaaccctaaacctaataaagttccttaattatcaaagaatcaattcttccattcatgggcatcagagagagaggggtcctggagaggagacgacgagcagaggaggcggcacacggcgacgacgagtcccggtcgagaggaggaggcggcggagaggagatcccggtggcggcgacgacggtcctggcgtggcgactgagaggaggtcccggcggccgtcgaaagagtgagtgaggcggcagcggtggagaggtcgaggcggcggtggggagggcggcgtagagggcggagatggcggtagagagggcggcggagatggcggcggagaggtcgatggagatggacggcggcggtcgagaggcggcggcggtggagagggcggcagagaggtcgaggcggcggtggggagggcggcgtagagggcggcggcagagatggtggcggagaggtcgaggtcgaggcggtggagaggagggcgtagagggcggcggatttggcggcggcgaggacgccggggaagaggtcgaggcggcggtggagaggagggcgtagagggcggcaaaaaggtcaaaagaaggcaaggcggcggtcgagagatgatgatgaagtggcgccggatctgatcgatctanaagatgtccaaccctaagtcaaccctagtcaaactcacctgtgacgggctccaactatgtggccgncacaagtggcctcacctatgacgaacgccaaccatagaaccgtgacaataaaaccacctatgacaaacccaacactctagcccgtacatataagtcacctataaaaccctacaaataaacccatcacatataaacttacctaaaacgagtgtattttattttatttcacttagttcttttattttccttaacatattttcacatacactacatatttttttatacttaattattttatttcactaacagtagtaattgcacttcattattatactactttaattatattatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtactttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgcttgaccgtgtgaaaggtgtatccatttatgtcatatccttgccaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccttcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccatagcactttgtttgcctcacaaggtgcaccggaagatgttccattatgtcaaagaaagttggaggaaagtacatctcaagatgacatagggttctcacaagttctgcctgtagtttatctagtccctcgggatcaatgatcttctggccgattgcatggaagaaggaacacaaccgctggatcgggtgttgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacatttttctcgacatgcatcaaatctatgcagtggcgaacttcaagatccttccagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcattaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactctgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccgaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatactttaacagctcaaggagttctgtaaaactcttgtccgaccagccattaatagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacaccctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgccattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagtaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacct

SEQ ID NO: 1418 - DNA, 9949 bp, Oryza sativa
atcccgtcagaagtgtgaggatctggcgtagtgtattaattaggctcaatagattcgtctcgcgaattaatccagggttatggaatatgttttgtcattagtccgcgtttaatacttgtcattagtatcacaacatttgatgtgacggggactaaaatttaaatccctggatccaaacaggtagtattgggcctagagtggttcatgacgaaaaaaaatggaaggatggcccttacatattgctactagctccgtccagaaaacatatgtacataaacagttcaaatgaagtagcccgagcctggagataaagcatattttaaggtctgttcggtaaaactctaactcttaaatttagatttaggagttgggtttggaatggagttgtggggcagactaaactcaactctatccctctagtttattttgtgagaacgctccacacagatccgctcctattttaggtggagctgaaactgtttggctagtctccaactctaggagaggtagagctggagtttagacggagatattagtactataaggacgtataagttgtagtttagttcttggagaaattcacatctattcaaggtattttatttcatggaatagaggaatttcagtgactatgaattaatttttgtgaaattttccaaagagaatcaccgatctatttacccaattatatggcttttataaacagaagaaatacgatgtactggcacaaaggataacccttttttagtggaaggataaccggaattttgggtaagatttttatactactgctctggatggtgtgcaagtatatatattggcacgtgacagtgatagggcgccctcagtttcaaattacggcatgtactttactctaacatctaaaatttgtgacaaaaaacttgtagtactactacataatggctaatcggtgccggttttcctaaccgccaccacggaggtagcactgatgacatgtttaaggatagctagtgtattttactctaatataaaacaaagataaaacaaagagaataataatttatcgtttactattacaaaccgtgcggaaaaaaaatgaggatgcacattggaataaatacaataaggaccattctacccctaagataaaattgatatttttttggcacaaacccatggcacattaaatatttctactttttatcaatgcgaaaaaattatcaaatcatgccatgagtacacatttaatttcttccatagtggtaaaattaatggcatagatggaagaaaacattaattcaaagttagcatggcatttgagaaatctaaacataaaaagaattatccctaaaacaactcataattgttttgtaacacatagtaatacaaattgacaagcaaaattgaatcggggtgagaaataatgaatatttactttctaagcttcaatcttcaaaaaaaaaaaggagcaaaactgccccctcctcgagctgatcgggcaagaacgagaggcgccgctctattcttgctcgatcagatcaagtgggatggttgcttatatgtgctcggctaataggtgccggttgtggacaaaacaaagacataggtaccggttttttgtgtgggctccatcaactcctagttatatgaaaggtgccggttttgaatgagaaccagcacatatttttttccacaaagatgccggttctagggttggctccgcgccaactactccgttgggataggtatataatctcttacaggggtaattaaaaggtgtcggtttttaaacaaatgataaaggtgctggttcttgcggtttgggcaggctaacggcgcgtgggcaggaaaggcactataggtgccagttttaccacttccggcacatatagtgccgacttatattagctactatgtagtagtgagtcagtggcgcaggattttgagactaggtatttacttggaatttgctaagtatattgtcctttatgtttggtgaaataggatttaatgctctaatcctattccaccaagtcatattaatctattttttaagtttttatatctagtacttaattaatcatttgttaatctatcactttgttttgcatatgaaggtgaggagttcccaacccctctaaaacaacacagtctaaaacgggtagagtttcacaatgagctgcagtttatgttgtgtatcctctaatctacttcggatgatgaaaaataatctagtacgatgaatttgataggtgtagattatgagagataatctagtacgatgaatttgatagacatagattatattttatcacattttagagagtgttattatgggacgaatgaaagaagatgtactactacacacgcgtacttacgtttcactccgacgagacggggggcaggagccaaagggttggatttcagggggagattcgtcccctgaaaatgggggcgtgtcacgcactgtgtcagcaacggcatcatgggaccatggaaaccacatccatcgaccgatgcagcagcgcgctgccatccatatgatccacgacgcagctgcctgttttctggttccatatgcattccgtgcgggctgtgtatctcatggaaggacggcacgatcgatctagggcaggtcgacgcagacgtcggcagtagaagagcctctggcagtctgcctctgcctctggccggcgaagtgacacatcgcgtcagttcaatcgtcgtctccgccccctgctcagcgcagcagcagcagctttctcgatgggtcgcagctctctctctctctctctgcctgcaatggatgactaccgagggatgcagtactccttttgtttgtcactcgtgcggtgtgcacaaaataaatttcttggccagctgccgcagtagagcaagttttactgtgaacaagttactgccgcaggtggtgtttggttcaatgactaaatcctatcaaatcggatgtttaaacattaattagaactattaaatgtaaattaataataaaactaattgtataaatgagagttaatttattagacaattttttttaaacctaattaatccataattagtatatgtttactatagcatcacataggctaatcatggaccgctcgtgatgctactgttggaattaatagatgggctaaggcccattcgaagattaattctttggaaaatcacaaaagcccaactcatgggatggcatgcatgtggagtttagtaccaccttacttattctaggagagggagacctccttaaaagggaggatgtcctcctagccacttgaagcatgtggggtggagagaagagggggaacacatgcttgcgcagatgcagtctccttttgcagttttgttttgctgcaggaaaattcggatttgttttgttgttggaaacattccgaaaaatccggtgcgtgaaaacggcgtggagtccggataagttacgcacgacttatccggatcggttacgcagagtgatgatcgtgcgagcgccctgatcaagcgacctatctctatataaaccgtgcctccgccttcacgcaacacacgcgaaatcaatctagggtttgcctcctcctctgtgttgcgctgtcgctcgtggactactccatcccgctcgccagcgtgcaccggcgatcggaagagcaggtctccggaacctctgccttcgacgtcctgcactgggagaaggcggcaataaggtttttgggaagcgcttcgcgcgactgctccctgttcgtccgcgacggctcgccttcctctccactcgcgtgctgcgcgccttcgtcgacgctcgcaaccgcgagtagttcttgctgagcaaccggtctttccgccacctcggtacttgttcgacatgttgcgcatatttgatctggtcatgttttactgtttagtttacatgtgtagatctaataatgcgttaatactagtatacatctgtaatgtcatgatttatttatggaatatattaaatcattatatgcctatattctcaacaatccaaaaaccttattataggcgctgtgattttactatggctggttttgccgatacactgaggccagataaattcaccggtgtgcactttaagagatggcagatcagggtcactctgtggctgacagctatgaaatgcttctgggtgagtactcgcaaacctgaaggaattcttactgctcctcagcagaagcaattcgaggaagccactactctctttgtgggatgcattcttagcgttcttggcgatcgtctggtcgaggtgtatatgcatatgaccgatgctaaggagttgtgggatgcactgaatactaaattcggtgctactgacgctagcaatgatctgtatatcatggagcagtttcatgactacaagatggctgaaaccgttctgtagtcgaacaggctcatgagatataaaccatggctaagaaactcgaactccttaagtgtgtcttacccgacaaatttgtggccgggtgcattattgcgaaactacctccatcatggagaagtttcggtactgcactcaaacacaagagataggaatactccgttgaggggttgatagcgtctctttatgttgaggagaaagctcgggaaaaagacgccgcgtctaagggcgatggtgggcagtccagtgccaatgttgtgcacaaggcctataacaagagcaagggaaaatacaaagctcaacagaccaccaacttcaagaaacagaagaagaacaacaacaatcctaatcaggatgagaggacttgctttgtgtgtgggcaacctggtcatctggctaagaagtgtccacagcgcaaggggatgaaggcacctgcagggcagacttctaagtctgctaatgtgaccattagcaacactggagatggaagcgggtatggtaatttacctactgttttttcagttaatcagtctactaattggtgggttgatactggggccaatgtacatgtttgtgctgacatctcattgttttcttcttatcaggtcgcatggggttccaccgtcctaatggggaatgggtcacatgcttctgttcatggtgttggcacggtagatctgaagtttactttgggaaagatcatgtaggtgaagaacgtgcagcatgtcccttctatcgacaggaatcttgttagtggctcctgtctgactagagacggatttaagttggtttttgagtctaataaagtagtcgtgtctaaacatggatattttattggtaaagattatgagtgcggaggcctgttccgcttttccctttctgatttctgcaataagcctgtgaaccatatttgtggcagtgtggatgatgaggctaatgtttggcactcacgtttatgtcatattaattttggcttgatgtctcggctttccagcatgcgtttaattcctaagttttccattgtcaaatgttctaagtgccatagttgtgtgcaaccgaagcaacctcgcaagcctcacaaggctgccgaggagagaaacttggcacaactagaactcctacattcagatctttgtgaaatgaatggggtattgacgaagggtggaaaacgatatttcatgacgttgattgatgatgctactagattttgctatgtgtacttgttgaaaacgaaagacgaggctctagactattttaaaatttataaggcagaagatgaaaatcaacttgacagaaagataaaaagacttaggtctgatcgtggtggagagttcttctcaaacgagtttgacttattctgtgaggaacatggcatcatacatgagaggacgcctccctattctcccgaatctaatgggattgctgaaaagaagaaccgcacactgactgacttggtgaatgccatgttggacaccgcgggactacctaaggcatggtggggggaggcattgttgatctcgaatcatgtgttaaacagagttcctaacagaaataaggacaaaacaccatatgagatatggattgggagaaaaccatcactttcttatttgcgcacatgggggtgcttggcgaaagtcaatgtaccaataacgaagaagcgtaaacttggacctaagactgtggaccgtgtctttctgggatatgctcatcacagcattgcctatagatttttaatagttaaatccgaggtacctgacatgcatattggtacaattatggagtctcgtgatgctacctactttgaaagctttttcccaatgaaggatacatatagtggttcgagccaaccctctgaaataattcccagttcaatcacaccaccagaacaaactgaacatttatatgaacatgtcactaaggaggatgtcagtgaagctcctcgaaggagtaagagacaaaggacggctaagtcctttggtgatgattttactgtgtacctcgtggatgacactcctaagtcaatttcagaagcatatgcatctcctgatgcagactactggaaggaggttgtccgtagtgaaatggattccattatcgctaacaggacttgggaggtgacagagcgaccctatgggtgtaaacctgtggagtgcaagtgggtgttcaagaagaagtttaggcctgacggtactattgaaaagtacaaggctcagcttgttgctaagggatatactcagaaagaaggcgaagatttctttgacacttactcacctattgctagattgaccacaattcgtgtgctactttccctagcagcctcaaatggtcttctcgttcatcaaatggacgttaagacaacgtttcttaatagagagttggatgaggagatctatatggatcaacctgatgggtttgtagttgaaggtcaagaaggcaaagtgtgcaaattgttgaagtctttgtatggtctgaaacaagcttctaagcaatggcatgagaaatttgacaaaacattgacatctgcaggctttgcagtaaatgaggcagataaatgtgtgcactatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattaaaggtgagaatgggattacacttttgcagtcccattatatggagaagatcttgaatagctttggctacattgatagtaaggcttctccaacaccttatgatactagcttgttgcttcgcaagaacaagagaattgctaggaataaactggaatactcccaaatcattggctcgctgatttacctggctagtgcaactaggcctgatatctcctttgctgtcagcatggtgagccggtttacctctaatccgggagatgatcactggcgtgcgcttgagcgagtaatgcgctatctgaaaggtactatggaattagggcttcactattctgggtatcctgcggtactggagggatatagtgattctaactggatctctgatgtggatgagatcaaagccactagtggatatgtcttcacactgggtggtggtgctgtttcgtggaggtcttgcaaacagactattttgacgaggtcaaccatggaagcagaactgacggcactggatactgctactattgaggcagaatggctgcgtgatctattaatggatctacctattgttgaaaaaccggtgccggctatccttatgaactgtgacaatcaaacggtaattgtcaaagtggatagttctaaggataatatgaaatcgtctagacatgtgaaaaaacgattgaagtctgtcaggaaattgagaaactccggagttataacgttggattacatccaaacagctagaaacctggcagatcccttcacgaagggactatcacgaaatgtgatagataatgcatcgaaggagatgggtttgagtcccatgtgagttatactacggtggtaacccagtctatatgatcggagatcccgtgaattagaacctgggaagaacaaaccattagtaaactagaggagagtaccaatctataccctctctaagtgaagatgcatgtactctcgtgagctgcaaggcaggttggctatgccttaatgagttctgttggttttaattagcaaagatgctgtcctgcagagcattcttgaaagaactcacctttgtaagcttgactgttggtcacaatctatgaagattttgggtgaatcttctaggaagcttactaaagacctaggagtatgacttatacgctccacccgaggggtagtgtacagacggtctagtaccagataagactctgagtgaaacttgttggcacaagacttgcaattcaaggcgtagtccattgttcaagttgtgagtaagtgtagcttggagttctaggtggatgttcaaccttaatcggtctccatcgaaccgctggtatataaacagtacattgaaaaaggcaaatcacagtgggaattttgagatttggtgggggattgttggaattaatagatgggctaaggcccattcgaagattaattctttggaaaatcacaaaagcccaccccataggatggcatgcatgtggagtttagtaccaccttgcttattttaggagagggggacctccttaaaagggagtatgccctcctagctacttgaagcatgtgtggtggagagaagagggggaacactcgctcgcctcgcctggcagggcagggcaggcggcgcgcgtgcacgacatacgcgtcgaatggtccgaaaaattagctcctcacccttgcacagatgcagcctctttttgcagttttgttttgctgcaagaaaattcggatttgttttgttgttggaaacattccaaaaaatccggtgcgtgaaaacggcgtggagtccggataagttacgcgcgacttatccggctcggttacgcagagtggagatcgtgcaggcgccctgatcacggtgtggagtccggataagttacgcgcgacttatctggctcggttacgcagagtggagatcgtgcgggcgccctgatcaagcgacttatctctataaaaaccgtgccgccgccttcacgcaacacacgtgaaatcaatctagggtttgcctcctcctctgtgttgcgccgtcgctcgtggactactccatcccgctcgccagcgtgcaccggcgatcgggagagcaggtctccggaatctctgccttcgacgtcctacagcgggagaaggcggcaataaggtttttgggaagcgcttcgcgcgactgctccctattcgtccgcgacggttcgccttccactccgctcgcatgctgcgcgccttcgtcgacgctcacaaccgcggtagttcctgccgagcaaccagcctttccgccacctcggtacgtgttcgacatgttacgcatatttgatctgttcatgttttactgcttagtttgtgtagatctaatgatgcgttaatactagtatacatctgtaatgtcatgatttatttatggaatatattaaatcattatatgcctatattctcaacagctatgacaacgagccgcgactccgacgatgatagcctcggtgggatccccatccgtactcctccttcgtgatgctgacacccacatcatgtggtcttatgcaccacacacaacgtctgctcctgcatcaccgacgcattccatggacgaatttcgaactcgacgtcaagatgggggaaggattgatttgttttgaagccaaaacttgccataccaaaatattgacattttgagcagtatttttggcaatgtttggtttaataccaatactcgccaaaaccacatgaatattaccaaaatattagcattggcaaaaacttgcccataatttagcatttccaatttttttttggcatggttgcaaaccaaataagccattcttttttttgtgcacgcgggggggggggggggggggggg

SEQ ID NO: 1419 - DNA, 8260 bp, Oryza sativa
  unsure (1)..(8260): unsure at all n locations
tctatccaacaaaatccatcaaccccttctctctcaaaaacgaaaaaaaaaaatcaaattccttccccctttcaaattcgaaatttcgaatcaaacacgcgcacgctcctctctcctctcccctctcgatcgaggcacgcttctccgcggcggcggcgcgcgaccggatcacggcggcgggggaggggaggggaggggaggatgcagcagaagcccgcggcggaggccatggaggaggagttgaagggggaggccgtggggccccgccgccccgggctagggttatggttggcggcgcggcggcggctggcccccgacgaccccttcttcgccgccggggacatggagcgcgagctcctcgccaagcaagtgcgttctcttcccctttcacctcccttccttctgctcgcttaatttgggcgctttagcttcttcgattttacggggattttttttgttagctgtattgagctggaacccgtggaaaagatgaaatagagatagtaaaatcagccatgataacctttgattttgcagaaattcagctgtactgtacataagaggaaaagcttttgcccttctttgaaaaaaaaaagagagaagaaattcagctgcacttagcatcagttaggtgggaattccttaatgctctgcaatacttgtttctttgatttcttgaacggatcatggccgattagctcagataccctgccctgatgtgaaaagtgtagatgaactgtgcttttactcaacaagtcccctatactccactgtttttttaggtgtctgatgttttcttgtttaggttgctctggatctctccgaagatgaacggtaccagcttgagaggatggaagtggcgagtgccaagtaagagattgatctttacttatgcttactctttggattgatgattatttatcctttccgtttcacgccgaattaggggggggggggggttagtccctgtcacatcagatgtttggacactaatttgaagtattaaacgtagactattgacaaaacccactccataaccttggactaattcgcgagacgaatctattgagccaaattaatccatgattagcctatgtgatgctacagtcaacatgtgctaattatggattaattaggcttaaaaaaaatttcacgtgaattagctctcatttatgtaattagttttgtaagtagtctatgtttaatactctaagggcccctttgaatcgtagaaatgaaaaaacggaggaataggaaaaacataggattcgacaggaatataagtgtaaaacagaggattgcaaaacacagggaaaacacatgaatgatcgtttgattggaccagaggaaaaacacaagaatcggatgagagagatagactcaaaggattttttccaagaggttggacctcttgctaagtttcctccaaaacctatatgccataagccattccataggaattttgtaggatttggaaaacttcaatcctttcaatcaaagagctatataggaaaatttcctacaggatttcaattctatgaaattccttcataatttcatttgattcaaaggggcccttaattagtgtctaaacatccgatgtgccagggactacagtttagtccctagatccaaacaccccctaacataccctctctacagatttaaaacagcatgttaatgtactgtttttctgcatccccataacaccataaatttcttcgctgtagctaaggaagtccctgaaccagtggtccacaccccacagtgactaaagtctgagaaaatgacaactggatgtcttgaactaaattattgtacgagttctctagaacctataattcaaaatgattggcgagtattccatcctgacacctgctaaatcatgtcaccttttgcagttgtatgttctctgtgttgtgttagtactgcaagttttggtctcattctgtttatttgatcatatatactactgcaagtttatgtcaccttttgcagttgtatgttctttgtgttgtgttagtactgcaagttttggtctcattctgtttatttgatcatatatactactgcaagttttggtcttatctgttcgatttatttgatcatatgtcttaagctcttgcagtgcccttttatgcccaatttctggctgtggtgctcatctagattgcctggagaactttgaggaccactatcgcacccgtcatactgcttcatgctctgtatgttggagagtgtatccaacttcaaggctgctgagtattcatatttctgaggcacatgattccttttttcaagcaaaagttgcccgtggttttccaatggtaataaattcataatctatccatgcccccagttctttaattggtttaattttgtggcatcatgcacactagccaattttatgcaaacccagaacttccagtggactgtgcctgctggccagtttaaaattactactcaatgtcttagcattagttagcattacatggttttctggtcccgctaatgaagctttccaatttccacatgtcacctttactggcatctgattcttgtataaatttacatagtagtaagtgatacttttatattccctcaactttctatagcaattcacattgtgtatgctatttttgaaacagtatgagtgtttggtggagggttgtggggtgaagttgaagagctacaaaagtcggcagcagcatcttcttgataagcaccagtttcccaagtcatttgaattcttcaaaaaagcacgcccttcgcaacgccagcggaacaagaaccagaagcaacggcaaacagttcacaagggagacgagacaagcgaaacactaatggatgttgatgggaagaagagctcaaggtacatgaattccagatatcggccaaagcaacatgatggaaaagagtcaaaagaaaatgagcatagtagctgtaaggaggccaagaacaacgaaatggaggttgacaagcaggttgatgagcttgcttcggccgtatcaagactgagcacagcggattcaactccttctagcataagctttggtcatcgtcgctctcgcggtcttgcttttgtccctaggtcgattcggcaaaacaagcaggtttctcagacagaaccaaaatgacagcatttgataccatctttctcttcattgctgatctcggatgcatcaacaatcctgaatgtgctgtttcctgtacctggacattcaccgaatccactaatatacattcttgtagttgtatcacgagatatgtcttctagctggttatccttgcttatggatgtactgagcttcctgttactgccatgtagtagaacaatttttctgaagcggcaaatatgaagtgcaaaatacaagacagttcttgtggttgatcgatttaccagcttgttctttctttcctgcaggtgaaagttaatgacactgaatgaaggatcctgttagggttagctacttagcttgctcttctcttcgatggatagaacataccaactccttcgtcaactgcagtgtagttttgctcggtccttttcacacctctggatatctgaagtagatgtaatctgaatttctgattgatacccggcatgtaatcgacatggccagtttgtgagtttagtttgcttcgtaattctgataaaaattaactatctgaagctatgataaaaatcaactgtatacggactagtgtatggaattcaaattcgaaagatatctccatgggtacaaatcatccaggatttccactaacattcctcgtaaagttgtctccatttgggtccaataggaacaatttgggctggctggcctagatattgtacacttgctagcccaacaaatatggataggcatgtacttatacaaagtaggaataagtccactattcatcccatatctttttgccgagtttaatttgcatcactaaactgcaaaccggtgcaaaagagattataagacagtacggagggcgatgctaatgggcgcccccatccccctatacgtcctctcccccttctccccttcttctcttcctactacaccataaattttaaaataataaaaaaacaaagttagaaaattttatgtataaaaatactatatataaaaaatatttgaattcaaatttaaatttgaatcggatatataaactttttacttataaactttgggtctataaactttaggtgtatagaaatactatatataaaaaaaattgaattcaaattcgaattaatatttgaatttaaattcaaatttgaatcgggtatataaacgtttgacttataaactttgggtctataaactttagatgtatagaaatactatatataaaaaatatttgaattcaaatttaaatttgaatcggatatataaacttttgacttataaactttgggtctgtaatctttaagtgtataaactttagaggtgtaaactttaggtgtataaattttaggtgcataaattttctaaaataggaaagtaatgcggtgccaaaaaaggaaagtggagggaggggggattgatcgcccggagcgattgatcgctcgttaggattctcgcaatatggaggctggttttggctgacataaatagtgaattaaacagcgctggtgtctcctgtagcctatgtggctgcatgctgttcctcccaatgctctacttcccgcggcaccttttgacacggcagatggtggaggccacgctggaggagcttgtcatctactatcccttctccgccatgtgcctgccgctctggctggtgttgccaagcgcctcgctgcgggggctcgtgccgagggtggacttcgacatgtcctcggtggcgtctagcgggtggatccgggtacctagactagatcggcgtcgtgccaaaccttgaggatatgaggctgtggggcttcagtactagggctgaatatgggccggtacggttggatcatgacattcccatatcctagacaatattttcctttaaattcggaaccggatataggtagtgccgaataacatatcattcatcctgtatcatttcccatattatttccttatgaatcggattcaggaatggatacctatttgttctctaattcatatctattaaatataagaaggtgattaaaatgctaaaagatatatacgaaggcaaaattatacaatattacatgtgagctcgtaaaatagtgattaaccaatcttttaccatgtttatatatggatctataatagattttcatatatattttataatatgggacatacgggtggatacaagttttcttgtatcctaacccttgccttttttacggatttagattcgaactatccaagtttttcccgcaagcctcaggttggatgagcgagcgattgggaaatatcgccccattttcacccctaggcctcacgatggcacgcgccctagcggggagggggggcagttggctttagcgggctagagttggcacggtgctacgggatgtctggagagaatagagggaagagaggcgggagagaaaagaggggaggagtgaaatgtggggcccactttttttccctcatgaacgtctagtcagtacgagtggatcggatcagcataacacgttagcgaaaccagctatctatgttgctggaggacctaatctaactcagaaaagttagggaatagacagtgaacttatttcatatgaagagtagacgggctttgtgggctcggcccgttggatccaacggcaagcgccgcgtgcaggagggggccgccgcagctgcagccggccacggacgcgacgtgtgcggatctgcacgcgcgcggcggccgacctgacgcgctctctttaacgtggccggccgccccgtttctccgtgctttgtgcctaccaacatcatgctgtgacatgtgagctatacatgtatgatcatgtgacaacgtggccggcaggcatgatgatggattgcagggttgcagcacactcggaggaggtaccatctatatcaaaatgtagcatcgtacaattagattagacacattctaataaaacgaatctgagaatgtggacctgtctaatttaatcttaggttgtatattttaggatagcgaaaatataccattcgctaaaaaatttgatttttctatgacggagaaagcagtagtgtaagcagagcgcccgtaaacatatcctcacttttggttcatctcatatttttgtaagatggaggaaacatgagtgaaattagagcaccctgtaaacatatcctcattttggttcgtctatcagtcacgtaactttgttatttctgtcggttacctagtactaatacctaagatgataatccactgtaatgggaagatgagcacggttttatatctgaaactgaaaatgggtctgttggtcataaaacttactacctccgtttcgaaatatatcaaactagcttgtattagattagacacgatctattattcaatttggacagagtccatatagctatgatatgcttactatttcatattgctttcatgaacttaacttaaagttttggaccacaatgaaagtttcagttcatatcatatggcatactacttctattcttttttttttgttaaaaaaaaactggagctctcaatttttttaaagtttgtcctgttacaattttaatcagttctttattattcctctccacatcaacaatttttcctcgatgatccggttcccttttgacctcactgcactgtcccagatctctcattaatccaacccagaaaaaaaaaacagtacaaaataaaatacacaagattcaacaaagcaacctgacctggtcggtgctgtaccacgtggcatctcccctccatgtcccaatcacttcgagagacaaaagaaacactcctccagtggcatcctgccatgtgtcctccattcttgtacttaatctcttcttatttaaggcctcataatctcttgctttcccttccctagtaaatcaaagaacacaaagcatccaaaacaacaccaggaaacttcttttcaatcgatcactccactggtgagtagtgagtggctagtgactggtcagttcatcacttgtgaaggttttgcaatcaggaaaagttcagaagatcatgggcaagctctggacaatcctcactcacgttcattcccttgcagggtacatatggtttctattcttgtaatgttaatatgcacttagctgcagttaaatttaagcttaaacagttaaaactgattcctgtgaattttctttctgctgccctttgtggttggttggttgcaggcctaccgtcatgctcctgtaccccttgtaagttcagagattttctctctattagcttttcttcttcttctttttataagttcatgtgattgaatgtttaattttgagatgattttggttggtgcaggtatgcgtcggtgcaggccatggagagcccatcgaagcttgacgacgagcagtggctggcctactggatcctctactccttcatcaccctcgtggagatgcttctcgagtccctcatctactggttgaattcgattaacccatctcatcttgatcttgatcgagcagatatggattaatttcagaaagaactcattcataaaagtactatgattttgttcgatcaggataccgatctggtacgagctgaagctgctgttcatcgcgtggctggcgctgcccaacttcaggggagccgcgttcatctacaacaggttcgtcagggagcagctcaggaagcatggcctcgccggcgccggcgccggcgccgccgccagcgtcggcaagaaggacaagtcgtcgccgtcgtcgtcacccaaggacaaggagaagaccaagagcaagttcctctccttcgtcactcccaagaaggtgagttcttaaacctcgagcagcatcagtctcttttttttttcttgattaatcttggctgaaatttgatccatgttctttgtgtgttcgttatgtcaggatcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1420 - DNA, 745 bp, Oryza sativa
tatgggtatatatattgggagaggtcttgagaggttggttgatgtatccgcatatagttaatacaataaagctgtgatgcccctccctatccgtgttcatctactatatgattgtgtgcatgagattgtcgtcttctactccggatcaacgaatagaccactagttatttaacaattatgtcatcttcgcaaacttttggagaagataatttgttttgaaacgagaactacgacgagccgaacatcatcctctgcctccatcaaaccctgcctcacatgagcacccaccagtgcctatagcaggttggcacgaggagctgatctgagctcccatctgaacctgacagcgagacgggcatcgaagctgttgcagaattctgaaggatcaacaacaagcaagcgcatgctgcacgcatgcatgtttcttctcgatgtaaggccgcgccgcctcccttgtccctggcgatggcgattccggcttttctcctgttcaccgctgttggggcgcctgcgctgacggcgaccgcctagcgcgcgcgcagccgcagcctcgatcttcttgtggtctttgatgcagcaacaagaagctacggcactctcctctgcgtgacgccacagtacgtttcgttggaaacgatcggaacggaacggtgccgtgtgcgggagaaacggttaggatgacagcagcaacagccaggcgccagcgagcgagcgagcgagcctactgatgtggacgataaacacc

SEQ ID NO: 1421 - DNA, 22679 bp, Oryza sativa
aaaaagatacaaccaattattatagaggttgtatgatgaacgactgtaaattttacaatcacaatttattagaaaacaagaaatttactaagaataccacctttaaagtatagactatttttatctatggttggcgagaatatgcataaccattttttttctctaacggcttacaagttctatatagttcttgtcttaaaccgaaaacagaatctccaaaatcaacaattaattatagtttcgattgaatttcacacacatcactataggcgggtaacgtcaaaccgaaaagaataacaccatagagcaacagagctgtaaatcaatgattcgctcaaatcttgctaacgttgtagccatcaaaacgacgctaaggacgcccctgaactctggaatctgaactcgagcggttttctcatggctctcagtgccggtgtgggatcgtggttgtgtgtgtgattgcagaaaaaaaaaatcctatccattatccatacgtttttctccacatcactcgccggccggtcagtgttcgcagtttgctttgctcagaactaatcggaggagaataaacatgtacgcaaccgatgcgagcttatgtgcaaccagagctaaccacagctaccttccaaaacgcgcccgatccaactcttgtcctcgcgcgaaaccgatcaaaatcccggacgccaccgccggctctcgcgtacgtacgtggcgaccataactcgccgttgcagccatctcactgcagtgtaccctgcaacatgccaattaacctccaagataagcatccatcgatccaccgctggatcaaccgcagcgcgcgagagatcgatcaacgtacgtaacgccatgcaccgtagccaccaagttccatgcatgcaccgatgcacgagtgatcgagcgagtgatctgatcgagtaataagttgcaggtttctggacgccatcgctcggtataaatacggcgttttctgcaggcgaagcagccaaggcatgcatgcacattcgctctagccttcctcatcgttgacagtgcgtggcagtgtactcttggttatcatgtcgtcgccgttctccgtgccatctctggtacatttcacgaatcgattagcaatttgttacagatgttaagcgtgatcgataatatatcgtgtgattttgatcgtgcagatcatggaggaggaagggcggttcgaggcggaggtggcggaggtggaggcgtggtggggaacggacaggttccggctcaccaagcgcccctacacggcgcgcgacgtcgcgctcctccgcggcacgctccggcagagctacgcctccggcgacatggccaagaagctgtggcgcacgctcagggcgcaccaggccaacggcacggcgtcgcgcaccttcggcgcgctcgaccccgtccaggtcgccatgatggcgaagcacctcgacaccgtctacgtctccggatggcagtgctcgtcgacgcacacctcgacgaacgagccgggccccgacctcgccgactacccctacgacaccgtccccaacaaggtcgagcacctcttcttcgcccagctctaccacgaccgcaagcagcgggaggcgcgcatgtcgatgtccagggcggagcgcgcgcacgagccgtacgtggattatcttaagcccatcatcgccgacggcgacaccgggttcggcggcgccacggccaccgtcaagctgtgcaagctgttcgtcgagcgcggggcggccggggttcacctcgaggaccagtcgtcggtgaccaagaagtgcgggcacatgccggggaaggtgctcgtcgccgtctccgagcatgtcaaccgcctcgtcgccgcgcggctccagttcgacatcatgggcgtcgagaccgtcctcgtcgcgcgcaccgacgccgtcgccgccacgctgatccagaccaacgtcgacgcgcgcgaccaccagttcatcctcggcgcgaccaacccgcgcctcaggaaccggagcctcgccgccgtcctctccgacgccatgtcggcgggcaagaacggcagggagctccaggccatcgaggacgagtggctcgccacggcgcagctcaagaccttctctgactgcgtcagggacgccatcgcgagcctcaacgccaccgacgccgacaagcagcgcaagctccaggagtggagcgccgccaccagccacgacaagtgcgtgcccctcgagcaggcgcgcgacatcgccgcgggcctcggcgtcacatccctgttctgggactgggacctgccgagaacacgggaggggttctaccgcttccgcggctccgtcgcggcggccgtcgtccgcggccgcgcgttcgcgccgcacgccgacgtgctctggatggagacgtcgagccccaacatcgccgagtgcacggcgttcgccgagggcgtgagggcggcgagcccgggcgcgatgctggcgtacaacctctcgccgtccttcaactgggacgcctccggcatgacggacgccgacatgtcggagttcatcccgctcgtggcgaggctggggtacgtgtggcagttcatcacgctcgccgggttccacgccgacgcgctcgtcacggacacgttcgcccgcgacttcgcgcggcgcggcatgctggcgtacgtggagaggatccagagggaggagaggagcaacggcgtggagacgctgcagcaccagaagtggtcgggcgccaacttctacgacagggtgctcaagaccgtgcagggtggcatctcctctaccgccgccatgggcaaaggcaagaaagcttgctgatgatgctagtgttcaatactgatttaattggctatttttttggaaattttttcaagatgatttgctcaaacctgtgtttggtttctgtgcttgcaggagttactgaagagcagttcaagggctcatggacagggcctggaagtgagagcagcagccatgttcttgccaaatccaggatgtgatgaggattattcagaggaaaattttaaacagttgaaatttatgtaataaaagccactctggacttcagccaaggagccttgatactttacagactgaactacagcacgcacggatcaactaattacatatagttacagtatatatgaatgattgagttatgactcaaaatggaacaatcagtttggggtaaaatgtaactgatctgtgagtttatcacagaaagtattttttgcacctagatgcaaaaattgggtacatacagtattgttatgcatttacagagaattctcaagttcataaaagaagtgtttgcaaatgaattatttagtaaaaactttttttctctttcttgataatgtatcttgcccaaatttatctaaatcctgaagcatcagcttcaaaaacagtggtaatttcttgtgcaacgggatggttacaaagcagagcacttgttcaaaggagggtgtctgaaatgttcaaaggaggttgtgcactgtgttcatacgaaaatgctcgtaatatcaattgtttttctagttttctacttagcccagggctttaagattgaaagaacgacaatagctgcaatgaccaggagtatgatgattgcgatgaacatgcacttccttgacttcttctgcagtctcttagctgtgcgcagctctcctgtaccacgttgtatatggtccacagcattttgaacctgagagttttaaactcattatcaagctaacaaggcgaaatatttccagccacattcgttaattgtcttttgagttttcagtaagttcggcaacaaaatggagggagattgcaaacctggttctctatgtcgttcaatgtctctccttgtgcgtcgacgagtgttgccatatccgcaaaaatctgacagcaggtggaagaagtcataataaagagataattagtgatatgggatatagttagtccattgattatatgagctcaattctgaagaacaaacgtgcaatcttgccaaagctacctgttgcaattcaagaagttttttttcaatttccatgactacatcatgcctttcatggatttctttaaccgtggctattatctgtaagtatgtgcaattatgaaacatttgagcactattataagaattgccagccttaatgacatggaaggaacatataatgtactggtgaagctgaacacgatattcaacctgccctctcccaattccctgaatcgctttctcaaatatctgctcactgctgccggtctcaatcaggtggtcaatcacctagtcatgttttttttttttttaaccacaatgagatcagaggagaaagcatctctcaacaccaagcgtagtagcactactgtcctcacctgatcagaaggctgctctccagtgactgttcaagattcaggtttatcaagaagcatgtgatagaatagcttgaagtaaattatactctctccgtttcagaatagaagttgttttggatttgttctaagtcaaactactccaagacaaaccaaaacaccttacattctagaacgaaggaaatatttatcagaaagaacgtaaaacgacttgaaaaaagaactccttacctgtgaaaaccatcctcgcaacgccttgtcggtactcatcttgaataatttgtcttagattctgtatgaaatgtggattactgtactgcaagctcttcaatttgttttctcatagaagatggacaataagctagaaagtttacctggaaatttttcattctttctttgagtttatttttcagcgcactgcaatcaacaagaaccaatcaaaattcacctcttttgttatgttgaacaagcaaaatatggaattgtttcttaaactttacaaatactttgggactacagtgatctgataatagacctaacaaaccaattttactcaaaatatgtcacaattctttttttggtggtgggtcaatgatcaatgtcaatcatgctgaatttaatttatcttgtcttgatatcaaacatatctgattatatcttctaaattattaaatttactgaagaaatgtatgaacaccttacatggtcattgacatccttgatcggtctacgcctgtgcccttttcacacccttgcttttttctgttttcaagattctgcaatcagaaaacaagtgagatcgtgagaactgggctaattcacatagtagtgcagattagtagacatgctaaaatccttacattcctatccatctcctccaacttcacttttatggtgcgtgtaattttcccaacttcattgatatctttctccatgcgcttgttgattgctggaatgtgtttttatttcagatgaatgcattagtatgatcattctactctgaaacttagctatatatgcagatcaatcaacagattaattgacgtttgcaacctttcatttcggaagccttagtgacggattttgattcctcattggcttcctatagttgataagaatgtatcaattctccaactccatagtatggtaatgggggaaacgtaagaaaaatattgtcatggacaattaactcttttgacaaaatgttggaaaggaattaagtatacctgaagtttgtggtttatattggacatcttgtccaacaacgtctcaatctcctgaacctaattcaacagaacacaaaatcagaagatttcatcatcattttgtgaaattagcactcatggctacaaaatcatagacaatagtgcatcaaaatcttggtgtggataaaattgttatgatacctcctggaagaaatcctcaagcccataatccgatttattctttgaattttgataccccatctcgatgtccctctccgattcaaaagaattctacaatcaagttgaaaggtcaatagtgatgtaagcaaggaaatattatggaattagcatatgtatcaaccctaacataattataagtttgaatcgtttacaacttctatgacagaaggacaatcatcagccatcaaagccctataatttgatcagtttatcctaaacttcgaaaagaaggttcaggattttgcatccagccaaattactggcccagggtgaaactggcagagaagggatcataattcataaagcagattggcacgacctatgaaaatttgttctctaatcaactgtttctccatcaagagaacatcaaaatcacaagaaagaaggaagcataatgatagcatcttttcgcagaaaaataatcgtaataatcctatgaagtaagaacattaccgtcagaagattgttcatctcgtccttgtggccgcagagagggagagagacgaagagttgaagaagagtagatacgaagaactcgtctgctgtgaggagactttggagagatcgttcaggcgaggaacgccggccgccaatgctagaaacaaataactagcagacagacgagtttagtaaccaacttaaacgcgaagtaaactatttcctctctcgcctccgtgaaacattgcggcaaaaaaattccaaatttatgattacccgatgttaaacatatgcaatatataccgcgattatatttccttagtacgatttatgaattgttttcctattaggactcctaggtttttatcccctatatatctatggtaataagcaatagttctgagccggaatccgaaatttcggtcatttcggtcccctacggtacgatattacttcggccgaaatttttcaattttttcatgaattttggtaatatttgttcaaatttaactaaattttgttcaaaattttagaaatttcggaccgaaatttcgagatttcgatgacctccgatcgaatgtcctaaaccgataaagtgaaccctagcttgaattcatcaaagtaagcaaatcaagagatgaaatcggcccataaagatcgcgtgttcactttgactcccttaattagttgtcgaatcagatctgtatccctgaaccataatatctaattaatatttcaacccatccattgttaaaaccggtgcaatttgactccctcggtggttttggagagcggtttcgctgacgtggcatctacgtggcgatgttgacgtagtctttatttcacgtggcattgacatagcgtttgtgtggtattagaatttaaaaaatatgtgtgggatctgtttatccttcaaaaataaaaattaatgggggacacctcgatgtgaggtaagcacatctcatccaaatcgatgagcagaaatctcttactagagaaaccaagccaacggtgagtatttcaacaggccttgctccggcaagaacttgtccacgtcctcggcagctgccagccacttgccgctgtctctgcagggccagcagtggcaccgccgctcctcggcgtcggcggcggcagcctggatacttgttcgcctcgtacgatctagagcagcctcgcgcgacgaacagcatccgcccacccagcgacgaacaactcctttcaagcgtatggtgcccgtggttgtcgttgggagtctccggcgactgagacgccggtgctccctcctcttcagcggcggccgcccctccccggggtgcccccacaggcgcgccttctcgacggcgggctacggcaaggatgtcgacgaggtaaacctcaagttcgcggaggcgcgagaggagatcgaggccgcctgcgtgcacgccgccgccggcgagactctcgcgaccttcgagtgatcgagtcccttctcgcccacctcctcgatctgcggcaggttgtgagcactctccactcaagatcacaagaacaagatatcttcgatggatcaacgagatcgcatcgccttcgctgccagtatatttgatctttttcgagatgagttctgttacagaaagtgtttgtcttataactctgtctctcgctctctcgcttggatagaggaatcaactactcagtgacagctaattgacaactgttacatagcccactctggcccagttacacgaatgtttggtttacgcactcgtgcggcccgttggacttgtggtttctgtagctcttcaggcacgacagtagttgggctgctggcagtagctgggctgttgacaagcccctccccttggaatttgacttgtccccaagtcagagcatttggagatctttgcttgagtgcagcttcacgttcccatgttgcatcagctgcagcaggatcagaccaacgaacaagcaattgagaaacaatacgattaccttttcgggtaactctggtatccaggacttcagctgggaactggatatttgcagttggggaaggcagttgttgctgaactgactgcttgaaccctttagaactcttcagttgggacacatgaaaaacacggtgtatggcactgccagatggaagctgtaacttgtaagccacctgacccactcgagaaatgatcttgtaaggaccaaaatacttgaaggagagtttatggtttgctcttttggcaacaaaagactgtatatagggctgtagcttgagaaaaacccattcaccttcttggaattgcctgaaactcctctttttatctgcttggtgtttcataacctgctgggctcggttcaactgttgcttgagaagttgggtcatcagtttcctttcagataaccacatatccaaatctggaatattgcaagcatcctctctaatgccaaaatgtgcagggggtaacgatagagaacctcaaaaggtgacttatcaatggaagagtgataggaacaattgtaccagaattcagccaaatggagccattcagaccatttagaaggagtagcacggacaaagcaccttaaaaaaatttctaaacattgattcactctctcagtttgcccatcagtttgagggtggtaagcagaactgaggtgtagtttagtgcctaacctgataaagagttgttcccataatgtaccggtgaaaattctatctctatcagaaacaatggcctttggaagtccatgcaatttgtaaacattcagcataaaaaccttagcaacatcaagggcagaaaatggatgggaaagggtcataaaatgagcatattttgagaaacgatcaaccaccactagtatgcaatcttgctgatgagatctgggcaaaccttcaatgaagtccatagatatgatttgccaagctccttctggtactggtaacggttgcaaaaggccaggatacttagccctgtctggcttggatagcagacaaacagagcaagaagagagctgatgctgaatggcagctttcatgtgtcgccaagagaacagagccttgattcttttgtaagttacagggaatcctgaatgaccacccattgggctatcatgtaaagcagagataatttggtattgaagagatggattatcgcccacccaaactcttcctttgtgtttcaaaagtccttgagacagcttataatgagtatgagcatcaggattaatagccaattctatcaaaagtttagttgagacagggtcctgttcatatcccttcaccacctcctgcagccaactaggagaacatacagaaatggctagaaattcagacaattctgttggcacattcctggatagagcatcagcagcaacattatacttccccttcctatacacaatcttgaattgcaatcccatgagcttagtaaaagccttgtgctgccatggagtattaagcctctgttcagtaagatgcatcaagctatggtggtctgtcaaggtctgaaattcctgaaagtgtaaataagggcgccagtggtctactgccatcataattgctagacactctttttcataagtggaaagtccctgagttcttggctccaatgccttactaataaaagcaactggatgctgattctgagaaagtacagccccaataccaaagtcactagcatcggtttctactgtggaagtttggttaaaatcaggaagtgccaacactggagcagaaactaaggcttgtttgagagccacaaaagcctcatctacctcagcagtccactgaaagggaacatccttctttaagagttgggtaagtggcttgctaatggtaccaaaatttttaacaaatttccgatagtatcctgccagacccaaaaatcctcttagtttcttgatggtagttggtcttgcccaatcaacaatgctctggatctttgatggatctgttgctactccggagccactgattatatgacccaagtaagaaatttgttcctgagcaaatgcacatttactaagtttgactttccattggtggtcaacaagtagctgcaacacttgtttgagatggcaaagatgtgatggcatgtcagggctgtaaataaggatatcatcaaagaataccaaagcacattttcttaagactgaccaaagggtatcattcattgcactttgaaaggttgcaggagctcctgtaagtccaaaggacatcaccttatactcataatgcccactatgagtttggaaggctgttttatgttcatctcctgcagccattctaatctgatgataaccagctctaagatccagtttagaaaagaatttagcaccagctgattcatccaagagctcatctatgactggcataggataagtgcccttttgagtaatagagttcaactgcctataatcaatgtaaaccctccaagatccatccttctttttcaccaacaatgcaggagaagaaaatgcactggtactatgttggatcaccccgttgtgtaacatttcttgaacttgcctttcaatttcatccttctgcctaggagtatgtctgtagggtctaacaaacactggtccagaatttggaagcaagggaatgtgatgatcacagtaacgttttggtggtaacccttttggttcctagaagacttccctaaattcctccaatagagactgtaccgcagcaggaatttcttgaaaagattgctcagtgttcttatccagttgaactagatacatgattccaccagatttagccaatccattcaattgatcaggagcaataggaaaacaactctctgtgttagaatgaatgccttgtaatctgattacagaatttcccaacttaaattccagccacttttgcaaccaatccactttcattgggctgaactgctctagccagtccattcccaatattacatcataggctcccaatgctaacagtctgaaatcacttttgaaattgatgccttgggtcaaccaatcacagccaagtatatgcaatgaacaagagagatgccccccatatgcaatcttaactctgactggttctgtcattgctttaactccagacaaccttaatccaagctgatgatcaacaaatgaatgagtgcttccagagtcgatcagcatcaacacttcaataccctgaacccaccctctcaatctgatagagtgacttgattcagtgccattaacagcctgaggtgaaatagccataagtgtatcgttttcctggaattcatatgcttcatgatcagacaacaaagtgacatgcaagacatccatcaattcctgtacaacatgcagctgaattgaagatgcacatttatgatccttgctccatttttctccgcagacaaaacaaagtaccttcgatcttctataagacttgagagctgccagcctttcagcttcctttgactgagcgacttgatcagcgcttctcctgtcttgtgataaaaatggaggtccaccccttgtagttggaggtaaaggaagtggcatagcccctttatgagagcccttctgatagctagtggtatcaaccctcttggattcttttggtttatcaccttccaaagcttcttcctgtaaaaaggcaagagtacaagcagcatccaagtcgccaggcctttggagtaacatagctgatttaatttcatgtttcaatccttctacgaacttagtgacaaagtaaactggtttaagagaagggtcataggccatcatttgatgcataatgcaatcaaactgctctacataatctgctactaatcctgattgactgattttaatccattgcctaataagagcttgttgcctatctctgttaaacctactgcaaaccttatcacaaagttcaccccaagttatcccttccaactgagacctaacagcttgcagtcagaaagcagcatttcccgtgaaatttaaggttgctaccttaacccaattacaaggatgtgtgccatatagatcaaaataagcctcacagttagccttccacataatggggttatctccatcaaacttagggcatgtcatgggcactactccaccactcagaccaacagacaccgcagtttggaaagaattcatggcagaggcatcaaaattgaaaggaatcagggagacattgtgggacacgtacgtaccattgactggggttggccttggggtaaaccccgtaacctcctcccgtgtaagattttgaatgcggtggccatttggaccggttgagccatttggtcgaacacctggtgagtccaggtactcgactggaatggatggctccagatttgccggagcgctcgccagcttctccacttgcgtttgcagcagatccatggcggactggagtacgtccatcttcttctccactaccggtatccaggattctaccgcctccttaaacgagcgcatctccagggactgcctcttctccccctcctctctcttccgctctgtttcctccatcttcttcaggagcaagtcaagtttcgccttgttctccatgatcttcgcggtctgtttcgtcacgaatcatggtttctccagggttacagatcctgtctcacctcatcccgaattcaaccaactcaagcaaggcaagttgccttttcgcggatcaacccgaaggtaatccaatccttgctcgagaatttcacggtcgaatcaagggaatccgaggatcaacgaagctctgataccaagttgtgagcactctccactcaagatcacaagaacaagatatcttcgatggatcaatgagatcgcatcgcctccgccgccttcgccgccagtatatttgatctttttcgagatgagttctattatagaaagtgtttgtcttataactctctctctcgcttggacagaggaatcaactactcagtgacagctaattgacaactgttacatggcccactctggcccagttacacgaatgtttggtttacgcactcgtgcggcccgttggacttgtgggttctgtagctcttcaggcacgacagtagttgggctgctggcagtagctgggctgctgacacaggtacgaacgagcagacccacccggtgcccgagaagtcactgaggtcgagcctgtaggtgagcgtgcccaccatggtggtctgcatcaccttctgcggcggtgtgggagcgggagcagctactcctccagctgctcctcctggagttcacgtgggcgcgtcgtggtggtgcagcatcatcatctacaacgtaagagtacaaggtggtgacgcgggaaatggtggcgctgggtcaatcacgggcgtccctctccagcagtctgggtgcctcacaaacgggcgccaccaccggccaccctttcatctggactctcgatccccgccctctcaacgcctccctctgaccctttacacaccatgttcgagggcaacttcttcctctccctcgccatccacatcaacttcggcaaccctgccaccgagcccatccgctaccccgacgaccgcatctgggagtttgacatggcacacaggtccaacttcctcgttgacgtcgtgcccgacaccgtctttgtggcctccggcgagctcccgccgcagaaggtgatgcagatcgccgtggtgggcacgctaggcgcggggggagagaaagagagagagagagagtcagataggtggcgggatgcatgtaattcagttgggttgtcaccggctgagatccgttggaggcgttcgtgacgggcgcagtgttgtggatgacggaatacggatgtcggacggggagggtaccgctaaacgattaatcggagtatggacgaataatcggaatttgacggaaatttaacgttttggacaaatatatgtacataactcataatagcttattatttttgacatataaatgcatataactacatatatatatacctattattcttaaataaaaataaggataacatgacattaactcgacatatagtaaaatataggtctgaacactcatagttgtgcatcaaatagtgataggtttggttcgtaatgcataaagaaataccaaaagcaggtaacactatataagtgacactaaaacaaggtcccaaataagatatgagttactccgaagaatcatcatcaagtgtaacatcatgagctgcgagtattttgggattgcaaatgacgttctgttagctatatagtgctaggttacacaattaatgggccagtatatatagtgctaggttacacaattaatgggccagtatagttatcgtgggctggctgggctaggtcttgtcacgtgattaggcccgtttattcggtcgattagtcagatacagctgattagtcgctaacgacggtgattatacgtcctgaaacgactaatgtgcaccgttttgctaaaacgtgacggagaggtaagcgccacagttttaacgtccgaatatacggccgtaccaaccgttatccacaacactggacgggcgaatgcctgcgaactagactcgtcggtccataagggacatactccctccatctaaaaataaatccaattctaaatataaatctagacacgcatatatatagaattagattttgcgtgtccatattcatatggagattagatttttttttttttacggaaagagcaggccgaatcgatgtagtcacgcaggacggaacagcggagtactaatcgcagcaagccgtgccacgacagattcatcggccaaatcgcctcatcaaagtgacatgatcttgctgctctgaaaatgattagctattgactccaaaagaaaaaaaatacaaaagactgattagctgttaactaaagaaggagatttccatcatatatccttaatctttacccgtgttcatccttcccaacgacatttcgtaatttcagtggtcaccaaaattttaaaatttcggaacatttttctcacgaaataatttaaaattttaactaattttaactgaattttaatatatttttttaaattacacagtgcaacgcagtcactcacaacgcacgcactcacccctatgaacgcactcactcaaaccttatccctatgagcatcttcgtagactaggtttggtcaaatccaacaaatagaaaactcaaaaagttcaggtgagatatttgcttagtggaggggacgaaatttcgaactggaattgtaagccttgaaaaatcttgattacaactgcaaacaagacaattttcactccttttgagcaagagaaaatcccttatatacccctgaaatttttcctaatcccttctatacccctgaattttgcttacttccttatatacccccaaaatttgattttgatcccttgcatacccctcccgtcagttgactgttagttgaccgtgtattttctataaaaatgaccattttacccttggatgaacaaagaaaatcatgaattacgttattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacagtaggggcatggaagggatcaaattgaaatttcaggggtacagaagggatcgggtaaattttaggggtatgaaagggattgagtgagttttcaggggtacacagggaatttactctttgagcaattcagggatttctcccccttgtggtaggcttccccttcgggactaggatcccagccttttcgctgtcagccgaacgaagcctcaggggttatgcctcctggtagtccctagatgcttccctagagagtaatcgagccgccgtgcgaggtccttttttgccgctgtcctaaacccattgtcgccgtcaaccatggtgcatgccgcctccagccaccctcggctgtgccgccaccactagaaggtccgtgaggaccccctccccctctagccgccccggccgagccctgccggtgagcctgtcccgtgccgccgcacgctctccttctttctgccgttgatgggaggaggaagatgaggactctgacgtaaatatgaaaactctagggttcatactataaaatactgagacacggacttgtgaaccccactgtttaaattaggtgcgcaatataggaatacaccttcacagtaggaaaacattctctggacagtacgctttagttcttttgtaaataaattaataaatccaagaaaaggttttctgttaattatttttgtatgctttagttccatccctggtgccgacaaggtgggtcccacatgagctagctcgttttatctttgcctcactagaacggataccctcatctcaatcgggcggtaagccccatctcaatcgagcacagcgtccgtcacaggctagaagtcactgatgtgaagagttatctcaatcgggcaaacggccgtcacgaatgaatatatctcaatcgggtcctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcaactcaatcgggcctaaactatagcctgtcatagatgactgatgacctcaatcgggcctaaactagaacccgtcacagatgactgctgacctcaatcgggcctaaactagagcccgtcacagatgactagtgacttcaatcgggcctaagctagagcccgtcacagatgatctcatctcaatcgggcatttagttatggcccgtcacaaatgactataatccacaaaaaaaataaattttgttttttggctagcctcaggcctttgctagccatgcccactgcaaaaatgacagaaacaaacacagatatccaatatccccagctccccagcatcacccattcatacatatgcattcacatacacagacatcaacatattttacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcccagttacatcaccacagttgcataataagtgttcatcattgcctaaacatagaagttcaacattgttcatcattttagtttaagcctaaacattcctttggggttaattatttcgcggaggatgaagctggctatctcctcgcgaacctcctcaaagctggtagtcagagacttggttattgtgccctacattgtcataattctagattagttgatcgatcatatataagtactaaaatgtagttagtctatcacaattgagaccaccgacctcaaactcagccaaagtcttcaccttttctctatacagaagtcgcatgttgtggcacacatgtaatctgcactggtcacctatttgttgcttcaccgggaagtcttttttgtggatgagggtgtcatgtcctgtcttcctgaggcctcctctttgcacgtattgggcccacgcttcatctatcgctagttgaattgggatccaattatatgcgttcttatcaattctggagttcaggtaatgacatgtactccatttaggtgttacgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcatagatgtagttgaccattccttgacggtcattctggagatttgtgacagtgaccacttatggatcaaggaaggcaacttccggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccgctcggagcctatagaggtcgaaaagatccttgaagtcgaccacgatataatttgttggaccaaggaatggctttccatcgtgctgtccaaggatatcggtagctttacttagcttcctggcgttagatttctccatgtagtataagtgaaggtccttacaagtggtgcccattgcggcaagcatgtcatctccaaccaatggcatgcctagttggaactcctgtggagcgacgtatttcttcttgacctctttgcccttagtctcttcctggcccttgcctagatctagctttcttggagctagaagcgaggcctgcacctttcctccccttcctctcccctttgcttcgggtttatcgagagtaattctctgaggggaagagtgtgccttcctgctcttcttcatcggtgggggttcatgaatcgccttgctgtcggcctctgttcggtcctccccaaaatccgtgtcgtactgcaactgcacatcgtaagattgtgcatgacgattttgagcaggaggggctgaaggagcagaggcaggtctctttggtggacgaccgcctggtgcagtggttggcctcgctgtaaccctgatctcaatgaggtccttgggccattggatgaaggtatcacgggcatttcctagtgagaggacctcgtcgttcggtggatacttcagagggaacaactcgtattcgggcttcaccgagtcgacttgaacttttgcacagtcggccctgagttgagctccatgcactcttgtctctgggatcggcttgtacgcaagtccctcggctgctggaacagtgaaggtcggcatcaccctaactgtgagggtgcagctcgttggttcctgcgatagattaatcaattttttttagaatattatatatcatatggattcgttacgtctttcatgtattgagtaagttcacggttaccgttatgtggtcgacggcgctgtcgaccgatgttggattttccgccaactcagttgatgcgcaactgctgcgtttttcggtgggacttcctaactctttgtgcgcagcagcagcggcggcctgggggatctgttgctcttctcggatctcttgcctaatcttggccctcatcgactcgagcttttcgtcgaattcagatgtcagctcagctcgtatcgactcccggatcttggcttcaaggcgtgcatctttctccgccttgttcgaagtccgcttcttgtactgccacgcgtagtctggaaatccatacttccagggaacagaagacccatcgccccgtgtccgtccacggtgttccttgttacccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgagaacatctagtttgattagacacttactatagcttcgtatactcgttgatcttctgcatttggcatgaagattgtgccatcatcatgtttctagtacctagccctagcccagttcctagcccgagggtgtgggatatcgccaaacacgagcggtgtgcacgattcctccgcttcttcatcctcacgctgccattcctcttccttaccggcatatccagcggtaccaagccggtgcggatgttggttcctggtctggagcaagcgatatgcctcgcttctagctctggactcgggggtcgacttcttcgcatggaattccgaccagacctgttccgtgatccaaggaaatttgtctcttggatctggatttgccgggttgtagacgaactcgccgactagcttagtcttaaagttcttccaagcagtgcccataaccttgaaagcagcccgcctgagacggtcctcatgctccgcaggataatcaaagctctccttgaacgttagccaagcaatgtccttctctgcggccggcacgagcttgaagtcgtcttgcagaatactgaatttctgcctccctatgaccccgcagatagacctaaatcggctcaatattttccttggagctgtcagaaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaacacaattgagtgctacaatctattacaatgaattgaatgtcacttataaaaataaatgaaacatataaataaattaaattgcgcatatcacaatgatagaatgaattgaatggcacatataaataaattaaacatatcaccaaatcctaaaatcataaattcacctcataccatctattcatccacatatcatgcatctatcactaaattgattaatgcaccacattccatctattcatcatcatgtcatcaataaaaaaaatcattcgtttaccatatatcatcaatccctaaaatcatctatcactaaaatcatctatcactaaattcattaatgaaccacattccatctattcatcatcaagtcatcaatcactaaaatcatctatcactaaattcatcccaacatccacatttcatcccaacatccacattttcattatcaaccacatgcaggtagcagagggaggcgcgatggaggactcacatgaggtcggccgggtgggctcggtggtggcggcggcgggctcggtggagggcgtcgccggtcggtggaggcggcggcgggctcggtgcaggcggcgggctcggcgaaggaggagttcacggcggcggcgccggtcggtgtagacgccggtcggggaggtcggcgtcgggcgggcggcgtcgggcgtcggtgaggagtaggcgacgacgatgaggaagaacgtcgccggcctcggtaggggctgttgttcgtgtcggtgaagaggcaagcggcgacgatgaggaaggccgaccccggtcggtgtaaaggctcggtggcggcggcggcgggctcggtggaggcggcgggctcggcggcggtggcggcgggcttggtgacggtggtggcggtctcggtggcggtggcggcgagggaggacgacggcggcgaaggaggagttggcggtggcgctagggttctaaggaggcgggaaactgtagcgggacttagaaaaatttttgatccgatctgagaaaccctagttatattagagtgatgagtcatctcaatcgggctttgccgtagagcccgtcacagatgactcatcggtgacgggctccatactaatgcccgattgagatgacattcaggcccgtcacggaagactcatctgtgacgggccctaagataatgcccgatagagatagattaatctctatcgggcttgaactaaggcccgtcaccgatgactatttttccatttcccagataagtctttatatttgtgagtacaaaatatatagctgctgtataataattcattttattagtcataacacattttctgatagtaaatgatttcaaatcgaaatatggtcaacaacaaaattgatcctctcatcaagatctacaacttttattttggtcatttatctatataattttgtttctaacagcttgaaattgattttaacaatatgacaaatgtaaacagcatttgtaaatattacatgactttaaatgggaaagccataaacagctaacttgtacagctaatcaagatctgtaacttttattttggtcacttcttcatccgacaaagtgatagtaccaatgtttataaaattgacatatctgtgttgatatttataaaccagatgagagaaatgtgatttttgtgaataatataactatcactttatcggatgaagaagtaaccaaataaaagttgtagatcttgatgagaggatcaactttgttgttgaccatatttccatttgaaatcattaagtatttacaaatgatgcttatatttgtcatattgtcaaaatcaatttcaagctgttagaaacaaagtt

SEQ ID NO: 1422 - DNA, 8008 bp, Oryza sativa
tacgacaaagcccgattgagatagattaatctctatcggccgtaaactaaggcccgtcaccgattactcattttccatctttcatttgttgtgagtgcaaaatatatagcagctgtgtaataattcattttattagtcataatacattttcggatagtaaaagatttcaaatggaaatattgtcaacaacaaagttgtagagcctttcaagatctaatatttttattttggtcattattatatataatttttttcccaacagcttgaaattgatttcgacaatgtgacaaatctaattaacagcatttgtaaatactaaatgatttcaaattgaaatatggtcaacaacaaagttgatcctctcatcacgatctacaacttttattttggtcatttgtaataaaacaaaattagccatattaatgactacatatatcaagtctttgcaataaaacaaaatacttcattcattacaatagataagtacaaatgcatcagtcacaaggttatgccttcggtataatctgaacgagcatatgccacaggctcttggggatcatcgtcaaggtcaatgtgaggtcttacatgaagattatggttgtattcttcttcatcgacgacgttgtcaactcatacaattcggcgctttccatccctcacaatgtgcatcttcttgtttgaagggtcttttatgtagaatatctgctcgacctgtttcgcaagtacaaatggttcatcggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgcggccgtagtatgtgtttgacccaacttgatcctagaatgcatctatacggacgccgctgttttgcactgtgcttttgtcatcttgtttgacagtgtaaaatgtgtatccatttatatcgtatccttgccatgtgtctatggtccaagacggtcccatccccaacaactgtactgtctcatttgggacatccgtggacattgtcacacgattcttgaaccattcgttgaaccgagaattatgttctctgttaatccatgcatcagatcgccccaagttctcatctcggattttcgctaagtgctcctcaaagtatgggccaacttctaccatatgttggagcacagcgtaatgagcctgcgcgtacgacgcttgatcgggcctaattcttttccttccgattgtgccaacacctgacaaccttccctcatgacgagacgctggaactccgataggatcggcatcggacatgtaattgacatagaactcaatagcctcctcggtcgtgtaaccttcaatgatgctcccctcgggtttagctctgttacgaacgtacgacttcagaactcccatgtacctttcaaacggccacatttcccttagaaaagccgggccacatagttttgtttgcttcaccagatgaacagggagatgaactattatatcaaagaaagacagtgggaaaaacatctccaggtgacagagggtattcacaatatcggtctgcagcctatctagatcttctggatctataaccttctgtccaattgcattgaagaaggcgcacagacgttggattgtgtgacgcactttcggtggtagaatgcttctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggagttacactttacctgtctctgcatctcgtatgggctggagttcgctgcgaatattcatgtcctgtagatcaaggcgtgcgttcaacccgtcctttgtcttcccgggaatattcaacatcaggccaaccaaactctcacacacattcttttctatatgcatgagatcaatgcaatgacggacatcaagatctttccagtaaggtagccgccaaaatatggatttttttcttccacatacccttctcctttgtcttgttacgttttcttttcttcccaaactcattgcttatgtccttgaccatattgtggacctcatctccggacaaatctttgggagtaggctgaagttctctcttaccattaaaaattttcttctttcttctaaatgtgtgacgtagcgggagccacctccggtgacccatgtataccatctttcgtgatttcttcagccaccggcttcgtgtatgttccttgcaatcggagcatgtcttctttccttttatagtttgtccggaaaaattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatggtgggaggttatagttcgcaataagaactggctaagtgctgtgagtactactcatgtcaccgaaaggattcatgccatccgtacaaagacatatcctcatgtttctagggtcggcagcaaagtctttgtgttttcgatctatattcctccattcaatcgaatccgctaggtgtctaagcataccatcattccttctttccgtggcatgccaacgtactaacttcgcttcgttcaggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacggacctctaaccccagtggacacagaacctgctttgcttcgtatgtcatctcgggcaatgtgttctcaacaggaagcatagccttcaaaattcctaaaagatctgtgaaattcttgtctgtccatccactacttgccttcagcttcattaggtccaaggtaactgacaacttagtgtgttttgctttgcatccagcatacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatgtcatgctcattttcatcttcctgattatgcgcatcacttctgtctgctgctgctccacttcctgattcttgctctccatgcttcacccaacatgtatagtcctccatgaatccttgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaatttctacaaaaaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtgggggtatttatactgtgcaacaaatatctgtaacggccctaaaacaatcaaccgtgacaggcatacaagtaatctctatcgggccttaataaaaggccgtcaaaaaagagtgtcatctatgacgggcaataaacttatctcaatcaggcctctagttggagcccgtcacagatgaccctcatctgtgacgggcttcttttagggcccgattgagatatggaacccttatctcaatcgggcctcaactatagcccgtaacagataagtgtcatccatgacgggctttagttttatgccgatataccatggctgtgcgaccatatctcaatcgggcgaaacttcggcccgattgagattacttccttgtgacggcccgcaaattctagtcttgttatgggccgtcacagatggaaggatctgtactagtgcctgttgcaacacacgggtattttgcattggattggatcatattaaaagaaagtgctcatataagttaacatacttttgcaaccaatagtgttaaaatattcctatacgtgcaaaagttatattcgacaagcgagttttaaccgctttcttgtgtgtactacaacccatgtaaaatataagttcgcaaccaatggtgtcagaactatcaagcacatatgcacaagagtggtattagaggggtttcaaaagattttgtacatacaatatgattttttggaaaaagtacaattaccttcgaaccataaaactggatattttggaacctatactatttataccggacgaataacttgtgacacccagagcccaaaaatgaccctatactatttaaaccggacattttgcactctaacctatgacaccccggcccgaaaacggtattgggtccatcttattagttggaccacaccttttataacatgtgacacccagggcctaaaaatgatattggatatttagcgcgctatagtgttcacggctgctagcgctgcttctagctagcttgctgagctgcacgcatgggccaagggccaaggcctgctgctgcttttgccctttttttccctccttttcttttctcaattatttgctgggatgttacataactcccccccaccccccatcattgctttgagcagttttgataaaaaaacttacatatgtgacgtcaacttggcaatccagttaggaaaaacaacaataatgaatttgtagggtccacttgtcatctcttttctcctctctccctctttcctctcccctctctctccctccctctccagcggtttgttgggagcaacggcggcgatgatcggctggaggaggcagggttccagatgagggcagcggccagccagggacaaggctaggaatggggaagttggctggtggcggaggcgttctgggcagtggcggaggatttccggggtggcagctagtgcgacggtcgacggcaggaccacgggcgacgatgcaggtgcctggtggaggacgggctcttgatagaggatgaggcagggcggaagtggatgggctctgtgatgtccatcttctcctgctgacgttctctagctacgcttatgccaccgtcgctatggacgccaagcttgccgcgctcttcccaacaaatcggccacatcacagtggaaagaggcggcggcggcagtgaaagagggatggatccagcttgctcggcgataaggagggggaggggaggaagggagcggtcgagcgcccttcgacgatggtgttgttgtgccggtggctggtggcgaaggcgttttgggcaacggctgaggatttctagggcagcagctaatacggtggccagcggcaggaccacgggagaagcaacaggtgcctggtggcggtgcaagtatatctagctgtagcttgtagacaaaggatgaggagagagcagcttacatgtggggcccactagcttcatataggagggatgatgaggtggaggctgacatgtggggccggtgccacgtgtgcggccacatggactaaatccgctccggattgtgctaggggggttatccatcagatctaaatagttcagggtttaaactaaatgtccggttttgtgctttaaggggtaattcggtcggccgcgatagttcaggaggtaattcaaactttttcctaaatttttcttgtatgcggaaaaaatgacattagaggagtttcaaccatttccttaatgtacgtaactcactaattattaatttcaaatttcaaagtcagattaacagaatgttaaattgagtatgatatgatacaactccatatttataaatttaaaaatttaaattattatatctctgaaaaaaattataaataagtcaatgatgcctcccttagtatgttttatttcgctaaattttacgcataatacctaatttcacaaaggatagctataccgcctaacactcagactctgctcacccatcggcttccaccattgctgcagagtgtgtgcgtcctcgtccttgctagtgctcttccacagcctcgccgatggtagaaggtgcggttgctccttctccattccgaacatggaaaagaacatgtcgcggtacgacaacgtcattgctgacgtagcgactgcacggaagcgctcctgcacctgctgccgttgctcgaagtagtcgatgtaacccttgcaaatgacatccctctcgtgcacgtatagttccggtgcccatggtgatagccgcttgaagaggttctccatgcgctccttgtggggattcaagaccttgcccaaccctgccttcacgaaatagctcacggcatatatgtccctctttgccttttgtgccttctctatcggtagcagcacatcgatcgctggagtcggtgacacttgtggcggattgaaaaggaaggtcgggaggttgtagccttgctccaccatcatggcacgccccacattcagcgcaagggaagcaccaagcgagtgtcccgcgagccaaacaatgcagctacctgcagtgccatgggcacaggcgcctcccatgcccttgtctatggtagcaacaagctttttaaccgcggtgtttgctaggcgggatcgcttggactctttgagggtgttcaccatgatcttggcgtcgaggtacagatcaatgagcgccttggggtgtgacatcatggtgccacgaaaggcgaccacatagtgagcagacagaggatgagcgggctcgccaagaggtggcacatgctcgtatattgcgccaataatggtcatcatgatcggagtcatctcgaataacatcgaggaggttaaacccgagagttctcccaccacgggtggcgcaagcgcattggtgtgcaccctgcgcctagtactgtcattctctatgatgtagacacctttgacaaggcaggcagcgacgcaacggcggtgctcctccttgcccctgcgagtacatatgcatggtcgatatacacatcaatttatatagaatcaattgtactttgcaccggataaaatgtatcttgtttcacttttgacgggtttagtgcatacttttactttgcatcagagagtatagtaaaataaattttagttttactagtttgtgttatataactggaaaatcttgtaaaatcacgagtgaaacttacaatattttttttgaatttataccacttttcacaaagtttcatcgtatttgatgatttatatcctggtgcaaagtaaaacttatttgaaggtaatctggtgtaaactgaaagtatatgctaaatttgatgtaaagtgaaactaggtgcgctttatctggtgcatgcaaagtaaaatttacacacctatatatgttttatgtttcacgatgatatccactattattgttttgctatcagcatttttacaaataaaagtgatctatgtggtagtcccttggtttaatattatatatgtagttttgactttttcctaagtcaactttttataggtttaactttaacagaaaaaaatcaaaacatctatgtaatataaatagttcatcagataagaaaagctaagaagtctaggttgct

SEQ ID NO: 1423 - DNA, 13949 bp, Oryza sativa
tttggagactggcttccgaaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgacccccttaagagagatcgacgcccccgtcgatcaaccctaggccaagaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgatcactcgtgtgcacccgggaagaatttcccggtcggtcacccatcccaaattgctccaggccagactggcttccggaaaagaagttgcaacttgttgatatgagtattctattaatcctattaagccctaggccgggatgttacaacatcctataacagaaatagtaacatgcacatgcataataacaatgcaaaaactatacagtgttggaccttctttagcaagaagccaacaaaaacatttcaaagcaatttggcttcatagcatttgatggttatcttctctgatccccgtacgggattcggtccatatattcggggatttctagctgtgaacaaacaaccaaataccgcattatatcaattagttagacttttatatgcaaaatagaattattagtcgatcatgaagacaaaatcaaataattttaagaattaaccctacaccttaattagtgatgctacttaaaaagtcttttttcggacattaggcttttatcttcacatagacgatccaaaagaaaaaatacttgtggaaatggttgaggttgtcttagggtcataaccgcctgttaaaaaaactatttttacgggttggtctgaaattcccctttaaaaatatgtatactttttgggcagatcccaaagaaatccacctataaaatctattttcgtggaccatgcattctgtacaagacgttaaaactagaagccccactaaaatacgaaaaaaattataactttttcatgtgaagtcggatgatgacaaacttaatatgaaaattgtaggtcttgatgaaacctataactttgcagtttaaagttgtttcattttaggttgtttagtgtggcaaattttttgttactattctcgtaactactttttagttttccaaacaacgctggatggagaaatgttctatattgaaattatcgagctcggccagatctacaactttgttattaaaagctattataaatgagatcgttcaggtggctaatattcattacaggctttgatatatctattattacggggaattgttcagaaagttcaaagtttgaaaaattctagaaaattcatatttggcccaatcgaggtaaaccaaaagttttatagattgttatctttatttattattttctttgatatgagctacttaatatttcttttagtatgcccattcattatgcaatatatcaacatatagagactacaggacataagtgaacaatcatatcaaaagaagtattttaaggaaacatcgacccagaatgttgtaaggttgagaacttctgttcaccttaatcggacataaaatgaattttctaaaaaagtaaagtttagtcattatcaaagaataaagaaaaaagggttttgtcagcagacttcttaacgaaacaccctaaaatgatttttacaggcagacattttaaagagtcgcccttaaaatattttttatggtcggttcacataagggaaagccagtaaaattttgcgtctatagatgcctacaaaaatctaaaatattttttttggggggttcttttttacagttaaaaaaaatcaaaagcatgatattcatttttacatgtgattccttaagagagttgccagtgaaaatcaattttcacgggtggttgtggaatgcgtccataaaaatcatgtgatttttacatgccattagttataggccgattgaaaaacacccatgtaatgaattacggaccacatgcaaaatatttgggtcgtttggttcttaactaacattgccataactcactttaggcaatgttagacaagtgtggctttgccacatttttttgtggcctacaaattgtaagccacacttgtggcaaagttagacaaatgattgagtctatgacatgtggggtaagatgataagaaagtgtggcttgccataactatggcaatgaatcaaacataaggctaaggaggtgtggcatcctaaagtgtgatgtggcaagttgaagcattgaaccaaacagcccatactatctctatccaaaaatataagaacctatgatcggataagacatatcataatattacgaatatgaacaagctttctatttgtgctaagatgtctgaagcattgaaccaaacagcccatactatctcaatccaaaaatataagaacctatgatcggataagacatatcataatattacgaatatgaacaagctttttatttgtgctaagatgtctcatgtgatattatattattatattttggaagagagagtgagtattttcataccagtgtacgacaaagctaggatcgactccattggctccattttcaaattaagctttacaaagaagcagcaatattgctgtattttgcagcctatatgtatcaacttgcactttctttcgctgtcctgactttgttgtctttatggtttaccttttggactcatctgttacgaacatggaggccagctcgaagtgcatgcatatggaatgccagtccggtcctaatacttgcacagttgaccccgagcgcgtggttgccacgtgcacgcactcttgcacagcagtgtgtgccttctatttgacgctattttattttttttatttttagcccaagataatgacatgtcacggcagagtaaaaaagtgcagtgtgtagactcttctggaatgcctcgtacggatcagtttacacgcatcttataaatttcgtttagtcatcgctgatgacatatttgagtactacttatcccatgcggttatgcatgtacgagatccgtgtatacgaatacacgtattgccagtgcatatatgatcatacatgtgcatgtgccactgcccactgccatacgagactttggatcctccaagtgcatgcatgcaggcaggctccaattcgtgctgcaacttcaacaaaataaattgattcgcctcgcctagctgatgttacaaaatggcggacgtatccaaaacgaataatacttggatgaaacaactgaagctcaaaagagtcaggggaaaattaatgactacaagtttgttattgatctgttcgacttcatcgaaaaatcccagcctcggctcgcgccagaaatatgtttccaacacacagcaacgaacatagccttagtacagcacaaactagccacttctatcaacgacaaactggcctactagaaacagcgcgggaaagttaaaaagctcaagctcgggttagatagcactgctttcttcaaagcgcatgcctacaacaacttcggacgaacctccatcaaatcgatcaaggcggcaggcaccgaagtttctgaccacaacagcaaggcacaagtcatgttcaactattactcgctcatcctaggatctgctgaatccctgcaatggtctcactacttaaaaaaaaaacgtataagtcgacactatacctttaaacgaagataggtgtcgattttagagaaaaatcaacatcaataataataatataggtgccagttttttttaaaaaaatccggcacctataatgtgcccgtttttttaaaaaaggcacacatgaacacacattccatcaagaacacacatgaacaaacattccatcaagaacacacatgaacaaacatcaagaacacatatgaacataagaacacaacttgaacatatgcctcttccaccgtcccggccgccgtcgcccggcaacctctgccgcctccacgccatccgtcccctaccgtggatctagcggagggaaggacgtcgtggagacggctgcggcccggcgggggtgggagggtcggcgcctcccccccccccccctccgccagatccggcgggaggggacgtgcagtggcgacggcagaagaggcatatgttcatgttgtgtttttatgttcatatgtgttcttgatggaatgtgtgttcttgatggaatcagttatcggctcaactgcagtcgagccgaccttttttttttcaatcgtggaacctcaaaggtgccggttcctaaaccggcacctttgattcaccatatcagtgccgcctccggggtgtcgattgggaaatccggcacctttggaagtttcacaaccggcacttaagggcttttctgtagtagtgtcttttcagcttggaatgctctacgacacagttcagccttcagccttgagcagtctgatgggcggcttctccaaggaagaaacactctttgcaatcaggcagatggacagaaacaacgcccctggaccttatggcttcgggccaagtttttaccaagcaacgtggcatctcctcagcacagaagtgatgaatctccttgaaagattctcgctacaacatgtctatcttgaaaggataaatcggccatacattgttctgattctgaaacctggaaaagagaatacaccagatggtttcaggccgatctctctacaaaactgctcgatgaaaatcattacaaaagtgttggcaaacagacttcatcgtattctgcaagagctaatccatttcgatcagagaggttttctcaaaggaagaagtatcactaagaatttcatatttgcgactgaactgatgcaaacctgcttcgtcagaaaatgcccaaccctaatcctcaagctggattttgccaaggcattcaattccatcagctgggatagccgcctccagatcctcaccgccaggggcttcaacaccacttggaatacatggattcagaatattctttcaacctctaagtcagtaatccttctcaacggagtctcgggacgctggattaactgcaagcatggtcttcgccaaggagatcctctatcgccacacctgttcattcttgtagctgatgttctccaaagactcctccttcacaatgagaatctcacacccgatgtgcccagacagcccctttaatcatatgcaatgcttgggtcacaggtgccagatcaatgaaattctcaactgcaagaaggaaagcttccctttgtcgtacctagctaggactacctctgtctctccccataagctgcgagctcaggacctcaatccaacaattgctaaagtgtacaagtacctagctggatgggaggcaagcctgctctcatatgccgagcacatagtccttatcaacttagtcctgaacaatatcccagtctttgctatgttttcctctaagctcccaggttgcaaaacgacacactgctaatcaagatgttgttccatccacatagctcaaattcgtcgtggtctatgtggctctagtaggaagctgaggacaaatcgttggcggatgacttgaaccttggacccctctggcgctccctccaatctctcatcccgacggttcaagacctttcaagcgtccaggtgggggatggattccgcacgtccttctagtgtgactcatggctctgcaatcaacctctcaagcttcgcctcgctacccttttctctcatgcagtggatcagctagccactatcaggactgttctttgcagaggactagccacctgtcttgttcctcgcttgtccttagtagcccagtatgatttagctctacttaaagtggaattgtagcaggtcattcttcaaggctgccctaacaaaaggaaaagtaaaggaactccccatcttgaaatcatcctggccaaacaaaactatgactccaggataatgctgcactaaatctgtccaaactggagcttcgtctggaacaacagagcgccactaaaggtgcaattcttcgcctagcttctggcaaaagagcgactccctacaaagcataatctcatcaaaaagggaattgtttcagttgatacatgtgatatctgtgccaatgcctcggagaataccaggcacttcaacctgcactgccctcgggtcaggacaataatcagcgtgaatatgatgggtcaggacgtcaaaaacctggcgaacattaagccctctgggggattaccggcgctccattttcaagttttcttcatgttatatttttggacgctctggaaccatagacatgatgttgtctttcgaaatgcagccccctaacttcagttggttttgcttaagtgtgttgaagagtgtgggatatggctagaacgaattaagcgcaacgatcgctttgtaattgcgatttggaagaacattttctcctcttccctccaacctctaaatgttgtgtagaactgcctttgtaacatcaataaaattcaggtggggaatccccccggcccccgcgtgacttgtctaaaaaaaattagtacagaacaacaccgtataaaacgacaaattatcttctatttttgaaatagatcgagttaattttcttttggagaaaggctaatcaattataatgtgagttaaaaagtttttctctcagtttcacaacttgcgtcgagattgttgcaccacttgcgctccgtgtcagttcctgtctatctcatattgatctgtagctagttttcgtagtttcgttggaataaattttttagatgtttaggacatcgcaatgttgtaaaaaaaagtaacattaaagtctctaaggtgaacaatatagctattgtgacattgaagctaagtcataacaaaaaaaaataatcataagtttgcgattggtcgctagcgaataaaaagatcagagaatctctcttctccctctgctccattctctctccacctaataaaaggcttatttggatagtttttatttatttatgaatgagttacatatattatttatcgagaacttaatttcgtgctaaggtaacaactacgatcaactgacaataggacctattttaatgctatatgttgcgtaacaaatattagccttgcccttagatctatttagatatatggttttggccggttgtactccccgtgatgtttatggtggtattagaattgtttagaggttaaagtactctatgtacatctttatgaacaacggatgtgtttgcaaggtttttaacaaaagatttaaaaatttgtctcctaatttttgatcattcaatttatcggtggcactagctatatggtgaggatcattgactttcctatgtgctctgttggtttgctataagaatgaagttgttggccaaataagataatcaccgtaagaactaagatagccagataggagctattgtaagttgtaaccaaggcctcttatactaagtagagtaagagtatataatacttcctccgtcccaaaatataagcatttttagacttcaacacagtcttcgaggtgctactttgaccaataatatctataaaagtaagatgttttaaataaaaggagttgcatattatgatagtttgtttaatgataaatctagtaacatctaatttacattattgatcttttttttctattaatactcaaaattaaaaatgtttgacttgacactattctaaaaatgcttatattttgggacagaggaagtaatacttttcacagcgctcgtgttacatgaaaaaaatatgcatgatagaacatcatagctcttttttttttttgaatgtgttgaagtatatatgggactgtgtacaaaatactcgaatgttttagctaggtcaacgatcatattttctaggtataagatatatagatcaaacagttaagatatctcccttccggtcttctccttcatcctactttgctgtatcccatgccacctcctacctctctagtgacatctttggcgctaatgaggcccaacaattaaaccgtgctaccactcccaacggttaggccccttccaagccaccatcacttctctcccctatccttagctcgtgtccgttgtccatgtcacccactacaccaaagcatatgaatgcactttgtttagggcatcagcaatatgctcacaaaccgatagtaagcaataaatacatccttactaccgggtagtaaacattgtgagactagtacgtaattgcaaccgggtcatatccctactgccggaagcaaggaaatagaatatgcatgtgcacagtattttctgacagcaaaagcattgcttctcccaaccgttgcatgcatgcttcgtccttgctgcgatttttttaccccatggactccaccttactgccaactcacagaaataagcaatgtgaagcacgcctctctttattaccgcctgttatctaggcccacgctaatacccatgtagatagtatacattgctgatgcccaggtagaggcgttttaagacatgccgtacatgcatgtacctctcctctactcttgcagttgcagctgatcctgtcaagctccaccaccaaaccactttgtcctgtaagctcatctttcccacggttttcactgcccccactgccgtccctacatgtatacacaataaatcagtatgtcttttgatcataatatccaacatgtactgttattaattaacaatatgctactgtaggatgtagccgcaaaccgtgccatccttctcttattatatggatggaggtcttgagcatgaacagtgagacgtacaagagaccaattcggatagctacacacaaagacgtcgtcgatcgtacaacttttctccatagtttttaaagctacacacccttagaatcatcagtctctttcttgagcaacagcacacacgccagaaatgccagctgcccggccgacattggagtagagaggagtagagagcaccaagtcgtcttcttccccccggcaatgcaagacgacgtcacgacgaccctgctgggaaactagtgctccatatacaaatgtccagaaagaatcagttcggtcggtcagatccacctgatcgatcgagtagctctgaaaaagcgagaattttatcgttaaattattccaaaggcgcgtggcggacacgcacgggacatggatctcgggcctcggctggggggatgaactaattgtgggtgatcaaacagttgtagcgatgaaataatttagctgcaagtggaggtcagccaggctggttttcatctgccattctgcgttcacgcgggcgacggcaatgcaactgccgatgtcattgctcacattagcaccggctctttttttctaaagcttaattggttctctgaatttctgagaccacacggcattcgattattcgatcgatacatcgcttactatgggcgatcgagttcatgctactactgtcctgctactctctccattttaatttgtaacctaagattgaatgaaacttaacctattatactacgaatgtaatataaacataggatatgttcatattcatagtagtacatattgagtatcatctgaacttatgatactatattatgagatggggttaataatatatatactatctccgtctcaaaatataccaacataggtatagatgaaatacatcttaacactacgaatctgatatatgggctatctaaatttatattattaggatgtgtctcatccaatagtaagaggttttagcagattataggagtataggtcttttgaaaaagttgatgtgtgctttgatttgattatttaccacaccttctgaaagcaaatttaccacttgcaagaggcctgactagcatgtctgtcaatggcaggaaaattgatgtgggtaagtgcgactaaccagctgtaatcacgaacatcgatcacgactagataatgaacgtcgacaaggaactttttccaaggcgagtgatgcatatgtatgacatgtacgtccattcagaagcgtgtgctgtgagagttttctgcagctcgatctacgatcgatatgatcgaatccagagtagtatccaacaggcagtgccaatactgtacgcaagaccaaattaaaacgtactcatatccaacagcagtagtgtactatctctcgctgcaaaccatgacttctttctaatctttccagttgcaagccgatctactgataatataactaacatattgcatacgtacgtgaaataacgttatccatgcttagcttaattcaaagtttatttttatatatcaagcaggtgctcattgacattggtgagaaggacgtagaagtaacggcgacacaacaaaattagtactatacgttaatcttgctccgatcctctgccaccccttcatttctatacccaacattactttcactagctaagcatctattatttttcatatatatctgcaggcagcaagcgtacgtataatcacagcttaatcagccgacatgaaagtatttaatcatacagtaccacattaattaatctcccgcgaggaaacatctatcctggtcaaagcatgagtaaatacttaattaattaaactagctcctcttaatccatctacataaaaattcgtgcaaaagcatacacggcatgtactgttcgtccgtacgctgccgtctcatttcgctttcgtagaacttgctctaggaaaacaactatgctagctataaatacgtacaccaccatactcttcgtctccactccaagcaagctagaaaaaaaaccaagtgaaaacctcaaagcagctaggcacgcgtcaacgcatcatctccttcgatcgtctccttgtagtggctatagtgtgctcgatctgagctagctttgatctctttgccatgggaaactgcaactgcttggagagggcgagggcgaaggtgacggcgtggggcgcggaagagggcgacggcggcgaggacgagttctggggcgccacggcggcggagttctccggcggcggcggcggcggggcgcgaggtggtgtaccgtcgacgaggaagaaagagatcatcaaggacggcggcggcggcgagggttcttcttcgccgacgaggcgcgtgaagatccggatgaccaaggggcagctgcggcggctgctggccggcgccgggaggggggcggccgtcgaggacgtcgtcgcggagatcatgagcatgggcgacgtgcacgtcgagcccgtcaaggcggaggagggcggaggcggccgccgcccgccgccgtcgccgtccaagctggagccgatacaggaagacatggacgagtagcaggagcagccatgggaggaggatatgatggagatgagcgtgagatcgtcagatggatcgatcatctggagatggacggtggatgttgcttcaccgattttgcatgcatgctggttggccctgtttgttttggatcttgtttgtatcttttctttgctctagttaagttttgtaggacgtacgtatcatgccatattagaggtagaaattaggaggggatatgtatatagtaatagatgtgtacgcgtgcacatgtacatttttgtactggtatgtgtgatgatatatactacctccgtttcaggttataaaacgttttgactttggttaaagtcaaattgtttcaactttgactaagtttatagaaaaaacaataacattttcaacccaaaacaatatatttaattattgattaaatgaaactaatttgatattataaatattactatattcgtctataaacttagttaaacttaaagtagtttaaatttgaccaaagtcaaaatgtcttataacctgaaacgaacggaatagcatattctttctgtgttttttatatgggaaatatctagtgataacttcaaataggtgaaataccctgtgaaagccatgtctaaaaagttatctcaattttcacaaaaaaaattactaaatatagatataggttgataggcatgaaatatattcatgtaacaaggtaataaaatagcgtatagcgggttaatagcagattatattagtgtctgggtagcagatataagctccaataacggaattaatgaagcaaccttaaatttagattggactatatcaatactaactttaagtttcacttaaaatttataaatttagattacacacttaattactcatacattacatagcataaaaaaatatgaataaacctatagagggacaagataaagaagatacacaacgttaaattttcctatccatatatacgaggaaaacatcgttacatgttggattattgccaatcacaatcctaaataggggtttgtttgtaaaatttcatttcgctactggttacaatgcaaaactaagggtctttttgcaaacctttggatcgctaccaataattgtgatacaaattatgggaaatacgtagtgtaaactccctatgtagtgtaaatatgtaatagtactcgatagtgtaaacttgtacaggtttgcaccatatatgaagtttgcattatatattttccttacaaaaaataacctgtttttttaaggaaggaattgagtttctgtcgtttaatattggtaggagataaaaaaaaaggtttacagttttacatatctgttacatgcagtgcaaagaaaacaataaaacatttttcgccaaagccatagacaaaagttgtgttcgaactagtagtttctatgtgctaggccgagagcgtcgaattcttgcataattgcaaaaacaacctgctcttcgctttggcttgtatcttgaaaagttattctattcctctccagcgagatgagccactcctttctcatgttgtctggcttgactcttgagtttggtcagctaaatcactagctattttccctacaaaacagggcgcattttgtaaaggattgagtaaggctgcgttcggcaactgaagaaagtgagtgagtttgtttcgattttcgcgtgcacgcttcccaaactactcaatggtgtattttttaaaaaattttctatagcaaagttgctttaaaaattcatattaatctatttttcaaatttaaaatagttaatactcaattaatcatgcgctaatagctcacctcgttttgcgtatcttcccaatcttctcaatctcctcctcctcaaactacaccgaatctaatttttatccttgaaccccaaaaccaaatacaaccggtcgtccctgaattgtcaaaaccggtgcaaacgagatccctcgtcggtttgaaaggcggttttggctgacgtggcgcctacgtggctggtttgactaggtcttcgtcccacgtggcactgatatggcgctcacgtggtaattctatccccgaaaaataataaaaactatgggcccatatatcagttacacaaaacaataatttaaaaatggtggggcccacgtgggccccacatgtcagcctcactcatcccttcatccctcttccttctctctcttcttcctcatcctcactcctctcttctgccctctcccctctttttctctctcttcttcccggggaacgccggagcagacgggcgggtgggaggcggagcaggcgagcgaggcgggctgtccgagctccggcggcgatggtactgagtggaccgcgacaaggatccccaagacgatggacaacgacgccggcgacgggagcctcaaccgagggagaggaggcgccgcgatggccagagccggggtggtcggcgcaagagtcggagcgcttgaccgcgggctccgatgacgaggacgaccactctggtgccattgccaccgcccgcgccaagaaggcgccgccctccatcaccatcatgctcgagaaggagatatggagttcgacggcggcggcggcagcggcgg

SEQ ID NO: 1424 - DNA, 37899 bp, Oryza sativa
catcgccccaaccatccccgccaccccggcccccgcagcagcgcttcctcttccccggtcgaggctcccgtcgccaacgccattgtccaccgtcttggggatccccgtcgcggcgcactcagtatcgccaccgccagagctcggacagcccacctcgctcgtctgcaccgctgcccacccgcccgtctgctccggcgcaccccgggaagaacagagagagagaggggggagagggaagaagagaggagtgaggatgaggaagaagagagagaagggagagggatgaaggaaggagtgaggctgaccatgtggggcccacatggcccccaccattttaaagttattttgtgtgtgaaaccaacatgtgggtcccacgagtttattattttttattaaattaccacgtacgtaagtgccacgtcagttgaagacagagccaaattagtcacgtaagcaccacatcagccaaaaccgccatctaaaccgtcgagggacctcatctacaccggttttgatagttgagaaacccgttgtatatagttttccagatgaaggacgaaaatcggattcgttgacatgttaagggacctcagatgaacttattccctttgtaaaagtacggatcgtactgttccaaaatatctcggcccggcccatcaaaaaactttgagcaggcaagtgcatacgtcaacaagggcctataaagtttaatgggctttaacttggaagacccctcctgcccagcccggcccggcccatgatttcaccatcgaccggccacgctcccgctccgcacaccgccgccgccgccgacgacgacgaccgccgcgctcctccacctggtgatcccaggttagcgatctctacgcagtacccaggtatgcttcgttctctgttccgtcctgactcggtccatctttctgcctctccaaacccctctccggacagacggatcggagagctaatacagaaggagaagggggcaatgcgtaacggagatggggaaatctggtttttgggaataggtgtaggtggcggcggagagggtgatagcgatgatctcccatcgatgatcagtatctaggatttccagttcgacggggagatgcagcctttttcagaagatgcaactttgcctgtgcgaagactggagccagaaagatacacagcatatggtaggttaagtgatcatcagttcatcagtaggatttagtttataggatgattaccgattgcatctcattatctttgagttgtgtgtttgattaatttggatattggcacaggggggcaagcatcatgcatcatgcttccgttttatttttcccttctgtattctgaaactaacgcttagcattatgttcttgagttcttccattttatttttccttttatagctcataaccattatctatgcagatatctgttatgaataattcggatgccttggaagacctttatgtaagtttctcgagataccatttggttttatttatctttctaaattacaggaaggaattgccaacagagctgtttgagaaacacgtatcctccctccaccaccaaagtttgagtactattgcttaatctgatccaaagtttctacatagtatctttattttattttttttgtatggcgatctaatggttgggaaaaaaatgaccagtagataatagcaaaatcagtcatctgatcaaaatttcaagtaactttcaggctccatttttcttttcgaaactgaccaacatttggttggggttatatcatagaagaaagcaaagagtacataataacaacaaggagtcagccttcttggcatatgctcctgccaaaataaagttgcaacatattactgcaattactcaggaatcaaatatcctcaccctcgcccgttagtaggcttgctaatgcttttaacctcctgtttatcatgcccaagtttcttcgtgatccggtcaatgatgcgtgccattgtggattcctcatcacggaacactctatcgtcccctttctttccaaatcttccaggtgatgactgatgtggatgaacatggatttaaccccagtcttctcacttccacagtaatttgcagttcctgcactccaaaataattttcagttcctgtactccaccagtgaactcaccaatttttcttgagcaatcttaggagcctggccaaacgggtcctatatctctgtggtctcaggccacttctattttctttcattatctatgaagtgcccattctgttttctgactgaataaagcttagtgcagttggagcaagggcactcttatcatgccacatggtgatagatagtggtgtcacaatcgatttcctcacaccccacccagttctcagccatggacataaaagagcagctagctagtagcatgatgaacacgagaattaagaattatatagatactgctgctctaccaccctctttggtgcacgttattattcagagttgaaacgaccacttgagatcaatcccttttaggtttttcttttttggctccatgataaagaaagacagcagaaagccactgcaaaagtgccattcattccatgctcgttgatcggtttcgttatcgtgctgcacaaaaagcgccatgaaagaaaggcaccatgagcatacctcgatcgcccaggcgttggttttatcagtcgacctgcaatttcagattctctgaacctttctggccggtcgaattctgaattgtctccatatggccatagtggagcactaggattcgttggaggacaccggccgtttacttggtaaacagtcactgctcactgctacatatgccaggtaaccctgtgtgtgtagcacatgaaagtaatggagtctgatctgtgtcactgtgttctgtgtggcctgtttcaggaaatgaccttggaaacagtctcttatctctgcgaaaatccaggaaaaatccttagctccaaaatggacaggaagtaccaagaggtaaagcaatgattggaaaaaactttttttttgaggggacaatgattggaaaaaacttggcttattattactgattctactactccctctggttctaaacatgagttactttagtcttctcaactccttcaaatgctaattattccagaaatttcaagtcttttaatttgtttacgctattctttcatccttgctgaaaataatcgctaccactcatgaataatgagtttagcatatatttttactactacactttgaatccaagctattacactttgaatccaagctattataccagattgtgaggttaactgtggccttcaatttattctttggtgaactggtggtgtactgcagatgaaacctcaaacaaagctgttgatgtgctgaatgtgcttagagacccatagagactggctctgtggaattggggttatttttgttgcacacgtttctacgacttctccacgtagtcctatctttgttttgcaaggaaggccatcatgtaagcaatcatattaattcttggaaatggtgatgtgataacaatagataatcaagaatcctatactagtgtgaggtaaacggtgatgagtcagctttaagccgaagatactgggattgattccagaatatgacgatagtccaagagaatgtgattatgtgagctccaaaagagggcacctcatggtttagataagaggagaaaaggtcagaaagtgacagcagccatgcatatgaaaacaaattaacggtgaaagattacttgcttgatctgcatgctagcttaatccactgacgtaattgtccatgcacatcgcctcgaaagagttccagaatcaattctttcctatggtgtaagctcacctttatccatattctgatgacatgtcaaagcagcagaagatacatatacaggcatttcagcagctgaaatttaattccttccaatacagaggccggcgatatgtaattccatataaattaatgaagaagatgaagatatgtgttggctttcagcagagttttatacagattacttctgtttgtccgcatccctgggatggatcaagagatccctgaatatttttatatctcatcttcagaatcaataatctccatgaatcctgatcagatcgaggtcgcctatctggcaatgattaacccgtacgtgacagacgatacagatcgatagcttccatttgcgctttcctcttctcttcctccctgaactgaactgcatatcacactgtcacagaactgaactaaactgggctgaactgcaagagaagtcaaaggccagaggcctctcagtccagccacaagatgcggcgaagtttatacgctaagatcacgcgcgctgtggccccgtacgcatgtgcatctcatacattccgatccactactacttgattaagcatatgtttattatcatagtatcatatacagtaaataattatataatacctccgttttttaatacattataccgctgacttttgtcacacgtttgatcattcgtcttatttaaaaaatttacgtaattataatttattttgttatgagttattttatcatttaaagtactttaagcatgatttatattttatatatttgtataaaatttttaataagatgaatggtgaaatatgtgtttaaaagtcaacgatgatatttattaaaatgagagggagtatgtatgtacgcagctagctaactcgtggatttgagctgtgctgtcgtcagttcgatcttacagttgtaaagcacacaccattgttcccggcctgtaattaacctgtgaggcactagtccccgtgatgagtgccgcaagagatgctgagattaattgctgctacgagcataacatgcctggtattggtcctaacaagttaacaaaaagtgcacatattaattagcttttgaagccaggggagaaaaagaaataaaatgcaggtattttaggatattgtactatatattaataaaatgcaatggaggctatcagaaagctagctagtgatggggataagattacccttcatgatcatttcgctatcggaatggccaagtagagagcgccactgcaccatggtggatctattgggtgccatagaatggcccccaccaaatccgcaagtgcagtgaacgtaaacattctcccctcttcttcagggaacgcacgcctgagaatacaaccaagcctgtcagaccagagcaaagatcaactgatcaagcgtgcggcaaggaagaaacattgcaatcctagcatactcctctggttagtacatgaattggtaaatgcgcatgtaggtctcggccacggttttacttcattcgctggaacgatgatataggcatataggtgtttctttttttattaagatggagatgaagtccatgcccgtaaatgataaagtcgttagcatataattaattgagttttaattatttctaacgtggaaaatagatttattttatattttaaagtaacttttaagtttttatataagacgcgtattctagcagtttgaaaaacatgctaacgaaaaataatgaaaaatctacatctaaattagaaaaaagagaaaagaacgggagagtatcaattttgcatgtcaatctaattaatttcctcaaataattttcttaaatatggtcacctcctaatccatgtccaaagctgccctgtgctaatccatgaagaggacattgcagtgtcctagagagtgcatttttatataaagaaaactaactgtattcaaaccaatttagccagtagatacagacatgcattatttcatttatcaaagggaaaacacataagtgcacacaccatcatacacatggcacatcgaagaatgtgtctcctatcacatggttaaaaagagatagagattaacgacgactctttaaccttactgaaaagttttattgaaaaatgcatctgtgtatgcttaatttatttttctctatttcgaatacttgactgtggtgttttatatccataatgtacttattttttcctattaatcaaatattcctttgcttttgcatcttggaaaagtgagagaaaagaaaaggggaaattggtgggtttggggaaaatactcacacgcttgctgaagaaaaagtgatggcaggcaaactggaaaagtggtagccatcgaatgcctgaggatatttgcctgccaaaagtgccaaatgttttctcccgagaacgccctcggacccataaaaataagtgcattatctcttttgactcttttaatagatcagtccccaagaaacattggaatttgcagatctgaaattactttccaacgtcttggaaaccatctgagtatacaatgtttcatacgaataacatcgtatatgcttcactaaaacattttgaggtaaatattcatttcttgcttaatttagtaaggtaggagtattagcctctcaaaatgaaattgggataagctacaggttataagttataaccaattttaaatttcaggattactttacttttttttcactttcttcgcttaatctcaacttctaaatttctataaaaaggttttgtcttaaaaaagtcattcctgttgcttcaatcatatcctttcgcagcatgggcagccactggaaaaaagacgccggacaaaccttgagcttctatgctaaatctttctactcggtctatttcaaatatgtctaaaatttctcataaccgtttcgaatttaattttggtcctccttaatctttgtgaagaacttagaggggtatatattttaagggtctattcattttgaagaaaaaccaaaagatttgggttcctaacaattaactcttatgagtatcattcggttcataggaatatactacatccgccccaaaaaaaaaagaaattctagtttggttagcatatattaagatttcataacaaagactataatgcccttattaaatggctgataagtaacagtgagagggtagctaagggcaaaacccacagaaattctgatgagaagggatcaacgggaccatctggactttacagtgacaactatttaggacagattcaaatcctagaaatacaattattatggggcataggtagtagatatagaaaaaccaaatgaaaattttctttccctatagacaaaacatagcaaatttttcatccactcaaacatcttgaaaaattcctatgaattaaagtgtggcattcttattcctccactttcctattcatatgtgttaaaattcctccaaaatgaatatcttatgatggagtacatggaaacattttgtaatttccatataactaccatgggcttctgtgaaaaatccatcatgtataaataacctgttctctcccattccccatcctctcctctgctctccatttgctcgcggcagattgagtgtgcccgtgtgagatagaatctttttgcccttcaaaaagagcaaagtggcagtgcttttccctccggttcctcgttttggtagtattccattgttcctattaccacttcccaacgaactaaccgaagccccggatacaacaaaagagaagacgcaaaggaatcatcagaagcagcagcagcacgcgaccatgggcgacgccgcctccaaccaacctgtaagttcatcttggtttttgccgttttgctttgtgtggttcttcgtcctgattaattgcgagaggtgaacgagttttttgaccttgtgtttactggaaaggatggaggattttgctttgtgtgttttttgctgaatttttttgttgggtgtttgcaggttcttgcggcgagcgatcttggccaatcgaacttggacgccggcgccggcgcgggagcagtcggcggcggcgggttcatcgccctcgacgtcagcgccctctcctcgctcgccggcgacggcccggacaccacggcggcgccaccacggacaccggtaagttggatagacgcgagcgcgcgcggcgatggcgacgtcggcgatgtacaattgtacatacatacgagcctccgtttcttccgttcgtttccaaagatttgattgattctttcctctttgtgtggttatgccgcggacgcgacgcaacagaaggtggtgaggtcgctgtcgaggaagggggaaaggaagccggccgacggcgacggcaatggcgccgccggtcagtccacctataaatctcatccaatcaaagatttcatcacttttgatatcaatatcttcagagttttctattttcgcttggcatttgttgggttttttttttcaattccatggagattttgtaatactcaattcgatcctgacagtgacagatcggttaccttgtcacaggatttagctagtaatccaagctgacaagtgacacctatggcgaattagtttacgtacgggtcaggattaatcgaggcccgtgtgtgacttttggcactctcatgtgcagggacaggcaagaggccgccgctgtcgccgctcttcgtgcatgtggcggccgccgacgacatggccggcctcggccggctcgtccacacgccggtggccggcacgccgggagggaagtcccggcggctcgggcggcagccggcggcgccgtggctcgatccccggagggtggtcttcttcttcgccacactgtaagtcaactggcaatagccacttatagcaaattttatagcagaggtgatactcatctctaattttgttcacgtcatttacttattattaattaatacaacaaattatctctaatacacttgctccaatttaccataatatttctttctttatttgttttcacttaattcattggtctgtttctcttatttctctgtaagtttgtatagaatttgtccggatgacttctcctttttttcccttctcttttccacttatcttttccacctcatcatgtgatccatagtatctcatagtatcttgatgcaagagctaagaagtccatagtacttgctctaatcatttacaagtgataatactgatagtataagaaaaagaataagttcaaaacggtaaatatctgaataaaatatttacgagttgtgcagtttcccaatagctagaagtagaaccatttcttttgagctgctacaagtacactcttgctaatttcttgctagtgattaggcgaaaaccgtggtacttaaagaaaaataattgacgaatttcctaaaccgtagggcacaagagtttaattgtcctgttgtccccaacaacgcaaaaaaaatgtggaacatggcctcgtattagcggctgcattaatctgcagccttttcagatcgtagtaggttcgctgcgaccggtggatgaatgaatgggtgatgcgtgcaggagtttgcagcacaaagagcggccgggtttctcgttggcgagtctacgtgtcagaactagttttagttgtcagctccggtttggctacagcgatatacgggagaaaagacggcgactgacgaacaaccgttctcgtgtacagtatgatgacccttgctttagaaaagaaaatccttcattttttgagtgacttttggacaaggtttactgaacctttaaaagtcactgaatactgcttccgagcgattttgttgataactgtgataaccccttggttacatgtgttctttccccttctttgccaactcaccctttttttttccacactcatgttatggaatgatgtgttttttaaaaaagaattataagaaaattacttaaaaaataatattaatctatatttcaaattttcttatattaacacttaattaatcacgtattaatgggtaacaccgttttcgtgcgagaaggtgtagttcctaagtatggaggtgaacaattttagcaaactcaaccttactgacgaaaacagtataaagttgaacaattttaccaaaaagtttgacttctggtttgatttttttattcaacttgactagttatcgagcgatttatcaatgtgtacctattcggtaaatcagataatggagcggccatcgtcacatttatcaaccctcctttttttggtttggtttggttgatcttgtaggtagaactctgaatttacgaaatcgtttcattcatcagtactgcactcttcagagatggtgaatgctcatgtaggttttctgcttttctgcaggtcaagcgttggaacgttgatcctgctttacttcacactctccatgagcaagatgggcggcgacagcggcggcggcggcagcagcgatgctcggtgaaacgccggctgttgaaactgaagaaaaattttcgttttgttctcaaacctcaatgcaatctgtaaaggaggcatgatgttgctacaaagacccaggcatcaaaaaaactgatgctcttctaagggtcaaggaagaatatagagtgaatggcagtgaagagatcaggctgaatggggtctgatggtgaagtatgcgatggtagttgcattctcttctctgttgctgtcatgatttcttcagttatttttctcttcttttttttgcataaaaaggggtacatcatacatgtcgctttgaagcgatgatactagatttttcatccttgatgttgttgcagacacacaaacaatcaaaaatacaaatggacacagatgtatttgaaagaattgtcttttactcatatgtcatttccgtaagagtggtagtacatgacttcaacaaagagttaaacgaacgaacaaagaatatgacacacagctcacaaggtggtgatgatctacaaaatgaattaaaaccctctctatgcacaggtgatgctaacctaatatgggacacgtgaaaaatgccggatagtgggtagttttttagacttttggattcacttcacagctgcagaatagacttaaaagtccctagcaaaaatcttttgatactcaacgtgagtgttaaccatctctgacagataatcgtagattctaattggagccaccctgcaagaacagaaacagatttcttaagatattcagctcaatgcagacaaattcaggacacctaccttagcaacctaaaatgaacgcttttttttcagaagatttttcaacacaatgaaaataacaatgactatatccggcatttttcaggatgcaaccatgcagttgattgacagccacagctgccattacatactactcaggaaatagatgataaacgtatgtagtttgccatttgaaaagactgaattgtgaatttattcccactttttatcagacgcaaacatagtatcaagtgtgcaacaaggactatatctttggaacattttccccttgagctgctgctgcaatttccatctaaccagatttctgatcagctcaaccagacttcagtgactggaggtatggttcaggatggccctggtctagcagacaaactacaatattggttgaagcacatcttaccagagctccattctggtacttacaaccacatatccacaagataatttgcgtagtgcgaaaagcagccacaaaatagatgtcactccaaacaataacacccaccggaatgaatgcaacatgtgtcagaaaaatgatagggaaataaacaacagaaagaagaaaaagaagagtgaaagtagcacaggttagtttcaactttcaagtgtcctaattggaaactagacccactttcggcaacttctaaaaatccctcctgtctaatccaagagtgattcttcaacaaaagatcctagtggtcaaaactagaagacatcacaatgaaattcgtcatggaggatatctatatcttgtccacatgtaaacatatttactgatggctacttatttctctgaaagcattatgagtctagtttatctggcaaattttggacagtgcaacctagtgttttacctgattaattagcaatgaacttatgaccaaaacaatttctgctgttgaataactcagacaatgaaatatacatttatttgctgtgcactatgccttattcatttagatacagaagccacctagaaggtggtaacacaaattaagagttaataaaaataagtgcgggctaaggtactcttgacatttatcaaaacacatgtactttacaagacgcagaagagatagaacgtggtgctagtaccgttttgatatgcgtggcatggcgcacttctgtttcctatcatggaatatcctcacaacgacagcagctgtttcctctatagcttttccagtgacttctgcacaaacacaaaacaaactacacttcaacatatgaaagtacaaagaaaagtgttcccacaaagacaattaaattgatcgtaccgatgactggccatataggatgctgggcgaaaatttgattggcatgatccaactcccccctgacatgttccatttcagcataattgcttttttgcccatgaaatcctagagttttggcccttgccttcctgattgcttgaagaaccacagggtttattgtcaatccaaaaatcttgtcttgatcaatctcaaaaagggactttggaagattcactcccattacaattggaacatttgccactttataccctttttgagccagatatattgacaatggtgtctttccagtacgtgaaacaccaacaagtacaatgtgtgcacggttaaggttctgtggctgagcaccgtcatcttgtttgatggtaaaatcaatagcttcaattcgtcggaagtaatcctcagtaagttgacccttccggctaggagaacttcgtggaattccagatggagcaacaccaatatgggaagctatggcttcaatagtaggacgaagaatatcattggatggaacaccccaaagctcacaggccttcttagttgcctcagccattgaaggatcagcaagagtatataaaaccagtgctccttcttttgctgcttgctttactatctcaataagtctatccatgtcatcaatctaaagcaaatttgtagcaaaagacaaaataatcaatatcaagaaaactacacagctagcttcatttatcagtcaatgcaagtgcaaattagggtcagtgactaatacgcgaggtttctaaactaggaaaccagaataactccttttgtgcaatagtgattcaaccagacatacaatgatcatggcaaattggcaataagcacacctccatgcctgaatatccaaagtactatggtattcatttgttctgtgtcctaagatacgtgcaaacaagtgaacactaaattttcaccgatgaaacaaatagaagtgcatgaaggagtaaccaaccattcagttctcaatttacacaacttttagccatacacaactccatgatccacaaaaatgtcaatgtctgcatcactatttaataaaagtatgccgcatcaatattcatcttaagttccatgtggaaagtctttcctccattagagcacaagcaatttgtgcttctaactggaaagtctttcctccgttagaacacaagcaacctgtgcttctaactgcgagcatattttaatagcagccattatcatctagtagtgatagcatgaaaaaaattttatttcttccattctcaaacaaatataatgtgaagtaatcccaagtactcacacgctactgaccttactctaaatctgatgtataaggctattaaaacaagctgaaaagaagcaggagacttatctccacaccattgattatggtgtagattaatcagacatatatatacagaacatcgctcttattatacaattgtattttcagagtaaacccaagagttgtataacaaataaaattatgctttcaattaaactatagtctagcttgtgaaagaagattcagctggttcttcgaaagctagatgctgataattaacagtgaaatcaagtatctcaaatccctaattagccaatcctgataatgtacagcaaggcaagggacaggtatgcagcaaccagtccgagagaataaagtgtacatgtgcaccgatcatcggtaaaggataacagtttatgttatacagcacaaatctacagctaaaatccaaaatcccctttattcccagaacaattgatatagtttctatgcactatgttggcatatcatgattttccagcaagaacgaaaaaattatactattgtacgaagcagacatatctggctggacagtggagaccatatatatcccaaaaattgaagaatcaagtcaatagagggcggcaaaaaaaattaaaaaaaaaaaagagacaaggagaaagaaatggatctttaccccgttgaagaggtgtgtgttgacggcgcaaccgcggtcgacgaggcagtgctcgaactggccgagcgcggcgttgacggagtgctccgccgtccaccccgtcccgtcggacaccatgtagatcgacttcgccgcctcgtccctcccaaccaccccgtagccatcctcctcgtccaccgcgaccttcgccgccgcggacgccgcctcgtcggacgacgggtgcggcctggtcggggtcggcggcgacgaggccccgccgctgccgcggtcccgtatcgtcggccactccagccgcctcccggaccggtgcgcgcgggcccgcgaccaccggtgcagctgcgagctcccgagctgcgcgggggagcgcggggtggtggccgacccggaccccgaccccgccgcctcccgctccggctccttgtccggccccgggctcggcagcgcggcgggggtgccgggcgtgcacgagggcggcgtcaggcggcggccctgtaggcgaggcgacggcgggaggagcagcgacggcggcggcgacgccagcttcgcgcttatcatcgagccgaaccgcggggacgtcgacgacgacgacgacatcctcgattcccctactgagcttgagcttactacgcgcgacgaccgtacgacgaggagagggattttttcttcttctcgttttcgcttcgtgttggcgacgagacgacgacgtttgggtggggttgtgaggcgcgcggcgtttttttatggccgagacgacggtgaaaagagaggaaaaacgtgggacgccgaccgggcgccaccggggttggactcggcgactagcggaatgaatagaaatgattggtgtttcgagacgatcgagctggtttttcggcgtctgctctgcttgccgttggaatctggtctggacagcgtgcgtttgcacgggtcgtacagcggtggtggtttcgttctttgttttggcctccggcgtcagtgcgtcagcccgtcaccatgttgattggatgcgggtggttttatggatcttcagggaatcagggctctgctccgctgatacactcgtcgttcatgtgttctctcttccacggctcgttagatatggatacgcatacgcctgttctattggagagtataattggacttggacccacatatatgttgtttccgtgattcaaaagtcatgtaggccaaacacagttgtgacagagtgaagtttgtgatgttttttaataccaagtataagtgaggtcttaaggttgagtattatccaagacttagtaattcgatactgtaatatataatttaaattttggatccttttatagttcacttggtggtagtagtatcgtataatttaaatctaaccattgatttatcttgtgttttttttcctccatcaattaaaacgtaggcatatttttgccaaagattttagttgccaatgttgccgctgaaaaattcgtggccggagaagccttaaccctgtagcagcatttgtgcgtttgtggtaaaaatatggctgaatgatgtcggggccaagggtgttggcctcgtttcttgtgtgttcagccgatgactaactgccgcgtcagagactgggtcatgtgttgtctcttatcatttttctcgccatctcagaaatgaaacgtcttaattaggaacaaaatctcttcaatacatcaactcagcaagcgtgagttcacggggtatcaactggtcgtcaacaagttaattcatgtacatccacataaaatcaagttggtatgtattaagctgatggcaagatctagttgcgatggccacgatgcatcgaaccagtgatatggtagtcgacggcggtgcaagagcgacagctgcctgacgatcgatgatgttgacgcggattctatcgaatcaaatgggttgtccatcagttccatcgtcactgttgcactctcaatacgcagtttgtgcccggttccatctaaccaccgataatatttagtttttctttactattttgtacccatgctcatctctactacacatactacaagtgggatgtagaaagagatttagtccatttgattgaatcgagtggacggcctatattcctccaagggtatgtttgaaatgtcctagatttcacggtagttaagatgatagtatccctagaataaattatcactacaccttgttgattagtaattcaataaataaataaatattgtttgctatgtactactcccccgttttaaaatatgtttttgattcgtagtaaaatatagatacatatatattttagaatggatagagtatgtattgtgccaaataaaaggtcaggaagcaaccctgtgtattttccaacctcataattttgcacatttttctcttaagtcaataataatttatgccggtaaaatattttaagcttagcgttagtacgtaaatacatcaaggtgttgaaagttgtggagatagcccctctaactccaagtctccaagagtatattagccaagtcttaaaaggttcgtattcctaaatatgttaattcttgcgtaaaatacaatctatattatcgtacaaacaataatattgtgccttacagttataaatataataatgtatagttttgtcgcccaattgtgacaaagaaggaattctgtcttaaaattttcagtaaaaacaaaacaatgaaaaaaaaaatcttatgctgccgctgaattgagctcttcaactatgactacgtaatgagctgcagtaaaatataacagtggcaaaaaacaaaacattatcacctttgccggttgcaattgcataatcagcatcctccttttttctcttttctcgattgcgcccgccctgccaaagtgccaagtgcgaaggttttactactagcggttggcacacaggatgacgcgtagtacgtctccggtcatatccaactcctccgtcacgagcttacaccccccaaatccccaatacctcaacatccctctcgccagttgaccaagacatttttccagcaactgatgtcatgacaacatcaggtgaagccacgaggatatcatcggtagcctggccccaaggcaacaaagacttgagccgcatgcagtgtcgacggcacagaaatctgccgcttcttctgccgcgttgcgcccaagcagcactgcagcagcagccgtgttcgcctgcaggtgagctcacacgcgggcgccgtacgtggagcgagtcgcaccgtttctgcggcagtcagcgccgagacctcgcggagacgcggacgcgcgtctgaaaaccgccaatctcccgccgcccctgccgacctcagcgcggcctgtggatttgggaggaaaataatgggcgcagcacgacgatttcggccgctttctgcctccgcccccgcccgcgatcagcggcgacgtccctatcgcactactagtacgtactcctgcgtggcatagcgccgtagccattgtttcggcctgctagctgctgtcatcgcctgatcggtcgccgtgtccacgaaggattgaggttaaatgcacggtctttttatcaaaaaatccagtgactttggccgtatttagttgttttgataaaaaaattgacgtgtactggtaagtatttgaagtattaaacgtaaactaatagcaaaataaattatagattctgtctataaattgcgagacgaatctattacggaaaagtatctagaacttcttccgctggcccttgcccaaatccgctatatatttgacacggatttgccgtaatgctggaactatggcgaatgcatctatcgtcattaatgcataaataaatataccaattagtagtgattgaattccttctatggttatacatgagaaaccagtacgaatataacctacatgtccaatcgaactatgagctagaggttttttgactttcgtttgagctatctgctcttccactgggagagggtttgattgggattgtttaagcaattctcgtaatcgtcgaccccttgccaattgattctgacttgttttatcgagagcagaggcgaattgtgcaaccgttgttatatcgctcgataatgggcatctcaagccttttccatttgaaggtacgactataaaaggactatgtcaaacctacgaaatagagatggcctacaaggggccatgggattaaacaaagagaggcaacttatgatcaagaagggcattagtgactattttatcggtacctgccggtgatgatttgagaataaataaagaagcgattgaaacaactggcgagcgaatgtttggatcatatgctgccttgccgcctaattaatctgtcattagcaaatgtttactgtagcaccacattgtcaaatcatggcgtaattaggctcaaaagattcgtctcgcaatttacttgtaaactgtgcaatcggtttttttcgtccacatttaatactccatgcatgtgtccaaacatttgatgtgacggaaaagttgaaagtttgaagggaaactaaacacagccttcaacagtagaggatcctgatcagtccatgaagacgtcgttgcatttgcctatgatccgcaaatgagtgtagacccaaaaatgttgtcctagaaaaatatgggaaacaaaataaactagtatatgttggtatatatatattctccctgtctttttcttttaatatgattaaccttttttattttataaagaatactaatatacattatttttttaccaggtactaatatacattattatatgctcgagtttaactcgagctcgaaccgagtttgcttgaaaactcgaagatggattgagctcatctcaagcttgtttcggtgaaaaccctagtccatggccaacggtgccaacctacttctcctatataggttcagtcaaggtgcatgttgccgtctataacgttattttgtcgtaagtcaatttcgtaggctatattcggttgcaactgctacaattcagccagcacacctgttgcgctgatacaaaatacaaaactacaaagtcatcgtcgtcttcgttacaagattgttctacctcataaatttcggtggttagtggcacactcgcatgttaacaccacttttccttgtatcctaattaaggttgtgttctaaggtgagggttgggaaccctcaccctagcatacaaaatagagtggtagattagtacataattaattaagtattagctaaaaacttaaaaaaatgaagtagttgtataatttttaaaaacaacttttctatagaaaattttggcaaaataagacatcgtttagtagtttgggaatcatgcgtgtcaaaaacgagcaagaggttgggaacgttcacatacgaactcagcctaagtatcaccacccaatttatcagtctttagtacactttgttagccaattacattgacgatttggaatacaaaaggaaatactagccatagacctcgccaaaaaaaatgctataacaacaaaaaaaatcttatagaaacttcataggactgtcacagaagaccgaaaaatgattaagttctacacggaacaagtaaattttgcaacaatccaaacagggttccgttgcaaataacctcgtagggtggcaaatgccacaacatcaatatttgcacatagatgtgcaatagttacatgtacgcacgtggtaatcattttaagctaacactagtacctctcactaacaaaaacatccccgcccactgatttctaatggagattagcttatttcttttcttttagaaaaaagttacggttgttcagaaagtatctcaagatacctaaattttacgctaaaaaattgtagttgaggaacattacttagaggtatcaaattttacactagaaaatacattacctcctagtaaattgtatttaagatacataaatttgttcggtgggtataatccagtacatacacgaacttgttagaaggtgcgtgcaaaccaaaaccaaaagaacacaaggctaatcttgccaatttgagtgttaactaggatactacataaacatgtacacgagaaaaatgctacgtagacataaatttgtccagtaaaaagtttaatgcggcctaactattgtacagataaagacataaaaaagagaagcaatgcaaagatagaataaagaataataaagcacaaatcaaattgttatatcatgtctcatgccaacctatatgtatacgttgtgtcctaataaacgtttaacttggtaaaattagccatgacatgtccttttggttttggtttgcgagttcatacaccaaaatacattttacaaatttttatactaaattatactccctccgtactcgtaaaggaagtcattttggaatgcgacacggtctccaaaacacaactttgacttcttgtttctacaaaaatatttattgaaaagtgatatatgtatacttttatgaaagtatttttcaagacaaatctattcatatgaattttacattttcaaactcaacaacttaagagttattcatgatttatattcccaaggtttgacttaaacattgtcctaaactacttcctttgtgagtacggagggagtatccacctaataagtttgtgtaccgccaatgtatttttctctttttttaaccatagattagctttatctgtaataatggtgaagaaaagtccatttgagatttttctaaaagaaccaagtgatgaaaatccagttttgaatcacctaaaagaaatctagttctgaacatttagtaatgctttcccacacttaaatgatgtgcctcgaaatgatctagaattatctcgacgccacttaaatagaaaatcttggttaggagagggggaatgttttgctccatttcattctaggattcaaattttgtggaatttgatccataaaatgagtttgcttttgccccattttgtatttgattttttttgtcttgattgatgtatttgtaatattgcactacaatgtatatgttatttaattgaacttttaatatttgcctatcttaaaagagcggagtcatcatccttcgatcccttccttccaccatgtgcaacatgcatgtatgtggaacataaccactagattcaatgctttatcctcaaccactctctaggccatccctaattatatggacatgacgcgttacaagtcatggacatgttactagtctttataatattgtactaatgttgtaccaacatataaagtgaaccaacatgcctttcccaagtccaactgaatgcggagtctgtcaccaccaccaacatccacaagctcattcatatccaagccaaaagcatgatgtttcatttgaaactttatacttttctactagcttctttatttcttcaaagtcagtggttcagtattgtggacaaaaagttcaaataccaagtgaagattttttttcttatgaaacacaattgtcttagattgaaaattggtaaatcatatcaaacatttttgtacttgaagtttaagttcacattttctagatgcaaagaaatagacacattgcattccaaacaacattattttgaaaatgctcaaaactggggaggtgtgtgtgcctgacttgaacaagaaggtgaatgagacacaccttatagatgtctctatcctgtcaatttgaaaacccaaaagtattttctctgtttatcaagagacatgatttggttccttgagactacaagagcttatttcatgacaaactaagagaacttctggtattgtagtcttccaatgcacgaattaatcaaaacctttcaccattacttgccttgtaattctgacactaagaaatcagtaattcaagtattatgtgcaacgtggcaaaactattaaattgaaagtacattttgtagtgtgaatacaatcataaacctggatcgaatacaacaccactacatttataatagagtatatgttgaatttgccaaggaaatgaccttggtgcttcatgttttagaagtcaaaaacagaaaacaaaaggaacaaattatacacacatcatttttcatgaagagcccaatagaaatgttgctccaattagcccaatagtgtttttcttgttccatttgttctaggtccatataccttgggggttgtaagttcaagtgccttaatttggttttggtgattaataacaaatctaactatatgagactaacatttttatgagcttttctttgactagcctcatttggatatgaaaataaaaatgatggaaggtatgtattaaactccacatattctaatcttgtatctcttgtggatctaaaatatagtgtgagctctctcatttcttaattaattatgtgcatatgcattctttcatatccatatgtatgcacaaattgagggggaggttattctatattttgtttattgtaatatctctatcttgatttgaaatcatctttcatctcatctccctatattgtttatatcgggttattatccatcaccaaagagagaaaagattgaaagatcttggcttaaacaatttgtgtaattgttgctttggtgatagatgataaacccatgtttatgggattaacttctcctttacataagttgtcaattaggttatttcccaataatgagatgtagtagacatgcattcttttgtgatggaccttaatcatgacaaggatgaactgcatggaaataaagctatatatatcactttttatctcctactttttgataggttcatatatatgatttccatgttattcgtatataagtgtgagactaatgtttacttgagtcttatcttatttagtctcatttacattaagaacatgaagatcatgaaggtatgtgtttttgtttatctttatcattgctacatgccttcgtgtataggataaactccattggttcttctttacttatgcatacacttacatctcttgtatatttttttgtatgcatatatttagggggagcaaatcctatacatttattgtgaatgttctagatccatattatttgcctattatttatatcggatatttgcacttgagcttgcgtacgagtatatgatacttgtggtgttaatgaatacctaacaaacatattcatatctttcatatgcaaccggttggtcatcaagtggatgatgataactgatttgttggtactaatgttctcctatgaactgtgcaaaggaataggtcccaccgtgatgaggctaatggatgacatcatgggttgatggtcaccaagccaaagacattgccatgttgataagaacgaagtaagcttatgatgagaagaaagtcttaacaaaggatgatcaagacctcggcataaacatgattcaaccgaatggtcataagtgttgatcttggctcaagcattaaccacaagttggatggcgcaaggcaaaggtataatcaagctaagaatgttttcttagtttgttcccggtcttggtgtttggtgtagatcagatttgttagataggcgttgtactatcaagacgggtctatgaagcgagcatgtttcatatgcatgtaggtgcatttggtgggattgtctagctaagtgtaatgagttttcttaagtcccaaacaaagaaagaagttggtacatcctataagtttgggtagcttaatgtggtattctccggtggagtatccttcggagtgtgagccctttctccttgctttaagttgtgtttcatggatggaaatttcatgagttggatatccctttgaataagcttttcatagagtccaagaacgtcaaattccgagacccgagtcaagagatatcatcattttactaacagctggttgtgctgaaaagtgaactgcggtatgaccgcagcccttatggcggtctgaccaatgtgtgttgtctggtctgaccgctgatcctgattttgaaggaggtctcatcttgacgatacagagccgaagacggtctgaccggagccgatggcggtctgaccggcatgcctatggcggtcagactggctagccatcgcccgtgcattaaatgcactgtaatgactagttttctagccattacaatagagagcggcatgaccggccaccccatggcggtatgaccgcccaacacctgggagttcgggtttcgcctccaacgactagttttggtggttgggggtttatatacccattccccaacagcaagggtagggttttggtactccattgcattatcttgaacccttgcaagacctctcacacccttgtgcatttagtttatctagcgaggtgttggagagtgagttaagccaatccaaaggcatttgcttctttgttagagctagtgtggcacttgatcatcatcggcaagcatcctagacttgttactcttggaggttgccacctcctagacggtttggaggagttgcccggtgacctctccaagaaggttgtgtaggaggcccggtgttgattgtgagtggctcggtgttcgccatctccagagtggaggaagaacgaccatagtgatagaggcttatgagaccactttgtggtttgagcggtgaagttggactcgcctcaacggtgacataggaagttggcaagctccgaacatcaggtgaaaaaattctttgtcacttgtcttctttattttgtgcaaatttactttgagcaagtttacatactagagtttatttgcgctattatcaccctaggcttgcaaatctcaacataggctagcttcttagtgcacttgcttgagattagttgatttagattttgaattgtgcaaaaccgttttgatttacgcttccgcatacaaaactcggttttagccaaaagttttaaaaccgcctagtcaacccctctaatcggcctcctatcctacaggggtctcagcccaaagtgaaccgtcacgcgctccatcctctataccctatctctactacctacccgctcctctctataccataaataatccccctccctcttcgccctcaaccattcttcacagccgccgccaaggctctaggttttgtcgagctccttcctttgccataggctcagctcgtcaaatatgtcttagagtcgcgaagatcctcttgaaacgcttcggatggggtaagttcttcaacttttaggtgcttcttttagatctattttattatattccttttcgagatgtattttccaatgatttcttctttagatgaactctagatgattcatttttggatagattcacgggtgacttctttttagatggatttttttagacaattccatttttagatggatgcgattctttgttagatggatttcttagacaacaccttcatagataggtgtttacatacttggttttatgttttacccttttttcatatataattctttcgtagataggtgtttacatatttggtatttatggtttacccacttttctttaggtaatgccttcgtagatatgtgtttgcatacttggtgtttatggtttaaccacttttccttaggtatctttttcgtagataagtgtttacatatttaatatttatggtttacccacttttgcttaagtaatttcttcgtagataggtgtttacatacttagtggtttacccactttttcttagatgattccttcgtagatatgtgtttacatatttgattatttatggtttaaccacttttccttaggtaatttcttagtagataggtgtttacatgtttaatacttatggtttacccttttttttgttggatctacatcttttttatttataggtttacccctttttgttgtatccacatctttttatttatggtctacctgtttttgttggatctgcatcttttttttatttatggtgtacgcactttttcctcacaattaatgttgtaggagcgactggtcaaccctgacggggtgcttggtgatgctgatcgccgagcgcctactggccaacgacgtcacggactacatccgcttccgcgccgtgtgcagcccctggaggcagcacaccgaggacccacgtgtcggcgacggcctccgccccaagtacctccccaggtcgtggatcatgctggaggagacccccccggcggcggcgccgttccgcaaccgcctcctcaacaccggcaccggcgccgtcctcgccgtcgacgtcccggagctcaaggaccacgacgtcatgggccccaccctgggcgggctcctcacgctgcgggagcgcggcggcgcccacgtgctccgcctcctccacccgttcacgcgccacctcaccgagctcccctcgctcgtcaccatgatccacgcggcgtcgcacgacccaaagatggtggagcccgagtaccaccagccgacggccatcggcctctccgacgaccacaaggcggtggccgtgttctgcggcctggtaaacaaggtcgccgtggccaggcccggcgacagccactggaagtgggtctacgtcccgcacttccacctggagtcggccgcgtcgctcgccggctgcttctacgccgtctcgcacgtctacatctaccagctcgagagcgacggcgcgcgcggggagccgaagctggtgcccgtggcgtacgtgcccgtggacgccccctcgttccgcctcacgctggtggcggacgacgagagggagaggctgatgctgatgaaggaggtgttctacgtgcacgcgggcgaggaggtgccaccggaagggcccgacatgctgacgatgcccagggtgtgcgtcgcgtacgcggtggacatggcggcgaggacgatcgcgctgtcgaggctgggcgcgcgcgcgctgttcatgggcgacgaccgcgcggtctgggcgtcgccgggggcgttctccccgggcgtcgcggcggacaccgtctacgccggccgccccaacaggctcttcaccgtgcacgagtgcggcatcgaggccgaccgcccgctgacggtcgtgctccacacgcacggcctcgtgagcgggctgacgcggcatgccgtgttcgagagcgacgacggcgaggacctgaaccccatgggcatcgtcgagaccgtctccagctacgtcgccagcgaccgcggcggcgcggcgcgcccgaccatgtatgtcgccagccatgcccgccgcggccgtggccgtggcgtgtagttcggctgataactgtggcggtgatgactgatgaggaattcgctctggaatttcctcctgaaataataaaaatagtggttggttcttcctgaaaaaatggcatgctgcgttcgtggtttctgtgaaaaaaaaaaagttccgtatgtcggtatgtgctggatagagtaatcaggtatactgatgatgatcatgatgagtaacagcagcagaaacgttacctgaaaccaggtcgccgtttgcagaaaagcaggaccagcgatcagtagtcttaccgcatagagaatgcaggtttacagggcaccggtgagttcccaactcacgcgcacgtttttcaaactattaaatggtattttttttaaaaaaaaatttatgcaaaagttgctttagaaaattatgttaatccattttttaaaaaaatagtaaatacttaattaatcataagaaaatgtgtcgctccgttttgcgtgcgaactcacctccccaacacagccatagaatgcacggtatgtgcaaataggaagcaaatgataagttctttgtgaagacattatattacacctcaattatgataaatgtcacggaggtactcatatgtggtaagtaaagcaggactaaggatcaaaaacaagatgagtccagaactgcctcaaattaacttgagtgtacatagatactcagatacaggctttcaggtctccactgtgatcccggtggccttcataagatgtttagaaacagagtaatatagcagcattcactcgaacaagtattcgttaaccgaaacctacataaacatgtttgggtctcatatatcatttcaacatggtaatttgacaatgaaagctaaactagttacagatcctcaacatcctgcttggatgatgtagggcgaccttgatactccagttttgtacctaaacttgctgtgataaccctgaatttcagtcttatcttctccattatatcttgaacttgctcgtcttctgggttcgacaacggatagcttctcaacagtgcagctagttgctcaatgtttttcctgacccgagctgagaatgcatcttgatcaattgaaaccaacgacgtccaaacatccagacatccctgataaaaacctagttcttcacctacctgaaaaccattctttaaaccaacctgccttccctcttcttttccagacaccaagccctcactataaccattcttgaaacccgtttgatagtgtgtctcatctaagagtactgatggttcaaggaaatcaaaatcatccttaggtttctgatccatggtattaataagaacctaaagatgttgcagtaaacagttccttagagagggattccaaaaggttgctcagtaagaaaatgtatgcatacctaaatgcaacaagacaaaaatattaatatcaaagaaacgagagatggaaaagtgcaaacagaacttctgctgagttatgaacaaaaatgtgttgcacgtcaaacaaagcaaaacaaaaaaatgatgattcactaaactacgtactctagacgtttgaaactttacaatttttttatgggtatatctaacattaacgtcatgttccacttcatcaagtaagagaaattaggatgtcaccattactattgactttttcttttgaaaaaggttatattgactattgaatgcagtgcgagccaaactgtatgatgtcaaatgttatgacttcaacaagcagagtcatacaacctcacacaaaaataagcactacacaactcattcgaaccatcataaatcccttgcgtagttgtgttggattaacgccaaggttggacagaagataaacaaggtggtagctattcaaacaaagtggtagctaaccttcaggattcaggaataaggatacactatattctagtaatattcaaaacttccagctcctaagtttcctaagcagcacgatcacatttttttggtagaaataccctatattaggctattactattagctttcaatataagctaggatcaacacttattatttaaaagaacaccatgatcactaaagcatagcattaattaagtcttcatcatacctctaaaccttcaattagtatgatattctaaggattgaaatgcccaaaaaggaaataaaaaaaaaggaagataaaacctacgtttctccagctttacagaacagtaagtttccccaaatctcgcttctatctttacgatgctcttggcttctactactaccaaacaaacaaaccaaaacaagatgtaggaaagccataatcacgctagatgtcacaactactcgagaattgaaagcagtcaagctgaattaggagtcatgatttcagttaccctttgctcactaaaaacaaaaaaaacaaaaaaaaagttaccctttgctcagttgctcccggaagaaggcgtcagtttccgcgatacttctggaacacgccgctgcagttggagtccttagccaccgcgctttccgccgcctactcagggcagaggcgaaggccgctgatagcaacggaactgcgctttccccggtctccgccggcgaaagaggcggggcgccgcacggcccctccgccggtggaccaggcgaggcgccgcagctggcggggggacgacgcggtggcgcggccgctgggcgccgccgctacgaccggaggaggaaggagggtaggagactcacgtgtgtggcggcggctccagcccagtgacctctagatgaagcttttgggtctgatttagttgatgatgggcttttttgggccatggagtttctcgacgtcagccttgtagaagttgataaatgggctaaagcccatatagatttggtggttgggctgcaatcacggttcgcgcgactcgagctctcgaatggccttcgtcttcgtcttctccggttctctttcccttccccatcctcctccccattgcgctgggtaggattccaatgtgggggactagggtttagggtttggagtcaatcccagaccgcgcccatgacgtcctcgtctcgagtaagttgcgttctgtattatcttcctctctctctctctctctctctccgcgcgtgcgattttttttgggggtgtggttttggcgatgatatgcgcgtgcgattttttctccccgggtgggtttggggatgggaggcgtgattagaatcagcgaatcgcttcagtgcattgcgctgtattctgatcagtgtttttccataggagatttaagattttgttgttgagctgatgtgtgaaaactggtgtattgcttaggtaagggttggcaatctagtccccctcaatgaaggaaatgcgagctcgtcaaatggatcggtgtcaagcattcctatctatctgggtgccaatgttgtagggaggaatcatttggtggtcgtcgacaagagagtcagccgcaagcatctgagcctacatgcctcggcggatggttccattgaagcggtagtggtgagtgtgataaggcatggggatattccaattaactgcgcagtattgttctgatggcttttttttcagaaaataacttgttgttcattggcattggatgtgcaggaaggaccaaatcctatcattgttcgatctgagggccagaggaggaaggtctgtgctcaagagagagtaaagattgcacatgatgatgtcctggaactcatccctggtgaatattttgtgaagtatttgaatgtgggcgataaccataaaagttccacatcaatgggttcaagtgattttaaaaaggggaagaggctctgtgaggatgatactgtagttatcaaaagaaatcgtcagattatggaagatgaggctttggcaagaagtttacaggtaacttaagtacttaacctttctagttgcactgcctgtattgtgcagtttgtttaacttagaagagagcaatccatggttttccgtgtatcatatttccgtttagtctgatcatggcttaatctgggcaatgctgtagttttaatataacataaatgatcctagtgctggacatagaatacttagggcacgtttggatctaaggctagcattagcctagcctggcctggcaaggcccagcgtttggaaccataaatatatcgcagcttctgggggcaagctagccctacgggcaaggaaaagctcgctcgcagtggagagccaattcggctctccttcgacgacaaacttctctttagactaactaactgcccgtcaaaaactaaacaaccaaacaactcagtaaagcaagcctagcaacgcagcaacaacctggtttgcctagctgggctatagctcaaggtgacaaacaaccaaacatacccttaaagaatgcctttaaaagaagggattttccagtgtatattctgataactttatcgtggataaactaatttaaattatgtcagacaattgtttatgaaattgatcagtggctatctttatatatttctggtaggaaaataaagtctttacgtcttaattcatagactccaggctgtgacactgaaagatcctgattcataaatataccactgaaagatcctggtacacttaaataccatccaaaggtgcaagcgtttagaaatgtacttatctgtggtgaatatttatcaaatagtatctaagtattggatgtttggatttgctttctgaaactcagcattggatatgctatccttgtatgcttctgttgtttagtgttggcatattttatattttgcattgtaaaaaatggtgccccttagcttgctgaatattagtttagctgtatgttttctttccttgtgtaaaattaccagtatactattgaattgtagtatagtacattaccatcttagtttcattactatttcctgtcctattccagaaaagctttgcagaagaaagttcaactatttccggtttgggttgtgatcaaatgttaagttcacttgatagtgctggtttttctgagagaaataacgagagaatacactctgttgattatctgaaagatgtactttcattgacttttcggctcatgcgtgtccaaggtcttccttcatggactaatacttcctcagttaccattcaagatgtcatacaggtatcatccatttaacaggagctcttgcggaagttatgtggttgatttcgtttaacatggcgtgccacaacatcttttagatatgatctgttcaggacacaaatgttgcataagaacaaatttcttagcctgctcatcattaccaacatatttgttcaaaaagaaaatcattaccaacacaaactcttgctcatataccatttgtgatttatcactatatagcctcaactcatgtagtctgctgtttgaaagatggaattgttctctagttggaccttgtaaagatttctgtctatattgtcaatggtatcgtgtatggtgggggagcaaaggctagttcttattctgctgatctgttcagttttcagggatactgtgttgcatatcatttcccaaccatttctctaaaacaaatgttctcttatgttcacactctattcatgcattgccagattcatcaaagaagtatactagttcttacatgatgaatgaattattagggtgaagtgcttcttgctgtactctcaaattatatggtggacatggaatggctgcttacaggtgggttattgtggtggaaatcatacaagtaatattgtttgtccttgtatgagggctgcttcctttttaccataagtagtgaccttttttgcaaacaaaataaatttggcgcctctgccactttacagtttcagaagtcagaacactcaatcatgaaaccaactacgatcctgtgctatttatatttgtctgctccttttaattttttttgtactgcacaattaatactaaattctacgtgcttgttggtaagaggaaaagcagtcctttctttgttgctgaaagtaatctgccacatttttttcattgaataagcatttagtttctgccatcctggtagctttcccctcaatgttttgtttgctgtaactattcattggtataattctttttgaagtgaaagtagctgctggtaacaacctaactcatctcatattcttcattactgataaattgatgtaactatattggtcactctctattggtttctagaatcatagtcatttatgttattgatttacctaaattgtttcctgtgcaataattttggaagctcatctttctgagcctctatggctaggattacaatttgtatgtttactagttaattgtaaagcataatatatttgtggaataaaaaaactggactacaaagataagcaaaacatgtacttttggccttttattttgctatttttgattatgattctcatttgtcttctattttccactacttcatgtatctttttgttgacatgcacttagttatgaaatgtatgtatttactaaggagtttggcaaccagcgcccatctgtgttccctatgctatgtggtgaaatatcactgtgctttcttttccagtcattgccattatctacatcctttagttttaatgtaaataacattgcactgtgcagcatgtccaagcttaaggaaagttcgacatgtcctagttatacatggagaagatggtgcatcagtggagcttctgaaggtgacaacattactagagtaattcatgatatttttgtatttcctttttctcatctcatattcatggttgggtgacagaaagtgaagccagccaattggatccttcacaagcctccacttccaatttcatttggaacacatcattcaaaggccatgctgcttgtatatcctcaagggattcgtgttgttgtgcacacagcaaatttgatacatgtcgactggaataacaaaactcaggggctatggatgcaagattttccctggaaagatgcaaaagatgtgaatagaagtgtttcctttgaaaacgatttggttgattatctgagtgcaattaaggtagcagctagcagggcacttgtctttgcttcttgattaacgtatcactccaattgtgtttcacttttttagaaaagaagttaaatgttgttttcttactgatatattttaaattatcatcataatgtgttttgccggaggttaccagaataaaaattaacaaataactgtgcacttctcgaacaatcacagttaacactggcaacttctgtttctactcttctgctactcaataaaaagaaatcatattaaatactactgaattggttcacaaggggatccactgttctcatgttagtaaaacactgaattggtaaaatatgcatatcatgattttgttagagagagatcttggaattgctggcaacatgttgcaaacttatagtaagacagtagctgtctcattgctaaaagcaatgagccatgttaaagaataccttaaaataagtataatgaaagtttcagcaaatcacaaaacatggtcttattttctgtggaacattgtacagagttctgtaataagtacctctaaattggagtgaatgaaaataggatgtctcgggctgtctagcttcgaaaagccccagttcattctaactattacttttgttctagtttaattccctaccgttgcagtgtactaaacacatcttctctatgtatgttgtaatgtattattctcttcatgacaatgcagtggcctgagttcagggtaaatttaccagtggttggtgatgtcaacatcaatgcagcattctttaggaagtttgattataagagctcatcggttagtataatccattaatcttagtttacacttagtgtgcagtgctcagctgtaaacatctcgttttttttttctccatgcaataggctgacatgaaaaagaaaaaaaattgaagtccgctttgcatgataaatgctggcaattacttaatcacgtgatcactgatttatgcttgtgcctccgccgtaaataggctgctttatgcaaaagttcccttttcttcaataaatgaacagatttcatcatcttttagcactgtttttattgcttgtcctacaaagtatttactgttctgaaggattttcagttcacaagaaaccattctattgctccttttgttatccattttaaaatcttatgttggaccttaccagtttggttgcatttgaaattaatctatgcattttttttctgcaccttctgtattgcgtgtttagtgataaagtccacatatgccactgaaaacttgcccaatcctcctattgtcagtaagacatcaatggcaaataaggaatgaagtgatatttaaagcgaaaaatgaggaattgcctcatcattttggcccttgatctttctctccctgttggatgcacaaaaactaaataaactgtacatggaagctcagcagcactcgcaaaaggtctattagttttacatagaagcaaacatactagcacacacaccagttctcctctctcgtgtattcataatttagtctcagctgattttacatcttataggtcaggttgattggatccgttcctggttatcatgttggccccaatattaaaaagtggggtcatatgaagcttaggagtgttcttgaagggtgcacatttgaacaacagttttgcaaggctcccatgatttatcaggtatctttgaatgtgtgagttatttatccatttatcttagcatttagcacaggcaacttttcgaagtgatgtagtgaatgccttaataaccctgttaaggttgaagcagaaatgcttaagattgagaaacaaaaatcacatggtgcctagtttaccttaggaaagaccttctagtaccttaaccctgcactttgtagcacactaatgccattaatagaagctgtaaaaaaatttgcactaatggtcaaaggaatatgtacttagttaatagctgtttcttgttttgtattgcaagaatgagcgagactataaggagtgcgggatatgttatattgtcacctgcatcatcacggattaattggacttaaaatctggcattcatctcccctttctgtttcactgaaagtttatattgtaattttttactcgcctattacttcccaggcttgttctccttaaaggacatttagcattttaattctcttgtatgcagttctcttccttggggtcacttgatgagaaatggatgagtgagtttgcattctcactatcagctggtaaatcagataatggttcacctttgggtattggtaaaccactgattgtctggcctacagtggaggatgttaggacatcaatagaggtataaacctaacatctgtaaaaattctctaatcatacttcctgtatattgcatcgtaaaacacacgagcatgaaagctccttgtgctttcttgatctgttgagaaccttcttcagatatgatgtcctatgatagatcagtgctggccccaaaataacaaaaaagaagtataaaccgattgtgttccctctcaaaatcagcatgttccatgacctgaattttttctaatccttttacccgagtactagtatcaccgcttatctgattttcttttatgtcaaatgtttcttatgtagggttatgcagctggtagttgcattccaagccctcaaaagaatgttgaaaaagatttcttgaggaagtattgggccaggtggaaagcggaccatgtgggtcgttggtatgttccctgattccttcaattatctaacaagctattgtcttgttcaaatggaacttcctaatggttaccttgcccgtatggtgctgcatatcacaagaaattgtttggtgatgtttctttaatcacgacagccatgtttggaggaacggtcatttgtgaccaaacattaaattgataggttggtgctgttcaaccttaattatgtgtccatgtgtaggatcaaggactagagagagagggggaggggtgaataggcgatttttaaaataaatgatacctaatcaaaactaacctaagttgctaggtttggttaggaagaagtctaaccaagcaactagattaagttttgcaatcctagggtgataagggctcaaaaaatctgtataaaagtaaattacacaaatgtaaatgcaataagtaaatagaacaagagacaaggtgtttttcaccgaggtccggaaactcgctggtttcctaatccctgttgaggtgagccctacttcaccgctcaaaccacaaaacctcgatcactagggtagttccttcgctctgaaggaggtgaattttgaaccactcacacccaacaccgggtcttcttcacaaccttttcggagagcccaccggacaacttcttcaagccgtttagaggtgtcaacctccaagagtaacaagtagcaaccaaactcgtagatgatcaagtgggacactagctcaatcgatgatgcaatgcacttgacttcgctcaaactattctcaacaccccaaaaggatgaagaagtgctcaagtgggtgagagtgaatgcaagaggttatacacatgaacaatgtgccaagaaaaccttcttgctgttggtgggg

SEQ ID NO: 1425 - DNA, 22767 bp, Oryza sativa
  unsure (1)..(22767): unsure at all n locations
atattttatagtattcctgagcatattaagttgatcgatggatatttgttatagcttgcaaaggttgccatccctgccataccaaatctgtaatattttgatcctttttagagtgtttattactttatcactgacttggactgacattctgatttgggttttcttaccagtcgtgcgatgcctcacataaaaacttttactcgatacaatggtcaagacattgcgtaagcatccatataaactgttttgaactctagaattaataacagtatttccattgaatcattgtctggaatctttgtatatcctcatcagatggtttctactaacctcggcaaatttaagcaaagctgcttggggtgcgttgcagaagaataatacacaactgatgatacgctcatatgaggtggatgattttgttccattgttgaattgaggaaattttctgaacatccagacttttacaggaaaactgctctgcaacatagtgttggtcatcatggaatcgtagcttataccttgccatttgatctcttttcagttaggtgtactgttcttgcccaaaactcaccaatctgtaccacaattttcatgtacggggaagaacaattcaaacctggtactatctaatttctccttccttttgtattataataatgtgatcactttgcttttttttttcatcattttaagttccttacccagaataacctggcccctgggaaagagatcaaaaccaaactggtcacactctgctggaaaagcgacgaagaaaaagaacaatccacggaaattatcagattgccagtgccatatcaacttcctccaaagccttacggcacagaaggtgagctggattaatttaacgattgatacaacttcagtggagtaacaatagtaaaacacttagaaatgttttttttactttcagatgtcccatggtcttgggacaagaggtacacaaagaaggacgtgtatggttcagtctggccgcgccatggttagctaagcggtatgcggacaatatatgatcaatgaaaggctaaccctgctccgatgtcgacaacaagaaggccggtagctgatcgcctgtcagtgcccactactcaaccattagcaggaagtagtactatttcctgggagagattagatatttctattactaatttgtacgagcacaggatattttctttcttgttggtacgaatcgtgtgccttgtctgcttccgatcgtgatgtttatgcctccatcctcttttacagagtagtactcctacagtccgtcgtcatccagcgatagcgatctgaaattttaacgtgcaaaggacgctacctaaaccagctttttccagaaatcccccgtgcttgttcttgcggctgtccttgccttgagccgctccatgaaagcagcaaattagtggtactgcgtaaaagaataggggcaattgactcgacgatctcgcttccgtcgtcctgttgtgatcctagacgagaatcgtcgtcggtgatcgatcgggtgatgcgaagcgttcgtccaaatcacggtgattcaatcaccaacccgccgtatgaacgaccacgagcacgggggtgtgcgacgcttccctcggccgcatccgccaaagggtaaacgccggcaccaccacccaccaagcgacacggggcgcgcgcgcaccgcatgaatcgcgtggtacgtacgtacgcccccatcccaccaacgggccaccacgcgacacgagacggcaccacgggttccgccccccgccgaccccttgcaccaagagcccacgtaccgcaccgcgcaccggtgccggtgcgtgctcgcttttgcctccctccgcgagccgggcgcgccacgcgacgcgcgcgcgcacacgtcgcacgccgtctcgacgtctcgctcgctagtcgctacccgcgtccgccccacgcaacgcaaggagtgaaagaacgcgatgccgcccgcccgcccgccgccacgtgaacgcgcggcgcccctatcaatccgcgggcggcggggtccgcgcgctcgcgggggccccgcgtggcggtggtggtgggtgggtgggtgtcaccgtcgcgaatctcgaatccgcgaaccgcgagtccgggggggaatcgggtccgtccatccatccctcccagtcgcgtctcgcgagtcgcgacggcttcgctctctcacctcctcggccaaggtgggccccgcctagtggctgctcgtatcgattcccggatacgggagatcgacgatgctccgctatgcgccgttgccgtttgggattgattgattgattaatataattaattttggtttaatcacgtacgtttcgtcgtaatcccggcatagaccgcgtctgatgctgcgggttggaatgaccattagcgtaggtcggtcgtctggtccggattctctgcaagtagcgggcacgtagtatgccttcattcctttaggaagaatcgtgtcaccatttcctcgtaatttttttctccatccgtctccgtcctaaaagaatgtagtagttagttttagttagttaagcaacatttcattaattaatacaaagagaatgaaggaaggaattactacttcttcgatgacaaaagagaaaaaatatgaagtattttctatgcaataattatagctattttttttattacgaaatagaggcatgttcgtacctagagagatctaatgggctctacttcaaaatacaaacaaatttttaaatatgttcatacacaatgtcctattttattttgttagagtatttaagaattctattataggtgtggtctaatatgaatttaattttaaagttaattggatccatatgccattgtactttgctaaattgaaaaaataccactactattcacaatatcggctaggtggcatcgatattttgtaaaatttgaaacagaccattatataaatcccaaacacagttgtaccaagttttttatattgtattttcatacttaccagaatgctccctatcccttagaggctgacaaggaggacccacacgttaaacttatcttcttccccgattattcctctagcttgacgattccgcctacaacaacaacagtggtgaagggccggcactagagcttaccagcgacgacgtccccgcacctggcttcccgatggtgtggtagatcctgcaacggtgtgcttgagcttgagcgtagattgcagccccagaggcgaacagcaacatctagattgtggcagcgagcaatagtagccccagtggcggcggtcggtcctcgtctcattatcgtcggtgagtcccagcaccgacccattcaccacatcactgccatggagttcgagggagttggcagcattcctcgtgtgaaaaccccatcgctagcctctcgacagcgtggcggcaaggtcaatgcaggcgggctagattggggcggtgaggagcagtagtagaagcaaccccagtggcggtgatcgtttctcgtgtcgctgtcatcgacaagccccaacgttgacctctccaccactgacaccaccttcaacctctccaccactatcgccactgccactctactcccgtcagtcttgctgtactagtggaagtgttagggaagaagataaggttgacatgtgggtcccactagttagcctataaggttttgggggcattttggtttatacgaaaatacggtatgaaaaaatcaagtccaactacgtccgggccgtatatagtggtatattttctcttacaatttcagaaattaaaatttttacaaaatataccaatggcacacgaccaatatcaacggatagtagtgatattttttcaattcaacaaatttgcaatggcatggattatagtaaccataattttaatttgtgctcatcagttcaatattgcttttttactttgtgcctcacacaagctatcttctctctggccatcactaacaataggggtgaaaacggtacggaaacggacgaaaacaacttttatcattttcgttttcatttttttttctgaatcggaatcagaaaccccggatatgaaaacggaatcgaatattatcgaaaccgaaaacggagcaaaaacgaaccggcgcgaatacggtatggaaatttatcggaatacaaaaacccctcaaactgataaatctaattctcaagtctcaacggtcaacaattcatcataaaacacaaattatataagttcaattgttaagtctcaacagtacatcacaaaacacaatgtatgaaataaattatctatgtttaagagagtaatgctgttgataaatcccaatgcgggaaaaaaaattcttatgtaacttcagatttgcataacaaatattttttaaaaataacatccaaacaccatggtattcactgttcagtgctaaaaaaaagaacccagggtatttcaatcataaaatttctagaagtttcgagaaaattccaaccgacagatttcattttcaaaaataggtccggaatccgaaaagtttccgcaccgtttttaccccctaactaacaatatagggaacgtgtgctaaatataaaataagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgagtaaaaaaaatctttctagctgaactcaatgggtaaagagagagatttttttttaaaaaaatagaatgaagatattctgaacgtatcggcaaagatttaaacatataattatataattttatagtttgtgcattcgtcatatcgcacgtcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaaccagcgacacatctctaatatcactcgcctatttaatacatttaggtagcaatatcggaattcaagcactccaccatcaccagaccacttttaataatatctaaaatacaaaaaataattttacagaatagcatgaaaagtatgaaacgaactatttaggtttttcacataaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttgaatttattgttctaggttgtgtagtacgggccttgatgttaggaaaggggatctgtatctgtgatgattcctgttcttggatttgggatagaggggttcttgatgttgcatgttatcggttcggtttgattagtagtatggttttcaatcgtctggagagctctacggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagtttataggtaatacccctatagtttagtcaggagaagaacttatccgatttctgatctccattttaattatatgaaatgaactgtagcataagcagtattcatttggattattttttttattagctctcaccccttcattattctgagctgaaagtctggtatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttcatgtctgatctcgacattcagatcccaactgccttcggtatgcatgttgttctcttccctctttgtgatggtctgagtgcctggaatatttgtgctcatcatgttttcctgaacatgtacagatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtgtgtgtaataaccgaaatttgtggtgcctgatctttacgtttttctatctttctgagctagtttttctgatcaatgcttcactctgtaggtcattcaacttcagggtgatcagaggaagaacgtatcaaattttcttgttcaggtagggatcattcttcttgtgcatgcttactgcaattagatgtacacatgctgtgatgtatgaaaagaatacgtcttgacttgttgtaacatgctatgtcccgcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttatccgtgtgttgaagtttgtaagaggcaccatcactatagatgatggcttgtgtccctctttcatcaagattgaataatatatgctactttgagagcgctatcctgcttgcctgattgtgttaatacttacatccgtcccacactcccacaatataaggaaataaggtattttggcagtttagagcaaaattcccttatatttttgggacggatgtcctcttttctgcatttttttatgttcatatgttcctgaagagtaaggtggatcttgatcaacctgtcggtttatggtgattgatttgagtggaatagaatgggccaacgtccggcatacagttatgcttcagctagctccaggagttgtggttttagattgctcattttctcattctttttcatggacgatagctgaactgctgaagtagtgaagtcggcatgcactggctactgtatatgtatggcaattgatactagtagtattgtcagctgaagctgcatgccttctactgtggagtactagctgttgatccaaactccagaccgtgaactgtttgttttttcattactgctgggtacggtacactagcttcattctgtgcatgagtcattctccggcatgtctgcaggacatctcatgatacttctggcacttcaacagtgatatttccagagtactgcaatgagtttattcttatggttatgtacagtactcgtgctagtaatagtgtattgtacgaaatgaatatgggtagtactagtagttacaggattcacaaagctgggtaagttagaaatgaacatgggtagtactagtagatcacaaaggttcaggattcagaaagttggatctgattctcgaagccttcagtgcttctacgtcgccttcatcagtcagcatgtatgtgtaccatcttttttgagtgatttcttcccccaagtttcaacaaacaaaatgatgttacgaccagaccatcaaggttgagaaatcaaatgcaatcttgtcccctgttcagtcagacgtgcacgtagtacatcacagcatttttcagtcccgaattcgctcatcctgctgctacaggtggtcaaacagtatagttcaacttcagactttcgtggtgcttcttctctgtcaatgtgtacaacctattgctcatgatgtgttcagatagataagattatagtgcaagatgttgccgtggaatccttgcaggtgcgtgcagtgacttgaacatgggctgcatgtgttcctgcccctgaaatacggtgagatcgatttggttaagataatcagtgttcctaaccacgtactgtagtagccgttaacgttgtcagccaattatcaaatacgctgggacatctctctgcatgacctggtgaccatcagagtagtcagtgcctcattgtgcttgtaattgatctactactagtattctcttcaaaataaactgcgaatcaaaccccaacatattcttttcttcagtaaaccccagacaaattttcatgccaggataaaatccttgtcacacgaaaacaaaaccaaaaatatgtagcttatgtctctgttagaacaacacgagatcactggagagtggagattatggccctccacggtcattcctgccgttgaaacggcgcacaatctttttggatgcttctttctttccccctctccatcttttctttttctcacacacatgcagatgcccacagatcgctcatcacttcatcagcagtagtaaccttttccttttgctatctccctttttcttccaattcgtgctcgccaaacgaaaggaacatctcgtcacattttccttttttcaagaacaatctcgtcacatcatgatgcattttccagcctatcctcaccttcatcacccagatctgtggcaggagagaaacattatttttttctctgacatccatgcctaacgagatgtgagatctggacgcatgtttcgcccatatgcctctgtactgtagtacatcttctgatcttcatcttggctgtcatctcgccattggatcaccactaaaattacccccacactaacacatgctttacaacgtcatttgtcaggctagtactacgatgcgtgtacactgaaagcagcaaaggaaaaaaaataattttatccatttcatcatccaaaaagaatatggtttccaacgtgacagccactctacgtggcccaatccaaaaatagtagtactgtagtagttacagtgaatctgagccgcacgatcgaaggacgatccgatcctggccgcacatcgtacggccatgtacgtcggcggcggcgccggcgatggcctcacgagctggtcgtccggagcaagcattcctccggcggggaggggaaccgcttgcggtcgtcgcagtagtcgtagatgacgaggttcctcgccacccaggcggagtcctcgcgctggccggcgtcgagcgcccacgccggcggctggtcccaccagctgttgccggtggacgccgcgcagctgggcgggctcgccgccgccgtgccccaggagcacgcgtcggcggtgaagtcgcggtaggaggagatgaacggcgccttggtccagtccgtcttctccagcccgccgcgcgtcgcccagtcgtcggcgttccagatgctggagaacacgtacatcggcttcatgatcgggaagaaggtgttgggcttgtccgagttccggtactcgcggatcggcaccttgtccacgaagaacctgatgatcaatcaccaccaccattgcaaagaacatcagaaatcgagattaattgacagaaaatggatttgggtgggcacggcacggggaagacgaaggtggtggcatggcattggcagccattgcttggtcctaaacagaatgtgtccaagtagcagcaacctggagtgctcgtacaagcggcagggtttggcaatatctgcaggttcaattaatcgccatcggagcgacccatttcaaggggtaggtaggtaggtgggcgcattcaactcgtagtcgtcgtcgtcgttgacggcggcggcggcggatgctatctccggcgagcccggatggccacggagtacgattgaaacaactagaagcttgattactattgttcggttgatcacttacacgatctgcttggggttccagaggatggagtaggagtggaagtcggcggtggggtcgaaccacagcgagtggcgcatctcccggccgccgacgccgctgcggtacacgttggtctggatgatgtagggctcacccgtccggttccccaggaactcgaagtccagctcgtcgcgctgcggcgccgcgtccacgtcggagcacatctgcagattacgccgtcgtcgaggagctcggtttcagtttcagttcggagttgacacaaagaagacgagctagctagttcatcgtacgtacgtagtaggcggtgacgacgccggcggagtcgttgccggcgagcttgaggttcatgctgaaccacccgaagagatacctctccttcgtctggaacccgacgcctgaaacacaaacccaagaaacagggcagcgtcagcattagccattgccggagtggagctcgaactactctcactcaccagtcttgttgtcgaggtagaggtaccacgtctggccgtcggcggaggtcttgacgtgatcctcggctccggtgatctcgaagttgtcgccgaacgtcggcgctgccgccgccgccgacgccccactgaagcagaaaccgcacacagcaacagcaaaaatcatcgccgccgtcaacccaccaacccacggccgccgccccagcgaccccatcctcgatcgtcctcgacacccgagccggccgagctcacgtagcagaggacagcgaggcagcagcagaggtcgatcgatagtgagagcagcacagagagacaagaggcgcaccaccgcgtagtattataggcgtgagagagatgtgaagtggctactgtactaaaaaagcctaaagaaagacacaagttggggcttgggcgcgccccggggttcacgaagcgtgtagtttttgccggctgtttccgtctcggcgcggcgcggcgtggtgcggtgaaaatcgcaccgttgctgctgctgctgccgcgcgcggccgcaccaagcccctctttttctatcgagaaacccagctgccttctccctttgtttatgcctttctccctttgtttatcgcgaccgttttttgagttggagcgatagtggattatattatggggagggagggcaacagttgttgtcactcatcagtcatcacgcatggtgttcgatcagatctggggcttggaccggtcagggtatctcatatatattctcatccgttttatccgctccgtggtggccgtcacatgaagttcgtcgcgtcgtgttgacgaggcacgttacatactcctgtcctacgagtgtactagtggatctgtggatggatcatggatggtggtggattaatggtgagatggtggtactagctagcagggcatgtgactgttgatgacttgatgcgagtgagaatgagcagtcagtcagtctgctgttgattgcgagagccgagaggagaggaaggggatcaagggaggattaaaggcggtgcaccgcccaaccaacctgccctctgtgcctctgccctctgccgcgagagaccgggtgacggaggaagtgagcacgaacaggaaacccctagtgcagattcgcagtaaaaaaaaagaccaccagatttacggcagttttggattgccaaaatttgccctaccaatatttggtagcctaaatagtacccaccatttgtttgtttagattgatgccaacattttagtaatacccatcccaaatttgatataaatctagaactttcttcactatgatatcacaatttagctatattttaatagcaaaccaaataagatgaatacaaatttattctaccaaataattggtagtgccaaaatttatatatgttttagcactaaaaaaattagtagggcactgatccaaacaagcccttatttatttcatgcattgatgactggaaggggccgtgtttgaaagttgaaaccacacgcatgtttgttcatcggacggccacttgctctcatgcatccggaccgttgatccgtgctcgtgtactacacgtttactcgtgctgtacttgtaagtcatcttttacagtacactggcaatgctgttagatttttcacgtcccgtttttatttaccccctttcttttggacgtctgtcctttttatccctttcttgaaaggcaaaagagatgctttcttgcaaattgcgtgggtcgtgtctggctgtaggacctcggccgacactcctgacgagggcgcaacgaataaaggagcatttgttgtcttctgcgtgtggtgcacagttgcagtgttgcacaagggagatatctcaagactcgaggggcagtaaaggaaaaaaaatgtttcagcaggagaaagaaaaaggacaactcatgtagacatctatctggtctgaatttttcaccaatatctacaaatagatcccaaaaagtttattgtagaaatggacattttctcgacaccgacatacgccgtggtacaacatgacaacgctaatgaaattgacacctatttgtaaaagaattcaataaaatctatttgtaattaaaaaaaattaaaaataggtcatcgacgccaatgtatattattggcgtcgatgacctatttcatattagtgacttaacttccactagagggcaaggggagatgttagaccacgtgccaataacgttggcgccatgaaaatggtccatttttaaaataagttttttgggtctatttattaaatcagtttttttaattggtcaaaaggtgaaaaatccagcctacctagtactagtacattgcaagtgtactgtttcttataccttctactgtgcagctgtagcacagtacactcttctttagataatggaaaaatatatataatgcaacctatacattagtacaaatctggaaactactgtacaattaaaaaaaaagggcatatgagatgtgtttacgttactatgagtaaactttttaccatgataacatggataaatatcatacgtacatttttagattttgcggtattttcaggtttgcacttaatttttttctcagaaaacatatttggtacagtgcgagtaaagcgcgggagggggggggggttcagaaacttgaatgaactgagagtacttcggccgtttgggcaaccatgatatcgccatacttttgtccctccgatttcaggtgtactacactctaatcatgggtcaaagcctttatttggcaactttgataaattgggcctatgatagatggctagctagatgcaaccaaaaccaaatgggctttggttctcagttcaaggctcaggtggatggacgttgggccagttgagaagttgtcatccaagggcccttcacacggtatgggctgtagttggatcacatcaactcatgggccatcacctatcggtagtttggtcttaactcagcccatctagtctacttcggccacaaaacaccaattcaatgtgacgtgtgatagttttgcggtaacgccgtaacaatatactaccttgctaagaatgaaaattttttactccagaaagaattttccatgagagatatttctcgaactaaaggaccacgcagccatggttgctggcttgctgcttgtctgttcttgtacagaggtgacaaaatggtatggtagggccaggaaactgttggtgtatgtgccaaaaacgaaaacgaattggaaaggaatcaatgatggagatatgcttttgtcaccaatatcaaatttcgaatagtctggaatatcccactagctccagacatgctgaggttgctctggctaacattgttgtgaaaatgaaaattgctataaccttattctaaacctgattagtgactgattaattccttttcctgaaactgataaatgtgtgatactaagaagggatttagcatcaattattgagagagagaagaaaatggtgagaaaaccactgttgagatctgagaaggactcgaaagcagggcagctggccagtggctttgctcttgatagctttctatatcgaccgttctcattagtgactgattaactggaccttttgtttttcgacatatttccagtgaatagaaatgctgaatgcctccagatattatgggttctggctagattttctatgagctgttgcattttcttggtcatgtggtcatgctgctgttctaaaacaaaacagagtttctcactctgtccagtgtccacatataaaaacatgcagccatcatattagcatcaacctgaccaacaaatataatggcactgaatcatttttatttcctcatcctttttattcattcctcccagagagacggatccatggaagttttcttgccctcatcaggcaagcagagcacacacacacggtggcagtggaagtgctatgaacaagacgctaatcaacatccagagctaaaacaaacaaggggatcaaagcaaatcccgaaaaaaaaaacacaggggaaagtccacatcttcttctcgtccccaacgcctccgtgtcaccaccacgtcttgcggatttttttttaccctgttctattcgctcaggcgtccacgatctcgccgtcgtccttcgacgccaggatcagctccgggtgcgccgccgccgccgccgccttcttgatcgtgccgtcgatggcgttcggccggccgagcgccttcagcgccaggtgcgccgccttctggccggagatcatcatggctccgaacgtcgggccctgcaacaacgaatttgttcaattccaagaacgggggagagattatggtgaagagtttgatgtttttttggtgcgtaccattctcggggcgccgtcgatctcggcgacctccatgccggtgacgatcatgccggggacgacctcgcgggtgaggcggacgatctcgtcctcggcggtgttcatgtcgagggcgcgcatgccgggcacggcgtcgatcatgccgatgtcctgcagccgcttgacgcccgtggcgccgaacggcccgtcgtggccgcaggagctcaccaccaccctggactccatcacgttggggtccatgcacgactgcgtgtcgtggttcatcgacaccagcgcccagttggtgaccacgccgccgacgcggccctccttgacgatgaggtcctcgacggcgacggcgttgaacagcttcacgttggggcgcgccaggaggcggctcatgacggtggaggtgaagagcgcggcgtgcttgatgacgacgtagtcctcctgctcgtcgtacgcgacgccgagctcgtcgaggaacaggtgcgccggcttgcgcaccaccatggcggagaacagctgcccgccgagccacgcgccgccgccgggggacaccgactgctcgatgacggcgacgctgacggaggggtccttggagagctcgtacgcgcaggagagccccgcggagccggcgccgacgacgacgacgtcggtgtcggcgtaggtgatcatgtcggtcatgtaccgccgggtcatctcgcgggacacgatggactccttgatggggctgaacctgatggcgttgaggtcgtaggggggagtggacgacgacgacgagatggagttgcagatggcgccgccggtgcgcggcgcgacggagacggtggggttgcgggcggcggcggggaggcgcgcgccagcgaaggaggtcttgaggaggctggacgcggtggtggccatggctgccatgcgagaggaggaggagatgagcttcttgctctgggatgaggagtgtgtgcgtgagtggatagagcgtgggttggcgggggtataagaagaagaggagagcgcaaatatctgggagtgccgtccacgtgtcagcagtatgggcctctgggtttcggattgattggaggagatattttcggaaggtttagtgagggtttttggactgtcttcaggagaacgggacaagtgctgctaagtcacggactcacgggaacagtggtgctgtgttcagtgacagtgtccgtgataccgtgacgactaaggctgtgtttgcaatcccacgttcccaacccctctccctcgttttccgcgcgcatactattcaaactagtaaacggtgtgttttttttaaaaagtttctatacaaaaattgcttaaaaatcatattgatccatttttgaaaaaaaaattagcaaatatttaattaatcacgtgctaatgaaccgctccgttttccgtgtggaaagtttagctcccaaacttcccatatcggaacacaacctaataatggtttttggtgatcgattttttttatggctacctgtagtgaggggtactagtggtggagcccgggtggtcactcgacctgtacaggagctggctttgtcgctgactgtaataacatatcgagaattttttagtctgaaagaaatccaccataatatgttgttgatatcgtctaatatcgagaagtgcggttttaacttcttgtcacgcgttggtaaacctaagtgtctgtccctaagaaaactatctttgccaacttcttgatggatcgccttgactgttttgttgcacgacagtcgttgggaacaaagctcatcttcacaaattacatggaggcatggggtatactagtggtaaaggttccgggggatgaaaaccttctagttttttgggtttgacgatcgcgagcggggatcgcactacatgtttttgttgagcaacaatcatcgtttatttgttgaagttgtcatatttaggtctttggacgtagatctaggtctaatttcatatgatagcggctatctctgtttatgatagtaattgttttcccgaaaaaagttgctttgttaatatatcctatcaatcaattgttttaatttctctttttttctaaataattcttttagaacttagttgtatttctctgttttttttcctacatctttgttcctaataaaagatgagaaacacccaggggtctttcggctagctccacaaggtggtgggctagacgacttgggttcgaagcctcaacccttctaattatttgatattaggttattctctaatattcgcgttcctaataaaagataatgatacactttcagggataaataatggatgttttctgatctggtatatatttttttcctctcgaactaatctgatataaacgaaaagagacaaagtcatttttatttgttttttatcattgcagacaagcttaaatgatctacctaatttgaaatgtctcacagatcaatatgcatgatattgattataattagaatgattttactacagggacagtgaatttcataacttgaggctagtagatggtagcttttcttgcactgaaaaatctctggtaaatatctgcaactgctccagctttgtccacatatcagacaagtgtcatatcgcctttcttcgagtgatttttctacatctttttcaagacagatatttgcatgtctgcaatcttcaaaactatgcagaatgaattgaggccgttgaagttcccatcatatctcgtcagcaaagcatacaacttgctgatagggaccatacgacgaatgaagaaattccaaatgctacactgctttcagttacattttcttaatttatatgatgattgcaattactactactactatctgggtaaaacaataattgtcatgaccttccgctgcagaagtgattgaggcccaattataatctagtaagacagtgcaaagccatctccattcagatttgtgccacacatttttgtccatccaattcctgaaagtgacactggatcagacaggctcttttctgaagaaagatcacgttatatggcctgttctcttttcctggttgtgatcatgtgatccttatatcatttctttgaagatgacccctgcattgtttactggcaaatggcaacatatagtgatgatatatttcttatgaaccacatacataggcacagaggtatgattttgacttcagatattttacagcgaagtagtctgagtgggtttaaattattttacttttcttttttggaaatatcaaacctgagaagtaaaaaaaacagagacgaagttaagttttgagtgaaaagcacagggaaaagaacttttttttcttttataaagagaactacattcaggggttgcaaggtttgttttaagggtaattttaccatccttgagaaaaatactgggtgataagtttgggtgataagttaaagtgagttcaaatttaccctttcccaacttctgctctttcgtttttatgcacacatttcttgaactagtaactatatgttttttaaaatcttctatatgaaaattactttaaaatattatattaatccattttaagtttttttttctaatacttgattatcatgcgcaccattccgtttagaatgcgtgaagaattagctcccaacccatgataacaaacattcttattgggtacttcgagttatcaaactttttagtgtcaaatttaggtatatcgaggcatttttctcaagtaccaaatttttttcttatattaagctcgaatgtgtatcatgaaaaaagcagagaaatgtttgcatcagtgtgagggagaagctcatcccgaacgggaatacatcacgatcaacagaagaaattggaatgcaaagtacaaactatagaagaagactgaattgtttctcagaagccgaaccttgttatgaccctgaaactggcaatcattccgggctgcacatccaaaggcatgaactttgaagtggttaatccattgattctgcttgcacttagtggctccatccgaggaaattcggatactacatccttttttacagaaggacttgtttgattaagggaaattaatttcacatcaatagacgtgaagtagatcccttttaaatcctcttctattcctttaggtagtgtttggttgcaagaatgggatgagatgggatagaatgaacccacttttaggggtgtttggttgagaggtgagtgggatgggatggtccttggagaggaatatttctctcagatccgggatgaaacggtccgccaaaatcggccggaccaatccatcccacttcgacggagcccacggcgttagctcccgtagcctcccgctcggctccgccgccgcctcatccgcgtcgacctccgcctccgcgactggccgtcacctcgtccgcgaccgcctccgcgaccgaccgccgccgctcgtcgtcagctcccacagcctcccgctcagctccgctgtggcaccgccccggctgcccgtccctcccccggcaccgttccctcccccagcgccgctccgtcctccttcgcctgctccctccacctcgcctcgcctccacgaccgggcgccgccttgtctgcgactgaccaccgtcgctcgtccgcgttcgcctccgcgactggccgtcgccttgtccgcgactggccgcccgtgctcgtctgcgcctcgtcgcctccgggaccggccgccactcgtatgcgcctcgcctccacgaccggtcgccgccttgtccgagaccgnctcccgggacgaccgccgtcgctagtacgagcgtcgcctngactttcctagnctncacgaccagtcgccggctagtccgcgaccgaccgacgncactcatccgcgcctcggctcacctcgcctncgcgaccggtcgncgacgctcgtacgcgcccgcctacgcatntnctncgctcacgccgacgagctcctccgtccccattctcaccactctctccaacctagccgttgggagcggacggacctaactgtccgtgaaacattgtccatcccatccgatctcaatcctttctaccaaacaaaaaactataaccatcccataccataaaccaaacacacaactagaaccattctatcctaaaaaactaggataggtctaacccatcccacttggtcaccaaaccaaacacacccggtggggggtaaatcaaccagacctacccagcctacaaggaaattcggatataagcctaaattttactacagaagaaattcttgggttcttcaagatagctgcacaacctgtatttcagtccttgcaaggagctatttgtcatatacttgtatagaaagcagggttgagaatatggttcacttggtgtaaatagcgcctacgagaacttgggcctaacaaaaagtgcaacagtttgtgtagcggttaattttggcccatggtagcggtccagatggtagctgtcctatttctatagagaaagtctatactcactcttgtccttaatcggatcgcttccctcaaccacaaaaccaggtataacgtcggagcttgctatctcgtgcgcgcaccaacaactaagctggcacgcgtgccggctggcggcccacgcccctcgcctacatgcgtttctttttttctttttttttttgcgattttctcctattttcaagcctcttatcctaggcgcgttttaatttctttcgtgttttttctaatttttttaatctgcaggcacacttgttttcaaatctttaagttgaaagattttaaattaagttgaaagttttggaatcttgacttgaaagttttccaatctaagctgaaagtttttaaatttcgagttgaaagttttcaaatccgagttgaaagtttcaaatttgagttgaaagtttttcaaatttcagatgaaaagttgaaagtttcaaatttgagttgaaattttttaaatttaagttgaaagttttcaaatcttaacttgaaagttttccaatctaagttgaaagttttcaaatttcgagttaaaagttttcaaatctaagttgaaagtttcaaatttcagttgaaatttttaacatttaagttgaaagttttcttgacttgaaagttttctaatccaaatcggaagttttcaaattttgaattgaaagtttccaaatctgagttgaaagtttcaaatttgacttgaaagttcaaatttcaagttgtaattttttaaaatttgactttacagtttcatattttaagttgaatttttaaatttcaggtatgttttaaagttttaatataaagttttaaatttgattttaatgtttctttcacgtgtagatttctttcagcctattagtaaaaaaatacttatagaaaaaagaaaaaaactaccttaaattttaggtttgtttttaattttcaatagaaagttttaaattttatttgaaagtttctttcatgtgtagatttctttcgatctgttagtaaaaaaactcccagacaaaaaaaaaacttaccttaaatatcatcaatatccaagactagacagagttagttacgagagttagttacagtagatgcgcgcgtctcccggaaaaaggaaaaagtccgattgcggattgggtgacatcgtgtgtgtgctacttctcttcccgacgtgtactcacggtacaagaattctgtgtaacgtctcccccaactcaaaaaaccggtgcaaaatcgattcctcgatggttcggtaagaggttgtgcggtgggcctcacctatcagttacactttttccccttaccccacctctccctctctcctctatcctcgcagacacagtagacgagataggctatagggaaagcggctgccgccgaggaacaccggcagtagagacgaaatggcgcatggaggaatacaggagggcagagaatgaaattttaaaatatgcactattttcctcgattttgtatatatatatatatgattttgaaaattttacagaaatatacatccgcatcaccgtgccgtcggcgcagctcgaagacgcgccgcagcgccaacacacgtgaccgggacggtcccgtgaggcccggcgccgcgtcggcccgttcctctgatgcacgtctgccagagcctggcagtggcgcagaactggcatgcactacgtgaatggtcagcgtagcacagtgatgcatatatagcatagtacagactgcattagcagcattaggaacaagagttttatttgattccgcttgaccattccgcggaaccgcgacctagtctgacgtttccacatcatgccgccgtcactcccggctgctaccacactaccacctgtgctcgggctggtggggacggcagtggtggtgatgagccggacgctcagtttttgttgtgactagggaagtaattaagtttttaaagcaatatcatccatgtatgtaaaggggtttcaagagcatcaaagctggaggacagaacattgt

SEQ ID NO: 1426 - DNA, 8195 bp, Oryza sativa
  unsure (1)..(8195): unsure at all n locations
aaataatcgtgtgagccaaaacacggcaagtataatgcagtttaaaatcaaaatcaacaagatttgtaacgccacaaaatcatgtatagcgcagataaaagcctgaattgaaatggacaattatatacccaatttggaggggcttctacaaatgcaagtaaacaacatacggacgccaaataagtcaaactgaaaatgctggtgagtactgttttttaataatttgaacaacctaatcgatgagtttgaaaagaaaaagggacagtcctgccaataacatgatttccatcatcacaaaatatttgttcagtgcattatagaataaaataggataggtggctaacgccaaactgaaaaatgctggtgtttagttgtgttctgctgctcttttatataatatgagcaacctaatcaaataagttaaaaagaaaaaaaaggactgtcctgccaattctatgatttccatcacaatctacggaaagatgatgtttgtttcttttgtgattgggagttggaatagaagtttgttagtgatgttgaatacatgttagaacaaaattagtaacctgcaaattgagctaaacatgctgacaaatcttatttgcagtagtggagtgctgagaaacagaaaagagcagacatgttcaagttggtcatctcatattgcacatcagaattgctagacaggtagtagagcaggacagactgataagagaaatactgtgatacatttcatacttatcctaaagacagatacggtgcatgcacaaaatgcaactgagtatctttggctgactttggcttttattacaattattacattgcatggttgttcaacgtatgacagatagatgaataaagattattgaaactatatggaagacatatatagtggttcaacctgtttcagatagatggatgaagactaaacatacaaagcaatacatatatatggaaatggttggtgagtacaaatgctatacaatgtacagttacttgttgctaataatggaaatatggagagtactaaatctagattaatatcattgattgaataaattttacttttgctaataataggaacagggagagtaattaataccttgattgaaaattttttgtttggccggataaacataacaagaccatatagacacctccatccaaatcaaatcatatccgagggattaccaagaacagtcaaaactgagcatatataattatatatgaatatacaccaaacaattatatctaaatcgtgagtttctcatggattatcacgaataaacatattatcagggaatatctcatggatcaccgcgaacaaacgcattatcatggaagatctcacggatcaccacgaataaacacacaatcaggtaaaatctcatggatcaccatgaacaaaaaaaacatcatcaggtaaaatcaaagcacacatctcttgggttaccacgaactacacacacatcaggtgacgatggacgagcaatcaccacgaattatcaatcgtctcagcaaacgatcaaaatagttatagggttttagagagggtcaagaacctagggctgggtttgcgtagtatatttaaagaaagaaaatgaatgtaaattcgttgttttagatttgttttttgtttaataattttgggtttattatatattcgagtagtaacgagtaggcgtggtatatttatagaaggaaaatgagtagaagttcgtatgattggaaatggaagatagttttggaagcctctagaatccatatgtgatatttttttctctagatttttcctcacatatgattattagatattttttctctactataaatttatgatttttcttcaaagtaagaggcaccatgtgggccaattgaaagctagtaaaagagccagctgtagatgattagattgtcttataactggtcgatgaaccccctacgctcctcctaccttcattttaggcaatctactgctccctccgggttgataatattagtcgtttcggacaagggtaaagtcaaactttaaaatctttgactaccaaataatttgtaaaaatattttatctttataaaaatattgggggagnanaaacccaactttaaaatgtgggattagtcttaaaaagtacttcaacaaaatcatatatttattggatntatatnatatatatatatatatatatatatatatatataatgaaaatagttatcaaagctactttttggagaccttgctcttgtccaaaatgacaagtattatgatattatcaacctaaagggagtagaaaataagcgcgctagttggtgcgctcgatttatatcccatttatattatctttgtgttattaattagcacattgttcattaaaaaattatagaaatcaatttaatttccttgaaactcatacaaaaatcgtcaaattataataacagatcatattgttgagaaaatcgtcaaattttctcctttttttcaatccatactattaatttctttctttgtttttctaaaattataattaaattgtttactaatgataaaattggttttgttatcttttttaaaaaatatatgaagtgtttcagatttttgttttgttaggggccacaatgttcatcatttctttttatgacataacaatgctaagttaggtttaaatcataaacattgtatacgtgtttatattgatggctaattagtgataggtgagatatacgttgatgatgagttgcatgtgatgatttcgccgattttagaagaaaaagaagtcaattttaattcctgaactatttcaccatagcagttaacctcctaaattgtttttttttctcattttacaaacccgaactatcgaaaacatctcactttactctcctaacactatttctcttttttttatttctctatattgtaagtcatattttgcactctaatttggtataatatagatgcatttacaacataagtctcaacattgcttttaatttttttctcaccgtttatgtaggctaaaagtacataggactgatttaaacatcaaaatttaatgttcaagcaaacaaccacattttgaaaaatatttttgaactttgataatattctaatgtatgactctaacaaatttcagcttaaagtaagaaaactaaaaaatattgttaaggagtaaagtgaaccatcgttaacagtttaggaggtaacatgagcttaaaaaaatagattttttaatagtgtccattgatttagttcgaagaagtaaaatagttttttttcattttcagatatgctaactcaatttttcaaagatgctgagatatgtacgaaagtgagtagttgtatatgcaattatgcattcaacatttttttttgcaaatatactatacaatactaatgtactacctcagaacttatacatgtagagcatgtggactccattgacatataggcgtttgttgcttgcctgatcgatccttccagcatagccttttatctgcacggaaggactagcctgccacaaccatgttcttccctcgtactcttagaacgcacaactgctcaactcttggtattttttttttcttttggtgctcttcggccggatatatctgccgtgtgagagaggacacgtggacagatcactgctggcagaagcagccagcattagggcagtcccaatccatggtgtccataagtaatatctatgatgccatgtcaataagacttcacagtagaaactacactctacaacccatggtttcttaaagtgggtcattaataaatacatcatctctcttctctaccaatcatatttattcttcatctattatgaagatactattctctcccaatgtaaaacttgatagtgtctaatgcataggttctcgtgttgaagctgtgtcttacatgagacccagtttcttcctctcttcactctctctcttatttaatatagtgccacataaggtaaaagtcctacatggcaatgtagttaatactatagacaccatcctaggtggagagttgtgactgcccttagaaataaacactaaaaatgagcgtgttggcatgcttgctaagttagtttatagcccgcgtgtatttccctttagaaatcatatattcaaaaggattattgaaagtccttttttctatttttatgtttgtaaacaattaaagtagaatggtaaaatcatcctgattagtagtattatcatgctgaacaaatattgagaaatgacaaaatatgatatatattagtaaaaaaatcatgttttattaatattcaacacaattctcatatatatgtaagtcattgagtttgtattagtaggaaatacatatctaaaataaatgtgtcttcgactaccaatttcttcatactagttttatttagaaataatggatgacgatatggtaaaaacacttatcttgatttcatatatcaagatatattaatatgcatagctcaactggttagattctctacctatacgagttcaagttctaaacttagcatagatacttgcatttacggctatttgtttttttaatggtaggaaacccatgagtcttcatcaatcccaagatatgcctgacggctcagcatttggaggtgctcgtaatgattgggtttgtatgtgtgagtttacaagtgtgagtatacacggtatatgaacgtctatatctatactatatttcacaataaaaataatatagcacacgattggtgttacttaccgatgttccaaaataaatgaattcctagcataaaaaagtaaaatttgaggagaaaaaaaaccgaaatgctccaaattaattggaaagtagttgtaaacttatcggttcacaagaaaatttcacttctattctttccattatatagaaattcaggtattttcctcgtttgaagtgaaccttatctgaagatttttaattgtcctaacgcaaatccttgctgccactttttttttcatttgatttaactatttatttattttattcccttgaaacacatgatattaacatgaagtgactttccctcattccgagtaacatgtagtaaattacatttgttagtaaaatattattatggaaaggctaaaatcctattatttttatccttttctttttattcatactattttcttgtaaactggctctgtatatgcgcagcagcgcaggtacatagcggagaaaagccgtgcggcaccaggcccaagctcgcatggccttgcatctgcgcccttgcgagatgccaagcccaccctgcaagcacatgcaggtaaacgtttttccgatctctcgagaagtggcacgtggcaatttttttggagggatataaccaaatttataggaagctacgtggcccaatgagaagccagatccctgaccctgttttggtattaaagatttcctttgtgccttggttctgatccatgttagggtccggttctaatttttatgtttccaaaaccagaccgcggcacaagatatatagggtccaatccgttgtccggatgggaacaggtaagcgagtgaaacaataatcaacggatgccactagaaccatttaagtaggatgtgagagttcttctatttcttataaaatcttagctcatgttggagcctttgcagtttgcatgagctatatatggattgttcagaaattacatggcaagtccacatgaagaatatttttgggtgaagtgtacaagcggtttctaaacttgtgtcgatgtatcatctagattcttaaactttaaaaatacatttttaggttcttgaactttttatgggtgtcatataggtccaaatgcggactccaactcgcttcatgagctgacgtggtatgccacgtttgcgtttacgtgttagaaagatgccatgtcagtgcttacatgtggatctacatgttagtcatatagaaaaaataaattttaaaaagagacgagggagagaggggagaaaaaaaatatgtttttaattaaaaataaataaataaataaagatgggagaaaaaaaatgttcttatatttttctgtatgtaactgacatatgagttccactgacatatagggaccatcatatgaatatattttaagtgcttaaagaattatacgatgtatagaaactttatatatatatatatatatatatatatatatatatatatatatatatatataggatgactattttgtactcccgggagtacatactccctctcccatattggatcatccaataggatctgtagggacctcttgagccgtatgaaagagaaaaaaaaagttaaattcctatttttcagctgaacagtgaatttgccaagttgaaaaatatttaaattcaaaaaatatccacgcatgaaggcatttgatcgactccatctacaaatttgaaatagtagtatatgtgcatatactattttatttttttaatccagtatataccgattcatggttggtggactatataccatttttcttggaaatcagtatgtactgatccctgattggaagtatatacttgtttttccaggaaccggtatatactgatcccaatttgaaagagtatatactttttttattgaagaaccagtatatagaatgctagatggagaagtgtgtacttcttaattttaggattcagggtatactaatgctggttgaggagcacttattttacagtgtcaattagaaatttatggaacaggtaaatctcaactcatatactattttttccatttttaagtgcatgctatattcctcttgtggagtaccatatcagtatatactattttaatttttaagttattatcagtatatactgttttaatttttaagttattaagtttgttagacgtatatactgtttttctagttataagtagtatagatggtataccccttttagtttttagcagcatatactattttttcaagttattaagttttttagtttttagcagtatatactattttttaagttattaaggttgtagcagtatatactttttaagttagtaagtagtatatacttttttaagttatttagtggcagtatatatatacaagatgttttgttgtttttacactgtagcagcaaacacactactgcagctgcgtgcacgttcgatgatccatacgtatctgagttttcacaaaatacgaaaaggcaagatgtatttccaaaagaagaacaatctgactgacgcaaattaaagaagaactagtctgaatgacatgagaatatgaagaaaaagaagtgcttaaatgagctgttataatttagactcagattgaagcgtatgctgattaaaaataatgtaccaacgagaatcacaaagatctgtttcctgagaaatattccggattctcaatctactgctacagaaagattgactatcaacaaggcaacgacaatttctgaacaaagccattttctcattgcgccgtggtgttactctccgccgtccaccacctgcatgcaacaaataaattgagggcttagtcattgaactggttaattcattggaaataatgcatctatgaccccatctaccatcctaaaacataaataaacacgaacaatggaagaaaacgctcgatcagcaagaagaaaactcaaaataggaaggattacacagttgtctgggaatagatacgatcaatggatcaacacctcacctgggaaaatattgccgaacgccggcacgggcctctgctgacatctcgacaccgttgacgcacggccatgcgcacaggattgccgatagatgggctgttgtcgtcctccggcagacgcccgcggccgcgcacggtccatcgcctggacaggcatgctattgccgccactggtgaacgccggagcctcctgagtcgttgatggatcgcgccgccgtcgcctccccgatccaccgatttgctaataagcatcacccctgggaaagcgatattaatgcgagcagttcgggatggatccgattagtgcggcttgattaagtattacgagaaaacaaattttcgaaaaaaaacaaaacgggtttggaatctagacccgtcagcgggttcaatcggctggttaaggatggacggtggatgagagcaggtgtacgtacacctgggagtatagaagcattttcctatatatatatatatatatatatatatatatatatatatatatatat

SEQ ID NO: 1427 - DNA, 4955 bp, Oryza sativa
tgttcgtattaaaaaacctagaaaaaacataacatataaaatttttatatccgcacgtatacaaactttgcatcccatacatataaaaaatgaaaaccaaaaacccgtaagagaaaaaaaaaaggaaaaaaaaaaggaaaaaaacccacgcatgcgcggcgtgcgccgccctcctctccccgcgcaccacctgtccatctgcgtggagggagcgacgcgcggacgtccgccaattagcaaatcttttcccctttggccttcgagctttccccaatccccattagtcctgcatgattgcacccatgatgcttatacttgcccgtgcacgagggccatgttgagtagtgcccgcgctgggtggtttcacggaggcaattgtgtgtcttgcgcttccgtaattttacatatatccctatcgcaccatctccattaattcttccgtgttttgaagagtttaccatatcaatcttacttatggctccttgtcggtgataactgataaatctataaagaaataatagaaggttaaacaaactagaacaaagttacagatctccttctcatttacatatggcaaaaataatttataagggttttgtgggggctcacatgatccttacgctagtagtggattatcgagcccctgttgtcccatgaggatccgccatgctcctcgtcgttgctggtggcaatttgaggggaaaaaattggatgtgcctacttcacgctttaaatttcaataatgctatataaaatcaatatgcataagtaaataaattaaaatcaccagctaaatttgaaaaattaaatattaatagctcatttttttaataaatgatttatataaaccccgcttctacatcccaaaaatgtatatagccaaccaactccacacaggagcactaaggctcctcccgttacatgggtcacaaaacaaactaatagctcatatatggaagatcctatattaaggctacaaaactactactcgcccggcctatacgctgcaggttctcacatccataaaaatgaaagccactattattgttatgaaactattatctcctgctagagataaatataggctcataccaaatatatgaaaacgtatcataatagaactctttctattatgggtatatatattgagagatggtttgagaggttggttgatgtatccgcatatagttaatgcaataaagctgtgatgcccctccctatccgtgttcatctactatataattgtgtgcatgagatcgtcgtcttctactccggatcagcaaataggccactaattatttaacacgtatcagcacgagattgctcgtacgttaatccgggtaagtgttctaatagatcaattgatttcggtactaatcagattgatctacgtcgccggccaacacgaccgtctgtcggtttgtcgttccaatccgtttttggtattagattgatttctaatttacagattaatgcgctagtattttctgtttaatgtccggatgatggcgagcctcgtgatgcaaatcgccgggatggtacggtgtggttgctcaccatccgtgcaagccaccttgacaactggacgtcaggaacgacgccacttgaaccatctgcttcgtctggctggatggattacaggcacatgaaggcacccggcacaccggtgcgctgtcgccgtgcgggtcagtcggctgcggtagtacggcaccgcaaggctcagcatgcaggagaaagtaccgatgtggtgcactgtgcaaattggttttcgataccaatctgatgcatgcaaggaggattagattaacatgcatctacacgcatgcatgttgcatgcatacaactgatatatgcatatatccttatagtactgctactagcctgacactaaccagatttattttcgtgattaattgtcttgcatgtacggccggagctgcatgccgttggctgttgaagattgtttctggactctagccacacgcattgcaccggagccgagcgcctcggctatggtccacatcgactcccccgggagttcccttgtgtaaagcggagcggcagctgcatatccggaccggctatctttacatcagataaacgagatgagtatcggttttatctattctaatactttgcagtagcgagagtaacatgctagatcatgcctctagtcgttttattttctcgcatgaatagatgtatttgtccggcatttgcgccgactcttctcttgttatatcgccgaccacgaagtttggcaccacgcacccgaatgtgcttaccatgcacacaagaaggtgcacatacataatccattgaattgaacgacagagtgttgtcccgaatgacgacacctaacactcggtaacacacgacaccacctagaagttgtcgtctttctagctaacatagtcgttaatctatgaatatattaacacactcgtcatcgctgatcttatggatcggcgcgcttgggacactctgtcggttgtgacttgtatgttaataatccgtcatattgctatctgtatgaagtagatggtaacaaatccgagtcatcggcacctgcatgcgccaccgccgccgcctgcacgtagcgacacccggacgcaccgcatgacgtcttcccctttgtcaatggttgccgaatcaatccaaaacctttccctcgtcaatctgccatctgaaacgccgactcgacggcctttcgaggccatccgcaacgcaattgacgatcaccgcccgtagcgacgccaaggagcttacgcccgcctcccctcgctgccggtacgcaccgcatgcctcccgcattacttcacgcggccgggacgagggtcgaagccgcggtgagcacccgccgtcgatagctgtccgccatgccggcctgtatgccgagccgagtttcatcgacacgtaacatgaagctatgattgtcggacgccggtcacggcttgatgccaacgaatgccggtgtcggtgctactagatgttgcaccgccgctccgcctctgaccatggcaacttgccatagttgtccatctctaccgagggctcactagcacatttgccattggttccatccgttgtctccattgaagaatggcaattggatcatacctcacccacttcttgtgggagaaggtcgtaatagcccattaggcgacatatgagatgggctggccaggttttaaagctagctagtataaggaggtgggccaagtagaaattggcctattaaaaggagtcgggcacgaaccgtgattttggtccgaaaatggcattttatttcaaaagtccttggtttccaaggtattatgcggaattcggaaattatgcggaaaagtcctatgggacattagaaactacggggaatatacattcgccatttatactttgaaccttcatgaattgggtttacgccaaatagagaagaattaaggatttattccttagtcccgtatttctaaatatttgctttaactatttagttagtttcttgaataatcataatcaatcctaaaaacattgtttttaggcaaaagagcttccatgaacttgtgaaacctttgttttagcaccccttttgaaagcataatattttatggtttatttcctggcaattgtttgtttagggtaattgattgttctgtgggttagtagttctgtaaattacacatacctttgaatagcagaaaatcatgttaattgctaggattgtaataaaaggtgtgtatagaaaaccattctttactattttgtactcgttttgtgcactttatttactagaagtaaaccggtagaaagttgcataaaaggacatcatgtaagtagttgcatgtagcaaatacatttattgggcaaatgagtaatagaattattcatatatcttctctttgtctaattgtcgcaacatttgtagaaggcacaattatatattctccgtatagaataaatgtatacactcatcatgaagagagtatattattgacttagagatatttattagtgcatgactatcatagaagataagctacagctaaatttatattaattgtgtccaagtagatacaatgtcatcgaatttgtgaatatctagacgaggagtctatatgccaatatgccctacaccaaaattatctatcaaaagactatgtacctatgcagtgtctatagttaatttgattgataatgttttgtccatcttccacgtataaatgactttaaaaatgaagtattgtttttatggatgtatgtacattattttgagtaaattggtcatttgcatttgaagcaattttggcctagatgcaacatgtttagttgttagaattgatacacaagaagttgtattactgtcaatatgtgcatttgcacgcacatatatgacttatactattaatatgttcatgaagaacatgcatactcaaaatttgtgaaaggaaaggaatttggtgtatttgaatttgatgttcaactcaaggggagacaaatagtaatgacagcaatcttgcattcgttcttttgagatagtagtttacaatacacgagttagattatagtttagattaagttcaatatgaagaacatggttaagctcatgtagagcatctttatcttttgctttaggcatagaagcttctgcagtagattactgaatattttttttatataggtcatctcaccttacctatattgcctttttttacctgtagtaattctttaaccttttgtggaataaaattgtgaattgtatgtctaacattgaatgtaaatatttgtcttgcctgttatttgaagtatttttggtgaatgtattcttattatccactaagcctcaatcaaccatgtaggttgatagttctaagtgcattgacgccacattggcatacatgtaaagttgtttacttatgcacatggacaattagaatatttatgtttaagcattgaagctt

SEQ ID NO: 1428 - DNA, 523 bp, Oryza sativa
gcacgacagtagttggctgctgcaagtagtggcttgttacaagcccttccccttgaatttgacttgtcccaagtcagagcatttggaaatctttgcttgaagtgaagttcacggttcccatgtggcatcagttcaagcaggatcagaccaccgaacaagcaattgagaaccaatacgattaccttttcgggtaactctggtatccaggacttcagctgggaactggatattgcaagttgggaaaggcagttgttgctgaactgactgcttgaaccctttagaactcttcagttgggacacatgaaaaacacggtgtatggcactgccagatggaagctgtaacttgtaagccacctgacccactcgagaaatgatcttgtaaggaccaaaatacttgaaggagagtttatggtttgctcttttggcaacaaaagactgtatatagggctgtagcttgagaaaaacccattcaccttcttggaattgcctgaaactcctctttttatctgcttggtgtttcata

SEQ ID NO: 1429 - DNA, 499 bp, Oryza sativa
agagacatttttatggaggaatacttagtatcattaatggcctggcaaccataagagacttgaggagtggcaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaattgttgtagacggctatgtaatacctgagggttctctgacttgaggttcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgtt

SEQ ID NO: 1430 - DNA, 59336 bp, Oryza sativa
  unsure (1)..(59336): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggcggcagctggatcgatcgatcgatcatcacccgggacgaaggaaacgtacggtgagaatgagatggatgagggggatgcgatccatggcttggcgtttagggttggttgtttgcaaaagcaggaattttcgaggatatctatggagattgaactgattattgttgtgagatcatgcaaaaccatgtgttccactggatgttgtacgagacaagagcctaatatcgtttcctcgaaaaaaaagtagtataatatcattttttgaaagacaccttacaaaaacaggcacaaaacacacgtacacaatcatccctataacgcgctcacatgtgcacgcattaactctataataaacaccttcaaaaactggatgacatatattgagattaacgacgtaactataaacatctcgctgtcaacggatgtcatataccactaagaataattaatcgtaaatacgagcatctgcggtaagtctagaaacttgaattccgatgagctaatcccaccacaataagagtaaatcattttattcatgtttttattttttttctttagaggatttgccacttcccaataatttgggttgtgtgtttgcataccaccacttgcacgcacaaacatttgtaagtcctgtacacatgttttaagttaatgttggaggcatcaaacacccaccccctgtagcgaggacaccacgtattaacctagcatacatgcataagcactcctaaaaacattggacagctaaactaaatctaaaacttgaactctgatgaactaggtacacaccagcaccacttagccatccgtgatttttaatactatagttagcccgtacaaccaagtagcaatcgcaatacgcacatgaagatgccaaaaactgcgttgattagttgactttgcgggaggttgtgagagcgtttttttcaacaaaagatgactggagaaagacgtcgagagagggaggagagggcagagaagcgagggggggtacaggggcgatgaagcgatgatgatgacctgtgttgaaagggaaggcgaatggaccggctaccagccttcctagttttggatatgcatatggcgttggtcgcctactcgctttcagcgtataattggagccccacccggcaaaggcttcatggcttcgttggctcaaaaagagcatgtcggcgacctctcccgccacctgattttaacgcaatcttttctctctctctattctcaccgcggaagtgaaacactgtgcactgttcgtatctttacactgaagctacaacctcttctgctcctctcagttttgatgttcttgcacaggatatgagctgtgaatttcacgagaaacaattcgattctacccccagcaaaatttcctgtgttctggtccaaacaggactgtagctattcacaacccattgtcgttctggtccactaccatactaggacatctctgcttaacgaatgaatggataaatgggcacactttcccgaattcctaaatgctatgatttcttataatactgtcttaaatccatttttatctttataataattcattcgttcatttgtaccctcgaataattctcacgaatcattaatttattcagcaattctgcacagcacaaaaaaacacacattgaagtaattaatgttgcaattccaatattccaggaacttgccaacattcttggtgaaattcatcaggccccataccagaatacagctataaattataattttagactgaagaactcctagcaacagaaatgaaaaaaaaaagtatggcaaatgcacctgactgaattgaatgtagattgatttaacagtagaacgccaaagcaagtacagatctcatcagtggctacggatcaacaaactacacattcagaagaacaagtttcaggagttgctaggaatgacattaaagaagtggtaaacttcatcttcatcaaacactccaacctcagttgagcaaacctcacaacaaacagggtgataaactgcacccttcttttcaccttctgatgtagtagaagaatcagcagcctttcccttgcggtttttccgtttgcctttcccctcccgtagaatctgatcagtcttgaccttgcagttgcgaacgaacattgcacggtactgatttacatacgtctcatgcctgaacatcaaagaaagccactacagttaataattgtctgaagatttgaagcattcaaagtaagaacttcaggagtttctgaacattgtgcaaatgaaaacaacagcataatgtttcacgatataaaatgattactgaaagaattgcaaataggtcacataaacttgcctccagattttttttcccacaaatctagatttctcaattttgtattaaaaaattggacatgctcagtacaatcaagtgatataattgcatattctggagaggaaaatgatcaagcacaatatatggttaccaacacaagttccaagcaggttttattttagtttcaaaccaaagtaagtttcatgaagatttcagactttcaaggtggataattcaatttacaaagcaggttacaaataagtcatcatgaatgttccagcatgttgcaagattgtcgcagtggttcaggtgtcttcagaaatttttgaaatggttcattaatgtattgcaagtttctgaaaagtaagtccaacctctaatacaaataattgtggcatgtccccatgggccaaccaaaaatctccgatataccactaatgtattcctagagtcgccatttcatcatagagataagcaattaaacacccctgacttgtttacaaatagctatgtcttccacttgcaggagcgtttctcccatacaagcaaaatcaaactaaaaattcaggaacaactaatcctagcataaaccatttattaagaagttccattatttcttccagccacttaaatcaaccaatttgatcattgtgagcatggatgtcgattgtatgcaaaagatttgctcacatgtatagatatactcctcatggtctaacatacaccaacttctccaaacaaaattattgatagcatctaccctatacaggcagcagcaccacaatcctgatagtttcttcatcatcaggaaaagcatcgtgccaatccaagaactaaaaatagtaaatcgactaatctaaaaagaactagtgactgcttaataaacatgcatattggaatccagaagcctcctcacagagttcgaagcagtaaggaaagacaacctctggcaatccaggcacaaggtagtgaagcacgcggggcagctgagcacggcgtcagaagtcctccctttcctctgcttgctcacccaccgctcatcgacatcatccaggtcgggatcgtagaactcgggctccacggagtaatctatctcatcgtcgctggacactaacaaattcagaggtaacacaaaaccaaaagaggggaaatcaggtgcatcagtcaggacacgtcaggcatctcccatttcctgcacgatttatatatacttccggttcttggaggaggaagcaaaaggggttcgcatgaaagattttagccatctaaagcaagggggggattgggagagctacctagttctcggggatcgacggggccgccggcgtccgcttccatcggctggctcgccgcctctttggatttctcgggctccatgaaaccctcctcgcctccgccgtgcgctctcgcttccgcttctccggccttcttccttcgcgattcttctctctcctgtggctgcgaggttttgggccgaaccgacagcttggtgtcggcctaattggagaaaccgacttgagttcttccccttttttttttgtttttttttgtcagatcagaatattagattagatacgattttttgtccatgtattatatagaagtaaaaaatggtgaaaaaaaaatcaaccatctaaaaaaaggaaaattaaggccgcattttcgatacatgtgaagttcagcttgtttactcaaacaggtactgtagctttacaaatattcaatcaggaaaaagagagtatcagcggcaacatcttttcaccgtgatccagaaaatctatatcgcatattacaccagtacaattcttttgttctttgaaacccatgcattcatgagtttgtcttagaaattaaagagaatcgcacatacatcaggaataataaaaaagagcacataatttggcatgttttgcttctcaaaagccttcttaagttgtgaccttcctcttaaaaaaaagctttcttaagcgagtgcccttttgattacaagcagctccttgatgatatctttggttgacattctactcaatggcatttccccagagcagagcagcccgagtttaagtagcgaaatcagggagttcaccctttctgacggaccatccatggatgttgcaggcggcgcgttttcaagctctgttaccagctctacatcgagaatgtccatcgctcgattattcagggccatctcaacgcacttgcgaaggctaaatccttgctcacatgtgttatctgtaggccgccttccagtaatcatttcaagaacaagaattccatagctatagatgtctccgtgagttgaaaccatatttccagcaccatattctgtttgaattgaacagtgatgatgagagtaagtaaactgggtaaatgataatgctatgtctatggtgaaagagatttgacgattgaaaggtcgtaatgttttcaagtaaatttcttgtgttaaataaatcgatagatgcaaataaaaagaatgataaactaaccaggtggagcataaccaattgtccctctaaatcccatcgagctcgttgagggttgagaagacagtatcttggctagcccaaaatctccaacatgtgctaccatatcagcatcaagaagcacattacttggtttaagatcgcagtgcacaacaggtgtagtgccatggaaatgaagataatccaatgcacaagccacatcaaagagtatacctactctgtggacaagattcaagtgcctctcttccaattggttatctatctgaggatggagccactcttctaggcaaccattgggcatgaagtcgaacacaattgctttgaagtcgtttccattgaagtccatgcttgagcatgctgtaactatcttaacaaggttccggtgtcttaagttcttcatcgcttcacattccgccgtgaaactcttaagagccccaggtgtctgaagtttcaatacttttacagcgataagattttcattctcaccagtttcatcgaacaatttacctctatagactgatccatagctcccagtacccaacaaattggtcgtcgagaagccatctgttgcatgtaccaactgctggtaggagacaagttgatgggctcgcatggacattgttgaaggactttttgttaatctgttcttataccaagcatggaagaaaaggagcaatgaaaggatacatattgttgtagcaacaaggggaacaacaatcgccaaccctggaactctatgccttctcttggaaatcttaagagaacatgtaggcaagtgaagatctggaatgcccccacaaagcttgttgttcccttggaccgaaatgccagtagcatttgcaaaaacaccaaacactggcacttcaccgtcaaagttattgtaagagaggtttaaatcatagagtgtgaggaagtgtccaaagaactttggtatttggcctgaaaaattgttactagagaggtcgagaatttctaaacccttcatctcactaaaggatgatgggatattaccaataaatgaattgttttgcagatacaaaatctggagaagctggcatttttcgaaagtaataggaatttcccctgataattgattataccgggcatcaaggtatacaagattcggtagattcccaacttcaggtggtattgacccgtctaagtgattgtaggagatatccaaatatattgagagtgttgtgatgttgaataaactagttgggatggtacctataaagttattaaacgagaaacgtagactcgacagtgaaaccatgtttcccactgttattgggatgctaccactaaaattattccttccaaggtctaaagagtccatatgagttaaattgcatataacacgagggaatggcccactaaagtaattgttatctagccacaaaattcttaggttttgaagcatacctaatgatgacggtggacttccagtcagaaaattgttatgtgcgacaagtgcacctaaattgattagtttgccaatttctctaggcatgttccctacaattttgttgctagctagagtgaggattgttagtgatgcggataagttggaaattacggatggaagagttccactaaacttattggcttccaattccaaaacttctaattgggagcaatttgttaatgctttcataaacttccagtcgttagattctttggcttcaagatcattttcagtgagaataaaccacttgagaccctgtaaccctcctaactctggaggaattacaccactgaagtggttttccgcgatctgaaatctagagagtttggaggcattaaccagtgatgatgggatatggccatcaaacatattctcccccgcatcgaaagtctcgagcataggaagtgtgttgaacacgttcggtggtagcatcccactgagctcattgttttctacagaaaaatgttttaggaatgatatgttacaaatattaggaggaatggaccctatcagaccgttagcttgtaggagaagactggtaaggttgttcaagtgaccaagagaagaaggtatgccaccagataattggttatgttgaataccaagagcattgagctgggaaagattgcccaaggaagctggaatctcaccaaatagcatgttgaaccctagattcaagaagtaaagtgatgacaagttacccagggatggcgggatctctcccgacagattatttgcacgaagattcaagtacgctagattcctcaacgcggcgatctcacccgggatctcaccacggaggtggttggagtccaggctaaggctctcgagcttgctacatcctatcgccaacgccggtgggatgcccccttctagcgagttgccagaaaggttaagctctcggagcctaccgagacgccccagctcgggaggaatctggccaaccagctggttcgccccaaggtctagcacacgcaggaacgagaggttacccaagaacggcgagatgagcccggacaacgacgaggagccgaggcttagcgcgacgacgctgcccgcgtgccggccgcggccgcacgcgacgccacgccacctgcacgggtggttggaggcgttccaccaggtgagcgcgccggatgggtcggacaccatggacctgaaggagagcagcgcggctgcctgcttgtcggtggcgtttgtgctgctgctgctgctccctaccgtgcataccgccgcaggggaatacaaaagcaacgtggagcatagcaagatcactagagcattcatgcctgtttatgtttttcagcgccaatggaactgaaggtgagtgggagctcaagggtgattggtatacgggcagaaaaattgcttggaattcacagtataaatagagatagaagcgcatgtaggagtagcgacgaaaagggttggaaacagtagaaaacaatctcaactatttccataactgtttttctaaaatggaaatggagttatacggaccatatctctatttctactatttaaaaataagagatgttcctatcatctatcatccgtgcgaaaaaaacgggcaaaaaaaaataaaaaagaatctgtccgattgaaaaaaaaggaatgtggcgaaaaaaaattgggtgaaaaaaagaaaaaaaaagaatccgattccgtcgacgcgataaaaaaaggcgaaaaaaataaaaaaaagaatatgtccgattcaaaaaaaaattatgtgacgcagtaaaaaaaattgaattctcttattcgtgacacggtactatatatctctatctctacttaaaaaataaaaaacatttctgtcgtccgtaataacgaaaaagggtgaaaaaacattaaaacaaaaaaagaaagtctgattcaatttactttaatcgtctgtgaaaatcttattttatcttaatctcaatctttccgaggggaccgagcggcgcactccgtccccgcccgcgcgatgaaacgccggccaaagcaaaagaaaaagaaactgaaattgagcaaagggataaactagattgaagttcccaaaattaaaagaggataaacgatattgaaactcccgtaactcaaaaagagggaataaaatagattgaaatttcccgacaaaattccccaaattcgaagaaccctaatttctggtaagaaccctaagagtcaaaatccaaaccaattaatctaagggttcgggttacttaccggacttgaagcccctaagctcaccggagctttctaggaagcggcaccgccgcaccttcacctcctcgcagttgcgtcgggttccccgtgcgcgcgctgtcctggagcacccttccaccgtcccttgccgaagacgggaagcgtcggcttggcgtcacccctcccaccgatgaggtccaggccgctcggcgctcgtcgccatttgcgcgcctgcctagccggaccgccgacactgtggcatggctttgtgccgccctcgggtgcggcccccagccggcaaagcaggagctgctcggcggtcatcaccacacgcgcgcaccagctcgccggaccgccattgccgcctttgttgtcgttccgcttgctcgtcgccggagagaaatgggattgggagagggatttgggagctagggttttgcccctctctcctggtcggcgcttcatccggcacggggacgatcggagccatccattagatcggagatccatccattagatcggacggctcagattcgcccagtgttgggccaccaccgctgctggttacgctgcgcccaatgggttgcggaagtgcatcggaccgtccccgcatatgtgggccgcgctctgctgctcggcttgtgggcctgttgatgcgaaaaacacacactggcctgggagatctgcttaactctagtgcaggttcaagatgttgatgagatgcgggagtgccattcagtttgattctgtaactgacaagatatacaaatagcagatcaatgagccgatcggctggcaagccgatagattaattccagctgatgccgatactagccgatagcaatagggttttgagctatcggctatgattctgatgtagattctgacgcttgatgtaaataacaatataaaggcaatcgactgatgataatgtaagaaagcaacaatgtaatccaatagaaaccattcgactaacaatgatatgatagaacaagtattgatctgaaggttaaatgatacatcggctggaggttcgatgtcataaaatccacaacattagataaatcaatgaaatatttgttatcatcggctaaatccaacttatatatgcagtccttataagccgatgcaacatccagataactcatcggttgaaaccccgataaaacccttattggcagtcaacaagtaggctagggattatggttctaagcacaacttagtagatcaaacttaactaatacaacactaagtatgaaaagaaacataatatctagacgatcatgcccttgacggatttttagagtggtagatgccttagctaatctaatctagtaaaacaatttagccgatactggcagaaaccctaaagcgagagacaaccgatagagctaaattgagttactaagactagattaactaagacatatgataaataggcaggcaaatatatcatccaaaccagagcaatccaagaggttgaatgtactgatgcagccttgaacgacgccgacgtagacaatacaggggattgctagttggcgcgcgcgccagctactcccgggcctcccagcccatcagccatttttttctttttttttcgcgatttcttctttattttttcttttgtgtttttttttcgttttttctgattactttttttaatctttagcacacttatttttttcaaaatgttttgagttgaaaatttttaaatctgatttgaaagtattcaaatcttgagttgaaagttttcaaatttgagtggaaagttttcgaatctcgagtcgaaagttttcgaatctgagtcgaaagttttcgaatctgagtcgaaagtttttggatcggagtcaagagttttcaaatctcaagttgaaagtttttaaatctgagtcgaaagttctcatatttttttcaaatcttaacttaaaaaattttcaaatctatacttgaaagttttcaaatctcgagttgaaagttttcaaaatttgtcttacacatttaaatttcgagttgaaaattttcaaattaagttttaaaagtttttaaaatttaacttcaaaagttttgatatctaacttgaaagttttcaatcggttagcagaaaaaatcttccggaaaaaaggaaatcatatcttaattaccgtcattatctactaatcacttaattaattaggctaaactatcggaaacgctcgccgccaacgcgcacgcgcgcgttagcttttctgaacgatacaattgcctgggccggtggaacgtaggacttatcccttcgcaggaggtcgatttaaaaaacaattgtaaaggtttcacctcgtgatcaaatatatttgaaacaaacctacaatacgtacattgctatcatccgattgctgtccggccgtgttacggcgtgggcacaactaacaggcgcacagcaatattcattacggcctgaatcatctatcgtgtgtgagactttcatcgctgctttgattgtatgctgaagttggatagcaacatcgtatatgtatattattttcaattggagactcaacttacaactcgtatgcatatatattatgcaggtactcatggtgatggtggccggccatagatgaaaccaaaaattagatgacaaacggaaatgtaatttaatcgaactctttgatagtatgccaacgtatataattagtgatggagaacaatgctcgacggagccacttatatggacaaagaggagtcatggatggactcgcgatgtaccaatcgggccttcccgaatcccatcctatctgctaacccatatatgcgatatatatgataggactagtgtgaaagacgaacgatggatacgtatgaaagatggatgacgtaccaagcccctaacaaaaacacttttaatttttataatagtagagatatagaggtggaactatagaaacacctttaaattttataatcgtagagatagagaggtgggacggtataagcactataaatattttaagtaggtaaagataaagatattggataaattaaattgcaagctcacatatttatattaacatgactatataatatggtcataaaaattcgcttacactatgtaaatcacaaaattacctattcttcagctatgtccttaaattagagatttgatcgagagattagtggaactctaaactatgggcgaaacataaaccatagatgttgtaatattgtaaacggttctactagctaactgtcgacagctttcctgagtgaaaactattgaattttttggccgtcgattccgcgctaagatttgtgctgagatattttgctatcggatctaaaccctatttttcacaagctagtctcatcatcgcatgtttatggcagatttgtttaagttacatctaagttatattctaagtacatgctagttacattgtaactacactaataactacattgttatctctatataaatctattatattattaagacagctcgaaaagaagccaccacattcgctgtggaggctagaaattcccacaataatcgaagaaaaagaaaagaagagtccaagtagaaatacaaactaaaaaataactgaaattcggaattaaaaataagcaatactgaaataggagtccatataagaacccaatacaagatcaattaaaacctttggcaattctagattttaactgtttacagtagaaaagataagtctatagaactgtgtacgttacatactaggagtctttgtccttttctgtttctttggcggtgtacacagtacacgtataatctaattcaattacaaacctatacgggcaagagttgtgctgccaaataaacaaagcttgcactgctgcacctatatattctgtagatttcaagcagcaacgattgggctggagcggcagaacccaatgatagcgggagccgaccatagtaaaaagacatgatatttacatagacattacaacaaacagatcaatacttgcagccggcaatgcatcaaacaccaaaagtttctttgatattcatgaaagtacacatgatatcgacatattgtaattagtgtatatttttcacaggagatgaattagtgcaagccgctataaactgacagtcagataaacgtttagattatagtggattcacaatttaacgttcataatttaacggttgagatataacacctatatataaatataggaattagagttgtagtgctaatataggagtacaaagcgccctgctcgatggaataatcgagatccaattctaaaactgttatctaaacctatttgattccagtggaaaaaaaaagcaaaacaggaactaggtaggcagaaagccgtgtatatacgtgtgcacatgtaagtattattttttcagtctaatcacttcaaaactatttagaacatactttgatatatttgttgctagtaaaaatgaagcgactgtctctattcgatcctttttaatcaccaaatatacatccagcaattcagatgatttataagtaactaaatttgaaataataataataaagactatgaaaagaaaaaaccatctacaacacaacatgtgattaattaaaatttaaaaaataaattatgaaattagaaaaataaaaacaaaagtttaagaaagaatacgatttatgaataacaaaagttcaaaataaaaaaaagaaatattaaaagaacaacccgtaacacaacaatggtaaatatcaataaagagggagggataaatagggtgtagcggttgatgggacattttaaaacaataaaaaaataaatgacgattagattcaattttaaaaatctcaatgacgattaagagaaacagcagcgggcaagccgtcaaggagcgcagtcgtgacgtttgactggacttctaaaaagaaaaaaaaacaacaataatcataatatcatatttgactttttaaattccaatgacaactaaaaggagacatcgggtggattgtagaacagtacaatgacgacatttgatgtaacttctaaaaatataaatatgtcaattgacaagacaatgaactaaaaaactataagatctaaatatgaaagtttcaaagaggatgaataaaagttgtgaaaggttgggcaatcaaataaatgagtggtaaaaatgtaaggggtgacgacttattgacttttaaaaactaacccgatgataataagattcaatctttcaagatcggctagatggctatttaacaaatttaaataaaaccatgcttaaaaatatataattctggatgggtgctagccgcgcaacaaataaatgggtgacaaaggagtaagggtagcaacaggtgtgacttttaaaaattataaaattataaacctggggatgataatgtttgatctttgaaagtcctaaaacaacgagatagatatttaataaattttaagtagaatcatgtgaaaaattagataattttgtgggtgctagccgcgcaattgcgcggaccacccagctagttagatataaagttgcatatattattttaatacatatgtacaagttattattattatagtatagttctagtgaaattatatactatagttagatttgaaagttttcccctcaaaaatcactcgacattttttttagctaatccctattttaaaattactaccatattataaagggagaattgattatttgactatgttttgaagcctaattaacaatttgaccctatttttttcaagtttgcttatttgactatgtttttcaaaattagagtagccgtctgaccctgtttcaactacgccgttagagtttcatttagaaaaagaaaaaaaaatgtatttatgagtcctaatggaccaaaataaccctgagtaaacacattaaccctaccctcattccttatcctcttgatctcccctctttctttccatagctttccccacggtgcagaaccagccacgcaacggaagagtggcggcgacgggggcctcggtggcgaagctcgggctgcgaggggcagatttggtgacggagcttgggctacggcaggtgaatttggcggggaggggcggcggaggcttgcgacgagaaggagcagcgacggcaggacccgggcggcggagttctggttgcgatggtgtgcggtctacggatctggtggcggcggtcggtgacagcggcatggcggcgacaaagctcgagttgcaacggtgcatcagcaacagatcgactcggcctgcgggatgtggatccgatggcgccgaggcatgcgggggacaggttggcgacaacggtgtgtcgacggcagatctgacggcgccgattcgtgcgggcagcggagtggcaggtcggcgacggcggcggcgataggaccttcgagtgttgggcaagaaggatttgtgttttgggatgtttttttggtagacatgaattaatttattttttttgcttcaatatatgttaaatttgtgaaacataaccaaattgaagtctattttgttaaactggaatctaatttgaaaaaataatctaacaaatctaggtcaattttgaccaaaatctgacaaatctaaaatagggtcaaatgagcaagggcagtagaggcattttgtgttttctataacatcgttacatgcccttaaaagaaagaatgaagaatgggaaaattggaaccataccattaaaattttacaaaatttgagatatgccatcctgacccacatgtcattgattcatgtgggtcctatatgtcattgagataccgatgtcatatctcaaactttgcaaaattataatggaatggttccaatttaccctaaaagaatagggtcacaccgtacgttcagttttgaaaaaaagggtcaaatgagcaaaattaacaaaaaaaggggtcaaattggtagttagtcttcaaaagagggtcaaatacgcaattgcctctattataaaagataacttcaacataaaaagggtaaaataaggaaacaattgagcataatctttttcagtttagggttagccaaaatttttaatttttctataactatttggataacatacacaaataagagagaatttctttttgagagtttataagtttcctcctatcatgtttttttttgctatatccatctattaacttattaaagtaatagaaaaaggagcctccacgttttctctcacccctagaaattcccacattaatcggagaaaaagaaaaaaaatagagtccaaatagaaatataattttaaaatagtttaaattcggaattagcaaataaggaatattggaagagaagactagagtccatataggaatacaacttagagctaattaaaatttagaataaaaaaagaaaattaaaagaagaggttagagaccatatagaaatagaacttcgaaataactaaggaatattgaaaaaaaaaatctagagtccatatatgaatacaatttagattgaattgaaatacggaatttaaaaataagaaaactaaaagtataatttagagtccatatagaaatacaacttagaaaaaaaaaactaaaattcgaaatttaaaaataagaaatattagaaaaagaatctagagtccatatagaaatacaacttagaagaagctaaaattcgaaacttaaaaaataagaaatattagaaaaagagtctatagtccatatatgaacacaatttggaaattactgaaattcgtaattaaaaaataagatgtattgaaatatgagtttagattccatataataaaaatacaatttataaataatagaaattcggaattaaaaataatttgctctcacggcctataaattctcacattaattggaaataaaaaaaatagagtccatatagaaataaaatttaaaaataatttaaattcggaattagcaaatatgaaatattggaagaggagactagagtccatataggaatacaatttagagttaattaaaacttcgaataaaaaagaaaattaaaagaagtggttagagaccatgtagaaatggaacttagaaataactaaggaatattgaaaaaagcaatatagagtctatatatgaatacaatttagtaataactgaaattcaaaattaaaaataagaaatattgaaatataagtttagagtccatatagaaatacatatacaacttagatctaactgaaattcggaatttgaaaagaagaaatgaaattcggaatttgaaaagaagaaaattaaaagtagaatttagagtccatatagaaatataacttagaaaaaactaaaattcaaaatttaagaataataaatattagaaaaagaatctagagtccaatagaaatacaacttataagaagctaaaattcgaacttggaaatatatgaacacaatttggaaatttaaaaataagaaatattagaaaaagggtctatagtccatatatgaacacaatttggaaattactgaaattcaaaattagaaaataaggaatattgatagatgagtttagagtccatgtaataaaaatataatttataaataagataaattcggaattaaaaaataaggaatattggaagaggagtctagagtttatacataaatacaatttagaaataactaaaatttaagatattaaaataaggaatattgaaagaagggtttagaatccatatctctactattataaaaattgaagatgtttttgtcgatactttgatacgtcatccgtgtatgagtcagtttttaagttcgttcgcttttgtaaatacatatctgaatttgagttggttttggaaatacagaaggagctgtataagaaatctctttaaaaaaaactcacatgataatttgaggcgaacatactcttaactgtacctcatgattttctaaaaatatatatccaagcgaattcccgcagtaaatttcgtcttaactaaaccatataacaataataagattaaaataaccttcacctattgcaacgcactggtattatttttctagttagaataacatttgtaagtaacatgacttcaaaatttaaaaataaaaatattataagatgagtttagagcctatataggaatacaatttagaattgactaatatttaaaattttaaaataattaataaataccatgtatattcaatacaatataaacattacacatcagttagtttgttcaagttagtacaaaattaatttttttaataatttttaatatattttaataaagatatataaaattatatgcgctatcatataagaactagccgtgtaatctagttttagggggcatttagattcaaggggtgtaaagttttggtttgtcacatcagatattttatagggtgtcgaatagggtgttcggacactaataaaaaaactatttacagaattcgtgagtaaaccgcgagacgaattttgtcggagggtgatcctttctagcgggaggctgtgaggcccccctttgtgagttcggccgggggagcgggtgcaatactgaggagcgtgctttcacgcgagcgaggtggatccacgagaatcaggctcatgaaatggaaggtgagagagtgagagagagggattatacaggttcggaccgctatcgagcataataccctactcctgtctgtgtgatgatcttcgtgtggttacaaagacttcagatcctgggagtacaagctagggcttggccaacctcttcccagagtctgattttctaagagacgtcccctttagtcgtagggcagggttctccttttatagatgaaggggataccacatgcaccacccctgctctctccctgcgggagaggggcccacattgcctatattaaaatgcgtcttgtgccttgggctggaagcgatctgcgcggctaaccttgggtggcccccaccgaaacttttcggctgacacgggggacatcccccatcattccctattaaatgtttggtgacttcgtgggcacacgcgcattgggcggaacgacctgcaggacctcccattacacatgatgggacaaggcatacctgcccctacgctgcctgacacgaatcgagacgtgggcgcactaccgcccatcccatccattcatcgccgggtcacagactagtcaaaaggcggttgccaggcgcacgtcaatcggtctacggcgcaccgtgccatgtcgcattaaatgcgacgggagcagttgctgcgccactcataaatgcgcctggcagacagtgctcacgcccgctgacggctcccgcttggccaccaagtggtggccgagcgagggcctcgggggtggttcaacccctcgagcccgaggggtacgacgaggtaccccgagcctcggggagggaggcagccactttccatgtgagggcgtgaccccccgagggggactgggcccgccgtacgcgtcacacgggaagggctttcttcccccctagactagggactcccgggcccatatcaccaataaatttattaagcctaattaatcagttattagcaaatgtttattatagcattatattgtcaaattattgatcacttaggcttaaaagatttgtctcgcaaattagttgcaatctgtgtaattaattattttttagcctatatttaatattttatgtaggtgttcaaacgttcgatgtgaataggtgaaaaattttgaggcaggatcggccttacatatgtttggtcggataggatggagaattttattctggtagcgacgtatcgtcacgtccggagtcgtcgtcggtcaatgtctaccgacacctaacggccaacccttccctattccctccgtacttaaaaaaaaaaaagaaggcaaacattgggtttccgtgtccaactttaactgtccgtcttatataaattttttttataattcgtattttcattgttgctagatgataaaacatgattaatattttatgcgtgacttgtctttttaattcttttcataatttttttaaataagacggacggttaaatattggacacggaaactagggtttgtctttttttttttttttttgtttttgggacggagggagtacacggttgacagcaggttgaatggacttgcccgaatgcccacggcgtgctatacggccactgcagttgactccacatacgacacgcgcgttagaatcgttcaacttgaagcttcattgtccagtcgctgtgtttctatcaagcagaaaatgtctgtactagtactttggcatgtttaggtcaggtataaaattttagcgcgtaatatcaaatatacagatacacatttaaagtattaaacgtagtctaataacaaaacaaattatagaatccatctgtaaactgtgagatgaatttattaaacctaattaatttgtcgttttgcaatatttactatatcaccatattgtcaaatcatgaagcaattagtcttaaaagattcatctcacaaattagtcgcaatctgtgcaattagttattttttagcctatatttaatacttcatgctggtgttcaaacgttcgatgtgaccgggtgaaaaattttaaggtgggatttaaacggggacttagaaagtcagtagtaatggtatctattttcacaccactcttatcactgatatctataggccacaaattctcactattacaccaccttttaaaaaaaatcattccgtatttcaatgtttgctttccaaatttcaaaatcgcctacttattcaataaaaaaaattatagtattacttggactaaataagtgcttattaattgatttaatacactagaaacttaatttgatttttgttgcaatacacgagctgtaagctgactgaaaattatatactcccatgcaaagatcatggagagagtgctagcaggcggtcaggcacacaaccatacaagaaggcttgcggatgcacaatagatgcacagcacaaatcactgtcccgcgagacttccagcgaggtcgtcacgatgcacagatctctgaacagcaacactccaggtggtcctgagcttataagaaatactatctccgtttcatattataaatcacttgatatttttctaatcaaacttcttaaagtttgaccaaatttatagaaaagtacattagtatttttaataaaaaatattattaaaatatatttgatgttagatttaatggaattaatttaatattttagatagcgctaatttttttttatgaatttagtcaaacttaactagaaaaaaaatcaaacgatttataatatgaaatggatggagtagatggttggtaggtaccttatgaaaattttagttttttcaccttctagcttcttctttttttgattctatagctttatattcttagaatttaggtcagaatctgtaccactgcagtttttgctgctaaaagtttttcaaataggaccttagtcaactttttccggctaggtgcaccccttttagaatttgttgctaaaagctactatcttttcaggttataagactttctagcattgcccacattcatatagatactagccatttggtcgtgtgttgcatgactttagatacctgtaaaaaagctctatatttatgggtcgtaatatatcatatgatgaaccatgtttttattagacatataaaaatatcatgaaattatcctttccctcaatcagggtatccaacgtttcctgtattttcatgtctcgcatctttagaagcctgctccaagttcgcataaaaaaatggccctgaaattgacttcaacaggtgttttgggaattttgcttcaggctccatcttgttccatgcttgccacaacactattgttagatctgcatctcataaccggataagagtacaatatgatccatgcatcccaaaatttatgggaaaccttttagtttctatgaaatcacaacctggaacatggcaggtgcaaagggcttggcattaatcacaaccgcaacataggagcaaaccttctggttcctttcgccgtttctataggcgagctggctgggcaaaagacttagcccagtatacatataagccctttatacatagaccataatatgataatgggattaactctaaatttattttacttaaaaaaacataggacttggtaaatagttagttagaactaacctatatttgcaagtaaggttcaagtaccatgtagaagatcttttggtttccaaagttcagtcatctcatccagtggctactacatgcttattccacaatattttctcataaaatacaaaataatttaatttatgactttgaaagggactggacaaacaattacttcctccgtttcatattattaaactttctagcattgcccacattcatatatatgtctagattcactaacatatatatgaatgtgggcaatactagaaagtcttataacctgaaacggagggagtagttaaatcctgaatctacgtaaaatcaaccattagtttatcatgaaacttataatggcaccattagaccattgggccaacaaaatattaaatttaaagtaggtgctttctaaagttgactaataataataattatcatgcttgcacaggacgcaacctaaatgtaggtagaatttcacttccaggttgttacatagtatgatactgtactaagcattataagtttgaagttgataagcaatccacatggttgaacacatctcagaaagttagaatcagtgtctctaaagttctgagattatttgtacattttagtaccgagaaaaatattacctggtttggatggtgccagcttccttgtttaacagaggagatacttttacggttttacctttggggagataattgcacctgttgcgtctgtaccatcatttgggggtgtttttatcataggattcaaagtatatatttggggggaagtgaagccaaaacactctgtatgaaatggttagtatctaacctgtgaaaaagatgatcccaataccatttatttggggacatatgttcagatgtcatctgctaaaccagtggaatcatagctaaaaaacaaaaggttgagtagatacattccaatttggttaaatgggtatatacaacattccaatttgattaaatgggtatatgcacaaaagtttgggtggtttctagaaattttgaaaaatatctttggaggtacaattgaaatgctttcttaatagaattcgtgcgaagaaaataaaaaggacttgatttgatgacacagtcaacaacaataaatttcttgttctatcaaacaatattattcctcaacaactcgtatccagtttttaccattcaagaagtactaatgttcatgattcataccttagatgcatggtagcaagttgaataaaaaatgaaaccacaaattttgaaaggacgtttatttcataattgtcacttcaggtaaagaccaataacgcaaatcaatattacagtcatttcaattcctgctttaaaactcataacatcaagaaaaagaaatacctgataatacaatatttgattgctttattatttgcttcataaattatcaaaattcattcttaatcagtgaatacacccttcacagcaaaccggaagctaaatgggtacttagagtcaaatacatttgatctttaatagtcaaatttcatttaagcttaagcaaatcacattgtagaattatcttttataggtttccactcccctgcttgctgcagctttgctcgttagacacacatatatagatacacaaatatagcaatacaccagtcatttatataatgttaggagcaaccctttcttttttctaaatgcgtgaatagctagtactactccttacttttttttttgggaaattattagtattagttatatcccggtgaaccactgccatcgaattgcttcagtgagttggacgttgggcatacggaggaaaatactatttcaatccacttataaattcatttgttattatcacacatatctttgataactattgaaataattgtatgtaactatttataattaatgaacatgaacttacattttgataggatgcattctttttacagtgctcttaaatgaaatttgcccacccaaaaactgaaattacatgagaggcttaattaaggactccattatagaacttatttatcacctttttagtctaaatcaacttgttagcactaggtgaagccgtggttcctatacatcgtacatgctttaccaacatgaacaccgtgaggagcaagaagtttagatacttaccacagctgtcgatgttgggactttttgtatttcccttggccatcgttattggaggaggatgagaagtggcgctgcagagtaggtcctggggaaccagaggcactcaggtggagatgcagaagataaggcggcagtgacccacaagtgaaattccgcgtgcatcgccgtcaggtcgagccatacctcccaaatccgaatcagccccaccatcgccggatccagaacaggtaggaggaggtgatgccgcagtagtgttggggatgggaatgaggaggaataggatggggtgtggctagggcagggggaggtggaaggggagaaaggggaggtatggattcctttgcttcccaccgcaggcgtcttcgaccggcctgtccccttgcacctatcctcgtccttctcgatgccggtggctcttcttcttacctctccggtccccattgattgtggtggagattgagaggagacatagcggctttggagatgggagtggaggaagcgagcggaaacgcggagcacacgatccggcgcctccgcctcccgggagtggcgcggcgcagcgaccagggaaggggaggcggcctccggtcccgagacggtgtcgcaactcgcaacaggtagcaggggtgaaaatgaaaaatggtaagactagggaggtggaaggatcttattgcgaaataatttttacgaaggatctagaatagattttgccaatcaatgaatccaacagctcacatcatctgtaggggcaatcggacgtcctatgtttttccgatgacgtggcgcaatctagtggcgaaaaactttagttttttcactactaggcaatgcgaaagtcttgtaatctgaaacggagatagtatctaaatagggtcttagtcaactttgcctagctacaaattgatgtatccctttcagaatttgcatgcgctgcctgtctgatctcagcacgattagcggttcaattagttgaactagttggcccgcacaatcgcgcggcgcacccatataaaattatatatttttaatatgattttgcttcaaatttattaaatagttatctcgttattaagattttaaaagaccaaaccttaccatcctcgtgtttctaaatttgtagtttttaaaagtcacactagttgataccatttacttctgtcatattattctttatttacttgctcgatctactactatttctattcattctttttggaacctttaaaaactgggcttcttcattatactcctccatgaccgtccactgcatcttctctttattgtcattgctattttaaaaatcgaacataattatcgtttaagtctatttttttactttatagaagttgcgctaaaacgtcagcgactttgttctctacgtgtacttctctacggctcgtccgctgcatcccttctttattgtcattgagattttaaaatcaaacatgattatcaaacacgctgcagcagatcacctatcacgttcagttattattacaggatgaatatctaaaaacagaaaaaaaaagaaaaaagaaacttcaggctcatgtgttaatccttacccaggcattctgggtcatatactcatatacctcaatcagttttaagaattactccctccgtcccagaaaaagacaaactctggtttccgtgtccaacgtttgaccgtccatcttgtttgaaaaaattatgaaaaaaattagaaagataagttacgcataaagtattaatcatgttttatcatctaacaacaatgaaaatactaattataaaaaaaattcatataaaatggacagtcaaactttagcacggaaacccaaggtttgcttttttttttgacggagggagtacagtacatgcattgcagtgcagttatgcagactaagagcaagtttaatagtatagccctactagctccaaatcatctatagccaatgtaatagccaattcatataatagctacttactggactattaatatctggtcacacctgtcatacacacattacgtattggagtccgtgctgtagctggctacatatctgtagccagctgctcttctctcttcctttatcttcttaaaatatgtttatagctagcttatagcctgctattatacctgctctaaatctagcttctaatcaaactggtcgcaggcattgaggtttccgatatcgttaccaaaaagccaaagcaacatttggcaaagcagaatgcttcctctgaactcgtgccttttcttttggagtattccctttgttccataagtcattttagttttatcctaagtgaccaagtttataaaagaatcatcatctacaacatcaaattagtttcattaaatccaccatgaaatatatcttgatagtgcatttatgtattattgtagcaattttctatatcctcagccaaagttagagaagtttaacttatgataaaactaaaataatctgtaatatggcaccaagggagtagaacgtaaaataaccacatgtgtgacagtgaaaccatcgtagtgccagttcatgcactactcatatttgatatggaggggaaccaagtttgatctgacacctaccttgatagatacacagcataaaaggggcaagttctacagacctcagaagtttgttctggactgcaatttacaagcaaggggatgacagggacgtcaagcatgaacgatcggagccaatgattcaccgtctagtgacagtaatcagttttgcgattgactctgattatcttgcttagtagggctttgcagtgctgtcactttttgcggctgtcgtcttctcagcggcagaagtgaaagacacagggaggtgcggctggtcattcactaccaagctcaagacctcaggtcgagcatagtggcccaccacatcaaaatcaaacttggctcgcacgatttctccaaggtctgcgaatgaatttcattacaaattttaatatgaattgtctaatcacaactattcaaaatttggtgccagaaaactgagggagcacataaacaaaattggggcaaatgcatgtacgaaaaacctagtacatatgcaattattttctcacctagatcagctgtaatcagcgcctccccttcgtagttgggacctgccaagacttctccggatggtgaaatgatgacgctacctccagggcagacaacagtgtctggagaaggctcttcacctaaaccagaaaatacatactccggtggtggaggatagtcctttctacggcagaattgatttgctgacaggacaaagcatcccccctctaaggcaatatgagtcatggaggcttgccaaacttgtctggaatcagcagttggagcacaatatatctcaatacctgtgtagtgcatacaatatatgagtagatgatgaagaaattcaagtgccactgccacaccagcgtttttattttttttcacatttgcctatctgacttattctgaaaccaaattcattttgttatttcaggaatatcatctcatgaaaccatgtcacttcctcataagctgtatgaactatgaagacttctagtggtattgtagtaacaatattccaagaaatagtcttacctttaccataaagtgctgtccgcaacagtggcattttattttcccagcaaattagggctccgatctttccaagtggagtatcataaacaggaattgttgatccatctccaaatccccatattattcgttctaatgctgttggcatgagctttcggtgcttacctaggtaccgtcctagaggatcaaagaagagcaccgagcaatacagagtgtaaccttccctttcaatcactcccatcactaaaaatactttatattttccagccatagcagccaagcgtgtcacctctgggcctgtaagtcagaagatggatatatcaatctagaagaaacaaaatgtatgtccacagtgatgaaacagctagaaagctgaatttttatgataaaacacaaaatctgttttcttatgataaaacacaataaaaagcatacaaaacagcacaggatatggggttattgatttgacaacaatcaatccatgcctggaaccagaaagcatgatcataacatctagctgaagcagtcgaggcaagtatgagtatcaataatccattgtagatgtttctccattttggggaaatcctatgccttacttgaacaattaccaaagctatggtcttttttttttttacatcagattaagtaattggatagatctttggtaacatctatgacttctttcccctaaaaagttctccagagtctaatatgagatggatatttctagtactccctccatccaaaagtgttaggcatatactatttttttggtttttccaaaagagatggtcatatttgtagtctccatatgctaaattaattgttgaccagaatccgaatagccatcttaatacttataggttgcatgtatgcatatagttccttggttttgttacatgggggatgagtgaattcctccttggtcttggtgacaaaagaaatatgccttacttttttgtatggatagagtattcagcaaacacagtgttgacagaaatatgcaatttaaacaatcaacacacacatatatatatatatatatatatatatatatatatatttctttttgatgataaaagggcatgaacggataagtcaatagcaaagaacactttgtttggcagggatcaatcctagcccgttccccatgggtggcccgggattttaagtgaattgatatattccattacattaccacttaccaggcacttctattgccgccgcatgatacttccggaattcttccttccccttgtcttttggattaccaatgcttatgttggccccaaagccaaatgtggatccacgaggatagccgccaacaaaagcttctgggaacacaaccaactgtgaaccatacccagcagcctcctctatcaacctctctgctttatctgcagtatgaatagcaatgtgaataataaacaatcgtttctaatgcaatgcatcgatctggttctcccaaagtgtcagtattggccttaatgtttacatgcataaagtagaaaaataatatgcattatgtgtctttcctaggcaatggcagtgattggaggaggtagtgccatagtgcaaaaggataggcacttggacatgaatacatgatcacacgagcccatgatgcagcatgctgcaacagaaaatagcatataatagagttttaacattttgtctggcctggcagaatagatcatttcactgggtcatataatcagtgggttattttagcagaataagaaaatgtgcattctgcccaaaacctgtgatacaaatgtgctcaccatttgtaaaatttccaaaggctcaacagctttgtttaatatccaaaggtactaaataaggctcaataacaaattaaactcttgaagaaagctcctcagttgaatactgggccagcccttgctgcaaaatctttcagtggcatgatttaaatatagcaaatactactaacaaaaattttcctacagataacacgcacagaacaaaaaattgtggcgaccattagttaggtaaatgcataatttacaagatggggtataacatacggcaatcatgacaattggcaaagcaaaaatcatataacaattaacaaagtaaaatcaaagtaagagctcacaaggaccgtgaacaaaccacaagaaataaaatctgatagatgtaacctatcatgatttcacctcaaatgacaaaggacatccaacaattacctccaattctgcgcatattgcttactcattaccaacaaatgacacctataccaaatctcacactgaaccctcttaattaataaccactagctgcagcacattggtgatttctgacttattttatctaccaacaacaacaaaagaaaattcaccaaagcaagggggggcacacacgagcgttgagcgtacgtgtgctgtgcttacctagagtggccggggtgtcgtagaacacggtggaggcctgcacgacggtggccctgaccgtggcggcgcccgagtcggcgccgccgttcatctccacctccgcaatcaccggcggcccaccgcccgagcccgaggggaccatagccatcggtacggcacgcgcgccgccgctcgaagtggacgcgggagaaatgggggccggcggcgaggagggagatggtgggggaggagctgaagctgaactgtcaagtgtgactaggagcagaagacgagggagcgaaatccatcacggatgcttctagaccctacaccttctccagcctttttccatggctgtaactttcccgtttcctctttccctctcttctttggcacgtgaacgaagaaaaaaataatttacaaataaagtttctcaagtttgagtgaattacgctttagaccacattttattacctaaacatatcttttcactttggaccggataaatttgccattgttgcaatttgaaccaccatgaacgattttttttctcgtgcaatcaacgaccttaaacacatcagctttagtatacggccgatctcctctatatatggttcatatgtttgccgaaagggaagttagtcatgacgagaaaagttgtttatagtagtccaaaccgcaacaatggtaaatttacccggtccaaattgaaaagataggtttaagggtggtccaaattgaaacttgggtaataaaaggtggactaaagtgcaatttagtcaagtttttatatctgtattgttcttggtatggaatactacgaaaatagagaaattcattagtgcataaaaactggactaggagtaggagagattatttcaccaagattactgaacaagttgtagtggccgttttgaactaagacggacaagaaaaacccacgcatggtaaagtgaacccagctcattcgacttcagtggagtaactaattagggcccctttacttgaaagaaaaatatagaaaaatataggaacttttattctgtatagaaacaataaactttgctataggaaatttctctatatgattctttgaaccaaaggattattgaaaactattgagtcttatcaaatttctaaggaatgcccaaattcatacaagttttggagtatttttaacatgaggttcaatatcatgcgaagtctcttatgagtttatctctctcatctaattcttgcatttttcgtatggtccaatcaaatgattatttcatatattttttatgtgttttataattatttgttttgcgcttgatttttttgtcagaattctatgtttttcctattcatccctcaatctttgtttcaaattagccctcacaagacatatataggttgcattggaccgagggagaaacgagaaagggacaattttgtttgtacaattgtacccctactttgatatccaataccgattttaccctacattttagggttgttgttttttgccctatttttttcaatgaatgaggcgtttacccctgtttttgatggaagtgagtgggattggacttagtgcggtaaagaattagagaaagaaagagataacgattttttaaattattgattgacccttttacccctataaaatatccaagtaccgcttggtgtccctccaggcttgggcacttggcatcaactcttcccttcctgaacccgaatccccgttgtgaaacagtggcggcagtgtccgtgggccggccaggcaacggggacaactcgagcaagtgcaggccacccaacccagttgcagtgtgtaggaggaggctaggcattgcacaagaggccatggtagagaggaggacaatggcggctgctgtagatcagcgtagggaggaggtgcggctgctcgacgtgtcgaggaggcgacggggaggaggacaacaggtcaacgacggcggtggtggctcgatgaaaggaggaggcgacagtggcagcttagcgcggggaggtgatggtggcggctcgacgtggggaggaggtggcggcggctcggtgggaagaggaggcaacaacggtggcggcggtttgtgagaggaggcgacgacgacagcttggcacaggtaggcaatagatttgcttgacttgtctatttgtttttttcaagatgtcaaattttgaagcaaatttttgttgatatttatgttaaaattatcatattagtaaaagtttatcgaatttgcaaggttcatgtgctaaatgtgggcaaattctcaatcatgaacaaaaacaggggaagtttgcaacatgagtaagggtattgaatgccttctcgctaaagatttaacatcgttaatctgtccatcaaaagtaggggctaaatttatctttatttcaaaaaaccatgggcaaaaacaaaaccctaaaatactgggcaacatcaatattaaacattaaagtaggggtaagaatgaaattgccccaaagagaaaaggttatataatttccatagagaaaaacacaggaaagaaataatataaatcacatgaatacggatacaaaataaggaaacacaataattgtaaaaggatggatgtttgcaacgtagaaattttagtgggtgatttgattacatcctgttaatcctcttttagtctctaaccaagtatgtatcattacttctttaatcctcaatatccggtggtaggaggaagcaatagctgcctgagctttgccagccgtacagcagcaacgcgagaaatcacatagcctgctgtgctcccatggacctagggcctatttggattgttgccttaccaattttttggtagtgccaaaatgtagacaagttttggcactaccaaaactttggtaaggtaaaattgtacttgatcatatttggtttgctaccaatatagagttaaaatgtgaaattttagtgaagaatgttctagatgacgccaaatctagattaggtattaccaatgaataggcttcaatccaaatcaaacacaattactattcaaattaccaaaatattggtagtgcatgtttttggtagcaatccaaataggcccctaattgctcaatcaatagctcgatcaatagaaacttctggacgaccttctggacaaccgctgcacgcacgcacacgagcgtttcacgctgcacgtgcgcaaacaggatcaagccgtcccgcgaaaccggtgttgccacgtagcacattgttctttcaattttttgcatggaattcgtattataagatttggaacaattgttagccacagcgaaactgatggtagaaatggaatgtagaatactgtatgatttgttggaaattgaatactgagtactgtgttatcgcaatctacatttgggagttgggacgtcttcactaacgaataagaggaagaaacatgacacgattttcagacgagtattacagcactataggcaccaattgtttatcagggaagcatcgtctccaaatctttacaagaaactaaagacagattattcatggggatccaacactggccagctgacaattttattgcacaccggatggaagattaatggccatcaggtcctaaagataccgtcactctttgcagcaaaatttttctctgcagcagaagtaaaagaaacgggcagctttgattcggttttcacggtcaggctcagcacctcgggtcgtgcatagtgtcccacgacgtcgaaatcaaacttagctcgagcaatttctccaaggtctgcaaaacataccatgcaatttctctttagtgttcttgtggtgtttcacggttacaatactgttctttgggcagagggttataatctgatatctgtagaaataattgcacaaatacagctggatacatctacaccaactgctactacatatgaaaaaagggctgggatgtagtagtcaacaagtgagcatggaatttacttgaaggttccacgtttcttacccaagtcagctgtgaggaggccctcgccttcatagtttggacctgccagaactgttccagatggtgagacgatggaacttcctccaggccaaataacagattctggggatggctcttcatcaaggccaccaaaagtatattcaggcgctggtggatagttctttctgcgacaaaactggtttgcagaaagtacaaagcatcccccttcaacggcaatatgcgtcatggaggcctgccaactaggcgagaaatcagcagttggagcacagtatatctgaacacctgcatgaatgtagaagatacttcaggtaaaatataaactcaagcacatgatacatggtgcatcttcagagtcactcaaagtacatttctccttttttttttcaaggtagtagtgtctaacaaatgaacaaccctagtatcccttttgtggtgtcttaactcttaacttctttgcattaccaatcgatataactttaacccagagtacttgctcaggtcgagaaacatatcatattgctagaactaggaatacctttagcgtacattgctgtcctgagaagtggcattctgttttcccagcaaatgacggcaccaatcttccctattggagtatcataaacaggtatagtagatccatccccaaacccccaaaacactcgttccagtccagtaggcatgaccttgcggtgtttcccgaggtatttccccagaggatcaaagaagagcactgtattatatagtgtgtaccctaccctttcaaccacccccatcaccaagaaaatcttgtattttccagccaatgcagctaagcgggtcacctctggacctgcattcaacagaagtcggtaaaatgtcttgcaggggcactgcatagtgcatatcctctgtagcaaggaaagctagatattaagtggggagaaccggagaatagctaaaaaatgatgtaagacgtattttaactgaattaattgacggaaaaaaaaagttaagatggatatgatcaacacgaattctgaacattactacagaaaaaaaaaagggcggttactaatgcttttattcattaatgcatagctatcatatatgattatcagcttgggatctgcatcacgagttaggtctccttatcatttttttttctgttttacctttcacaatttagggaacatggttgaaattgatatttcagggtttatacttcacatttagcagtgtattttcttttttttttagataatagcagtgtcttttctaatagattgataacctaaataaaataaagcactgaactttaaaaaaaaaatgaaaatgataaagcaaaagaccttggtttggaaacactcgataaacatagcgtacgacaacgatatattaattactaaactatttcagaataccaggcacatctatagcagctgcatgatatttatggaagtcttcctttcccttggcagatcgattgccaatagtcagtccaaaggtagatccatgagggtaaccaccaacaaagacttctggaaatagaactatctgtgaaccatatccagctgcttcagctaccagtttctctgctttatctgcagtgcaaagcagttaaagaaattagcataatatcgttaccccgtttatttaggattttattcataaaaagtaacatgtcatatgatcatacatttacagttttaattccattgaactatttacttgtttcattctccactagattaggtagataggatcattgcagataaatcattaattacctcattaaggccatgttcggttaatccactagagggagggattggataggtaaccccagtaagacagccgtttggctttcaatataagccgggtcgtaagaccttatttctaaaaataaaaatattggcgcacacggagatatcctacttcctgcccagtttcagttcactcccggtgttttgcgtgtgggtaaattagtgtcgctgtgcgggcgagacaaataagcaagcaccttgcgcgcaccacctaatccaaacagccacacgggcgagacaaacaatcgaacacctcgcgggtgatactagctgcagcagcagcagcagcaacagcataaacgaagatggcagaacgcaccgagagtcgcaggggtgtcgtagaacacggtgcaggcctgcacgacggtggcacgcacggtgccggtggcaccctggtcggcgccggcgttcatctccacctccgtaaccaccggcccactgcccgagctcgcgggggccaaagccatcgctcccccacccctcccaagaaattgagcgggaaggggatctcgttggggggagggggggaggccgtgtgctacttgtcgtacttccttttgaggtaatcgcggacgaactggtcgcgggcgagcgtgcgcgcccgctggggctcgacgtgggcgtaggagaggtggacgccgtaggcgaggaggcctgcgccgaaggcgaagagagcgacggtggagaggagctgacgaggagtggacggggagcacaaccccatccgcgaggagtgtttttggtggggggaccggattgtaaaaggtgaatgcgacggcgacggcggcggcggcggcagccgcgactgattggaagaggacgagtggacgacccgagtaccggctgctctttcgatcctccacctacgtatgtttcttgactaacaatttcttttaattttgtatactttataattattagcatataggagattttaactctgtatattttccatactttacaggagatttttatctgtattttttcagtggagtgataaccatttgcttatagtatattccctccatcccaaaaaaaagataaaccgtgggtttccgtgccaacgtttaactgtctatcttatatgaaaaatttttataattagtattttcattgttgttagatgataaaacatgattaatgctttatgcgtgacttatctttttaattttttttataattttttcaaataagacggacggtcaaacgttggcacggaaacccacagtttgccttttttttgggacggagggagtaggggccaggggagaagtttgcacatgtatacatgcacactcacacatcagcctttatacccttacaccgaattttttaaagaaatactagagtacacgttaaagaaattctacccatcgtttagctaaattcagataatacgacatattaacaaaataataataatttatggatacgtgttcttagtggcataaatgctaatgtaaaaaaataaacctctatgaaaaactttaaaatcaaattttaaaatttgaaatttgaaatgctgtacagaggaaactacgatggggcctgagctatttcctgtatatgttttaacagctcatattattttgcatctacgcagtaacgcagacatgcacatgttttacggatgcaaactcaaccaagatattccttcgtgatctgttttgactgtttcacaagtactgtcagggcaaatgatatgtcgggaggagacacaatatatgcgccaaatacctccttagaagagaaccaaatacaacattcacccaacaatatcttgtttacgatggggattcaaaagtaggtccaccacttcatctcatgcatatcactgaagcaaatcagtttacaataggtttaagtgacaaatggtaagagacaagaagcctcatgactacggctcaagagtgtcacttagaacagtaaactatcaaatgtcaacagacaatttactccacctcttccaagaaatccttgatctctgccggggttagaactctgcattttgtacagaaagtaacttgtcagtaacttgttatggcatgttcacaagacagaagttgcattgcatatacgtggcagtaaaaaacagcttgatcaagtctgtatgacatacttgaattcacggtcagatcgaataactccaatttcaatattgttggctgagatttgaccctcatatctgcaacccccgaatcagtcagtaactcagtaaggatgttccggaaatagaaacagaagcacctacaagacatacccttctttcagagtcaaaatggcagtatggatggcatcatcaagctccatgtcttctgtgtatctgaaatgaggacataaagaggttgaacaacagtacaagtgcagtcatacaactttggaaagaagatatcctcgtaaacaaatccactttatttctgatcagattgaggaaaacagagtgtagtacaatacaatattagtggtatgctatgtaccttttttcaagaaatgtctttgcattggagacatttttccccatagctgatgctttccaggagaagtatgatcctgagggatcaacctgtagaaataatacagcacatctggcattataccaattttacaccataacaaaatatgacaaattgacaggtaaaatttcagtccagaagaacaaaactagcacaactaatagtggtgatctgctattagatgctttgtgcaaacaacactttgcagcttattattgagacaagggtcaacgtacacattaattttgaaacagttgcaacaaaaaagagcccctatcacgcagctatctgcatacctgatacagctgtgggccattgtcatcgtacccggcaatcaataatgatactccaaatggtcttacaccactgcaacaaacaagttggccgtgagtcatgcctcagaaattcggttacatcatatattcatatctttaaggagtgaactgtacttcaggattcaccaatcaacataagaaccaactaccacatagcatgtaatgtgatttataacaagatgtatgtcttaattattcctctgatgtttttttttcttttttgtttcaatgatgtcaaagtgaattataaaatgcaaatgactggaaaatcctatgtgttacaggtatgaaactacccaacttgcttggttacattagcaatttaattctcaatggcccaatttcaataaaattttatccatccagtgaaaatccaagtggaagttcacacagcagatcatatatattcttcccagcaggtcaattaacaagcttctgcatcaacacacatcaatgtgatgtacatgttgaaagttttcggtactgaacatctgaattatcgaatacaatattgaatgaatggtactgttaagttatagtaaaaatatcccacaaatatatccatacaaattaattaggtcgaacaagtgcaagaatatattatttaacaatatcattgatagaaatggaaaactctgaagtagcatacccagactgtgtgaactcctgcataacagcagcagtttctcggacaagctgagtaacagggatagtttcctgcattagaaaaaggaagaacaatcatgagaaataagtaaatgatggaaaagatcatgactgtcgtacatgaaaaattgcatgctatccgaaatagcaatttattgaaaaatatatgtctttacaaaacatacaatagttatctgaagtataaatcaaatgaactgtaaaaaaccaccttgtacaaccgataatactgctgtgcttgtttccgactttttctcacaagaacacggaaatcgggacccatcccactgaaagaagtgcacaggtaagtaaacatgtattattgaattgcaactgatattaacagcagcaagctgagagatgtaacaaactaacaaataatttaaagacagaatgcagctgttctctcagaccactgtacaaggctgcagatggattgaagaactattttttatgctttagtccagtgaatagataaactataaataccttacaagctaatcaacaaaaatccagagatctgcatgctcattcaccaagttgcctcaaatgtctagatatggatttccaaagttactgcaatctgatgtgcatataactataagacacagtaaaataccaatgcacttatcctcttgcaaagtttggagagcaagatagatatttttaatttgtgcctttttagggaagattaatatgtgcaaatttctcagggcgaactgtgtcacttgttcactaaaaccaggcggttcaaaccaattatttatattaccattatattcttacacaatagctcatctgtgaactatgtactgctaaaattgtagaagcttacagcacagctagtgctcatataaaggatcaagaacataactaatagaataacaagttggaataactcacaatagcatgtacatgacaaccataatatatacaaaatagaaatgtattccaacaatgaagccaatgtaaaaggttacctgtagacaactccaatgttcggagtcaatgactgaatcttttgcacctgaatttgcatataactatgtattagtgcttctgagaaacaaacaacgaatagcatgtcgcaactcactaaaagaggaattcagcattaagagtgatgttagacttacagatgtttcatcgactaaaatagaaggcaatttcttctcagtggcgataactacaccattagcagctgcaaacataacaaatatacctcagaatcaataaactaggctaaaagggaactgaagagaatcaacagactgtagtctctgagcagtaactacacaaaaacatatgatagaacaatctggtaaaaacatatgcagtatgttctacaccacaaatttattacatacaacaattacatctatcagcgtgaagaacgcatgtcaaatagtttctttcaatttttcatacaccaaaacaaaattcatgggctaaaaccccaagactttaaattgcataaatactgacaagtggcaacaaaagctgattttaagggtatgtaaacctaccagtaaggtggacgttgacagggcaaacaaattagaattttgcactgatactaaaatgggcttccaaaccctaataggcactagatcagactgcacacacatacaactactaatgggaaaactaggtcagcatatacattcaacgccgtaaattggcatagaaaacttcatcatcacagatgaaaccaagcagcttgtatttcttatgtggttataaaggggagcacttgccattgctgttacaagacatacatttatgtagattaataatgattttccatggaatccacaagcatttgtaagcgaaaacgaagcaaacattacaaaattcccaagtatcactaaagcagaatagcagatgcaagtaacatggcacctattagtaacctaagccgtagcaaacttcacactccaggtctccagaacaaataaaagctctgcaacgacctaaagttatgcgaaaagtgcaaaatccccaacaagcgccacttcgtcatgtgaaccgaaccagccaaaatctcaaacctcccctccccttctcgattctcataacgcaatagaagtatagagaagggattgcttcacgggacgcacctttgatcccgagggacgtctggccggatccgaccgcggtgagcgcgtgctcgatctgcaccagcttccccgacgggctgcaaacgaaatcgccacaaaaaccacagatgacgaaaccgaaaccgcaccagatcacgcccgatctccgggcgagggaggcgcaaggcagcacatacctgaaggtggtgagggagaaggagtactggctgtctcccatggccgccgacgcgcaggcctacctgtgagctgctgctcttcgtgtctcgcggcggaagaggaggcgaccgagcgagcgattgcggcgagacggcgtgggaagggagagggaggcagagcacaactcgccaaggaagaagaggagagagagaaagagactggatggatggattgctccgcaagaaggtggtgggtcttgggccggaaatctggcccatctgttattgggtcagcccatgactcacccacctccccgtcacgtcgtcttcctcctcataacttcttccccacgggccaacggctgcgcgtcttcccgttcgtcctcctgtccggtccgagtccctctgacgacgcgactttccccacgccgggatcgagctccggggaggggagctgcgagctggtacgtacgcttgatttcttcccttgccaccgcgatattccgatgtatccgtgatgtgtcgttcatgggtagatcggctagggatttggcggcgttgaggaaagcgatggctgccgggtggggggaattgttgtattagactctcgaagctgatatctggtgtggatttgcggtggaagccatggtcggaggcccagtgccttccgggagttgttgggttatcgggagcccggagggcagtgcggctcgccgactgctgccatgatccccgtcggcaaaatctccagattgggggagatggggggtaggaaccatttggattagtagtgtatacacggggtttcgtttattatatttagagcgctctacatgtagacagcacacagcagctttaacgtatggatggtgtatcgcagggaatgtatctcgaagacattggattaggctattattacatttagagaaccagattgggtttgcgataactagaaattgagtctgttatgaatttattgatggagcggacagggaattacgattactatctgtttagcttttcagttgtgaatgatgattatttcaatttagctaatcaaggttcctcaatcaaaccgttctaactttttctatttatgctcttggttacattttgacagaaacactttgtcatatcagtcaacagtagagaggagaccagatgcaggtcagttctaattcatctttggttgcacatttcttgtatagttagttaggtatgtaatgtgatggccaactcttaatcaactaattattcgggttatgttttactggtctcactgagacgtccatgctaaggtggtaacatttaataggacaatccacatttggcagcaataactgtactcatcttttcctttagtaaacggtttggcgcctagtatagggctcgcgtgtttgcatggaagagttggcactcggtagttggagagctttgccgacggttaccaatgtgaccagtactggtttttgtacacccatactttcttgtcgtcatacactagcaaaagtttgtgtacatcccttacttttactaatggctcaattatataacttgatttacttcactacaataaaacttataaatgtttggaagatcatgtccaagagactttcagtattattgttaactggaatgagcttaactactactccctccgtttcacaatataagtcattctagcatttcccacatttatattgatgttaatgaatctaggcatatctatctatctagattcattaacattaatatgaatgtgggaaatgctagaatgacttacattgtgaaacggaggaagtatgtgaattgctcctttagtttggttcctaacatgctatctgaatgtcttcaaaatattttctatcgaaaggcatctagagctaggctctttaaggagtataaggaggtgcagcgagaaaagtcagctgatccagatatccagttaatctgcgatgattcaaacatattcaagtggactgctcttatcaaggtggtttttatattgcaacttgcaaggtgatgctagaaacagcaatataagtttttaactaatgccttttctgattgtatatgttgttagggcccttcggagacaccttttgaaggtggtgtatttcaacttgcattctctattcctgagcaataccctctccttcctccgcaagttcgcttcttgaccaaaattttccacccgaatgtgcatttcaaggttacttctgcattgccttctctgcgtacattttactttaggaaatttgacctatttgaaggcatttgtctctttcaagtgttggtgagaatgtaaatatgaagttgctgtcatcttcttcattttatcaggttttcctgtaacaatctgaatgtactaacatgacagaatttactgtgtagactcaactgtgctcttcctgttattgtttttgtcaagtcgcttctatattgttacatctgaattaacagaattgaaggagtaatttcagttatcattctttttaccttgtttgtgtttccagacaggtgagatttgcctggatatcttgaagaatgcgtggagcccagcatggacactacaatccgtttgtagagccataattgcattgatggcccatcctgaaccagacagtccacttaactgtgactcaggtagctccaccttcctactaattctgccacatatagttcagccattattttgtaatgtgaaagtaatagatgttcatgctctcactgaatcaagctatggtgcatgaagatttccatcttcgaggcctcaaccactccatgatgtgatctttttggagtagtttgagacatgaaaatatttggttctaattattgtcacatggtacattagccagttaaaaaatatggagaaaaacttggctatttactctaatggagcccctctatataaccaaaggaattacgtgataattgatatggtcagactccagtatcaccgttgtcctaggcgagggccaatgagtcccaggacgaggctgagtccacctcgggtggcgggtgtgcttgggatgctgattagattagttcgttacattgaaatagtatatctttccaattgttatctcttcccagttagagtccaacttgtaagggccattaaaaggtgtttgctacatcatcgcgagtttcaagttccttgtcctcattctttttatgcctcatagttccatgccgcctactctcctgggaagcctcatcatccacatgtcctaatcttccgcacacaacagaagaaactgatttatgtagttacaatatttaattttgaggcggtcagagaaaccattcctgctgatccattttacgcaatatggattgaataattgccttgtaaatatttcattgttggttattagcatttatactaatgagctaagatgtgcagtgtcacttatattgtatagttcctcattatgaattagaatgtaattttcccagtaaatttgtattggtcccattcaccgcctcacggtttatgtttgagattttttcagatggcactttggtcacattgcatccaaaatatgattatcataggtcaaaattatgaattactgtatttgataacttagggagctcttgtgtaatttcatcatctgatgatcatatacagtttgtcgcttcaagcattttgcaagtccgatttctgattgattatatagcggtttaaattactttttcatactttttacttggttgtttgaaaagaggcctgctgtgatattttaatccttatcttagtttctgctaattttcttccgtaaatataggcaacctcctgcgctcaggcgacatcagaggctatcaatccatggcaagaatgtatactaggttggctgccatgccaaagaaaggttaactccagggtgcaaaaggaaatatgcgccaagcgaaggcatggctgattcatgtgatttgctctgttaagtgtaactcttactgtcaccatgtgaacatctggtacttattttcttacctcactcttatggatgtatgccctggagtgaagagaagaaaaacatgcattgtaatgcttggtctatatgatgtcataaatataactgggttcggtacttctaatgcactgtccattgttcaattacttctcctctttttcctgtccggataaaagaagaatacttgtcctgtatgtttctgaaatcgccatacggctcctataaaacgccaggttagagccgcactactctaatcttctatgatgctgtcacgccgagaattcctttcatatttgctggtgttcagtttaattaacgccgcacacatacagatcacccgttgttgtattgcgagcatcgaaatcaatcaacactatatatgattttattgttatcgattgttccaatcgaatttccactgtgttacatgacttggagtcttggaccaaagaaaagaaaatttcctgatcagttggtatcgctggaaaacaacctagtgggcgcacgacgcccgttcctcgccatcgttgaagaaggcagactgcatgcgagcgactaggggaacgccgtcggaggcatcttcttgtcagccaagaagtggctgaagaggctgagcgcctgcctcggcgcgtgcaggggaacctcgtgcccggcgccgcggatcgtcacgaacgtcaggccctcgtagaggatcgtccatcctccaacctgcataaatggttcagtttgatgctcacaacgacctgtttctgaatatttctttgttgtaggatggtttaattacctgctgatggtcgtaccacggcgtccactcctgcaccgtcttcagcccaagcttgttcagggtgagcctcgtcgacgtcacggggatccttccatcggtgtcaccgctgcacccagtgaaactcattgtcagctcaattcaaacgccatgcatctattgctgtgtacacgttgttcagacatgctgaagtatactacaaggatgtttttttcacctgaaaacccagaccctgatgccgccggcgacgagcttacggatgatggggagagtcgagaagggagcatctctccacttgccgatcacgtcgctgcaacaaacacaccgtcacaaaacgattctgtcaactcaaagcttcaaagactcaaaagagaacagaggttgcaaacgcttattgtttgcacctgcagtgcgtccagttgtagccgatattggtcacgttggcgtgcagcgcctcctgcacgtcagcccggttgaagtacacctcggcgtgatccgacgtgcacggatcgtaccccgccggcctcatgtaccacccatgctgttacaaaatgacaccaaaaaaaaatcatgttgtttcttctctctgaaaaaatgtgatcgttctgtgtgccgatgagttgcctacgcacgtatttggagaagatttttggggcggcgccgtggacggcgacctggcgctggccgaacgccgccgacgacgagacctcggtgcagacgggggtgtagaggctgtacatgtcgatgaggcggtacacggcgaagtactcggtgagcgcgctgtcgcacgcgtcggtcacgttctccatgctgaagttgcagtacttcttgacgtcggcgtacacccggtccgagatgacggcgtggtcccaggcgtagtcgatcatgcccgtctggtccgtctcgtcgtccatcagggcattccctatctgcgtcagagtaatgagacgacgtgatcgaagaaataaaattgtatgagatcagtattagttcgaggcagaattgtgtagctaccatgaaacccttgaagttgatgtagttctccttggggccttgcttgttgccgtcgaaaatcttctccgaaagctgtggaacgtaatgccctgacaataacgcaatccgggaataatgagctcgcatcacgattttttcagaagctagatgctgaagtgtgtatgtgtatcagttcagttaccagcgtagctctctccagcgatgtagaagtcgtgagatttgtactgagggaagcgcttgaaccagttgagcaggaagatgtaagcatcatcagctgcgtgcatggcaatccgagttcagatactgtttggatcatccaaaattgaccccttttttttatcagagtattctgttgttgatgtagaggttaatttaccggtgatcttgtcgccaagctgctgcagatcggagcttgtgttagtgtatgagaagccgacacccacaggggactccaggaacatcagattggcctctgcagatttttaacagtgaacattcagttgtgccaaaaaaaaaaactctgaacccctgttcattgcgaggagtcagtgacagactaacagaatgcagggtttggcatgaacaagcagtacgtgcctttgttccacgagtacttgttccattttagctccggcttgcccttctgcaccaagaatggaccgagctcctccgcttctccatacccaacagacgaacacccaggccctgcagcaaaaacagcaacatttgtcatcctaactcaaacactcagtacacactcctgacgaagaattacacacagggtttttaagctactagctcataatcacgaacgaaaagagagaaaaaaaaaagaaacttcacatgcatggtgaacgtcgaccgttaaaacgttgcagagaccagtagatcagtcgtgtccatcccgcgcgagagacaacgacgcgatcacgagcacgagtacgacacggcacgggtcgccatccagtcataggccacaccacagcggaagcagcagcagccagctagcttagctaatggaccgaattattcgcgcatttctaacgagaaaccgagcttagacacagctcactttcgcgctcccgatccctttccggcgtcctgcctgcctgcacgtgaacgtgatccatctcattcgaccagttcacggcgtgcatgggtgactccgcgcgcggcacagtacgcagccacgcgcgcgcccggtgagatccagcaccgggccaccggcacaggcgcgcacagccgtggcccccgtgggcgctcgcgtaccgtcgtttcagatattttccccggccggcaaggcaggcagggaaggcaggcagcggcagtagtagcttcgatccgttccgtggtggggcgcgcccgcgggttgggctcgatcgggcacgcgaggtggtggccgtgtcacgacgcgcggccggtggtggcgcatgcttttgcttagctggtccccgcccgtgtagcatgcagcagtggccagcggtgtgtagtagcgtacgcctccgcctcagcgcgccactgctcgctatagaagtagcgatgattggtggccggtggcccggtgtgcgcgtccgtcctcctcggtcgcgcgtgaaagcggcgccataccgaccgacccgctttgtttcttgtctccatgtacatgatactacgtggaccgttggtgatacggtgcgtgcgtgcgtgcgtgcggccgtgcgctagcgagcacccccgtgcagtcgtgctccgtatgcctttccgggtcgatgggtacgtacgcgtagtgcggttccaacttccatataggcagaaacagaaggcgacgacgagtgaacttttctacccttttactcttttagtctctggaagcttgctctgagctatatatgtgggtaaaagggaatcggcggcaccaacagctgacggttgttcgtttttcacgtgtacgtttccaaactatatgtacatttttaaaaatattttctgtagaaaagttatttaaaaaaattacgttaattcatttgttaagtttgttttaactaatccttaattattatacgctaatggatcgtttcatattacgtgcgaagagatggaggttgccccaaccttcacctctaaacacagccaacctctttgttgacctttagaattttaagaagtaattggtaaaaaaatttagctggtgagaatctagaaaagctataaattctatctatttattttctaaattatataactacatatttttaaaacctagataaaaattagactatttatgaaaagttttagttttgaaagaaaccgtagctaccataaattcctaaaacaagacctaaacaagcttgttttggtctcctctaaaaatattaaataataggttaatactgcacacaacagggccaagtttcctttaaaaaaaagaacaacaacaacaagaagaagagagcgcaagaacagtaagtgtctctcctaaccactaatcggactttgtcggatggtgtgtaattgttctttcctaacaaatcccaactaacaaccataactacatagaattttcaacgttactaggttctgactgacatatcacagatgcttcgacgccttctgattgagtgcaaccaaaaaactcaactgatgcaagcaagcaaaatgatataagcccccagaccacctctgccactttgcttcagatgctggcaaaaaccgcgcggcttaattcagatcccgatgaggatgtgaattgtgccggaagatcagcttatcgccgggaaacggacacccgcgaggccccattggctgcgtggatctccctttgttcccggagcaagctagctgctagcctggctcgtgttgaccatgccaagcaggattggctatccctctggttgctaccagcaaccagtccaaatgcagaaatccagcagcatttcgttctctagctgctgctgcagctagctcgcatggatcgcgcccatccttctcgatcgaacgggggtattcatgcagtccatatcgtggggggtccccgggcggcttgtcttggaccagctgctaggagagtacgatatgctcttggctggacagcaaatccgtctggctagcgagctagctcatcgatcaagcggatggattcaccggtacgttcgtgaggatgagcaggccacagtgacagtggtggacctcgtcagacttgttctgtgctaacttgaacgtgtatttggctaatttttcaaattggaggtgaatggggctcggtctgtagtataattgaactgggacaaacactgaactcaattcaaaacttaatcctgccttctctatctagtagattaacttatctcatatagcaaaaaactgaggcaccacaaattatactctggaccgtgcaaactttctcctaaagagaacaaactagctagttactttccaacccttcaattttccaactcttcgtctccggcgctttcgactgggacggcgcctcagagcagctacatatgtatgtgtcctctagttgtgttttgttactctcgttctgatttttttctaaagagaaacacggagatgagatgttgacatatgcaacgaataattacaatatgcgctgttggatgagattcattcggatagagtgaacattggagggtttcaggctgagtttgagaaagaggagatagagaagattgggaagatacgtaaaacgaggtgagctattagtgcatgattaattgagtattaattatttcaatttcaaaaatggactaatataattttttaaagcaactttcctatagaaaatttttataaaaaatacaccgtttaatagtttaagaagcgtgacgcggaaaaaaatgtgcattctatctccaatctcccagaacgaacgctgcctcaatcacaggtttttggaagccgttcaggggaacgcccggttttggcctcctaaactagttttagcatctgaaccgttatggtgcagacaatgattttcttttcagattttctgatagtaattttatttttgaagagttttagacaataaattttttgagacaatttacatttttttaaaaaaaggataaaaaagatgaattacatcaccagcctctgcaactaagatacacagccaattgaaggcgacgagttgtagactaactaactaatatttctttttgttacgtaggcttcaatttgcacaggaatattctggccagtttttgtgagcaatagccaattctgaatccggtgatcactgacaatggcgtacctggctcaaagctacggccggagctgggttacgcgtgtggctgaatattgtttggcaatgttatgcaagttggtcaaataaatgtgataagtcgactgtacattagccattgaaagagactctacgcaattaaggtgtactcttttcgttctaaaatataagagattttgggtgaataagatatattctagtattacgaatctgaataggctctctgtccatattcataatattatcatgtgtctcatccaaccaaaatcttttatatattttaagatggagggagtaggagtatgtgactaaagtaggtacttcacttgagttagttataatagcatacagactattactccatgaaactgccaatagtgaattatgctagctggaggacaaccatttgatgggatagcagatggctcctcttttcgcttgaaatgctgattaattgattggttagttgggcatggtgattgtactatgatagacacttgaaacatgcattcacttacgacatgtcacaattcacacatactgatattgtcatctctacccgagcctcttaatcactacgatatcatcaatgtatatatacttcaaaacattaaagaagaaatgtctagtttgagttttagaggtaacgagaagatcacatcttaggattagtcgattagatcattcccagcaacatttttatagaaaacccagtatcatttttgtgctccagaaaacctttaacacccagcgattttaagttcttagggtaattttatcatccttaaaaagatactagacgtactactctttttagtataaaatttgctgtaaaatcttcgtacctccagatactttctcaagaagtaaaaaaattctctcttacgtaaggtaaaaaggtatcatactttttaatattaaagatacctggcacacaaaatttcgcactaaaaataattttagaacatttcggaacttcgaattttccttaaaacactccgttagaaaaaagtgagatcgccattctatcttcattcgtaattaacatcaatataaatataagaaatgttagaatgacttaaattgtgaaacagagggagtgattaataccgagttaatgcgcacacaaattttgtggagcaaaggcaaatggcagttggtggtagaagtggttaattgtgtgtcgagtgctagtattacgtaccgccgttgagccagaggacgaggggcttcttgtcggcggcggcggtggcctcgaagaaccagtagaagagcgcgcggccgtgcgtctcgttcaccgtcacgtacccggcgtactgcgcgaaccgcacggcgggttgccccggcagcctcgtcacgcggtcggcctcctgctgccgcgcggcctccgcgtccagctgaggcgagccgccagcggccgcggcgcagagcgagagcaacgcgagcgcgaggaaggaggaggagacggcggcagcggtagcgccggccattgttgtgtgtggcgcgctgtatagctggtgcctaccgtaccgcgcgctagctgctgccggtgcatcgtcctcggcggattatatatagagagagcaggagcagtgagcacagtttgataatgacaaaatttactaaatacattgtttactatcgacaaaatttgatcaaataacctctttgtgatcgcattgacgacataggaaaaatcctcaattctaacggaggtatatgaccaaatatttaatatactgtaattggaataatattgcaaccgtatcctgcttacggctactccagtagagtttacatagccgaggtgataagtggagcgcttctaaattataaatgaccattcctcaatcctaggatatatgatactccattcgtcccatcttaaatataactattgttttctgcgtctaattttaattgtttatcttattttttttaaaaaaaaattaaaacataagttacgagtaaaatactattgatttttatcatctcataaaaaatactgattataatattttttaaataagacggacgatcaagttgaacacggaaactcatatttacatttaaaatagaacggagggagtagtacaggatgtttgtctgacacaccaacagaatttgggagaaaacgagaaagcaaatctaaaaattaaggcctgggtatgcatgtacgacacatatacacgtaaatggtgccgtatctaaaaatactaatcgaatgaaattgctcccaatcagaaaaaaatacaaaagttggtttattgaggacaacggatcgaaatacatactatgtgtttggtttatttaaactttagtctaatactcaaattaaaaatatcccaatgcttggacttcctgaaactcaattcaaaattgtgtttggtttgaccgagcaggaattttagaagatttttagttgctataattaaaaatacccctatgtttggttttatgtactcttgtgctcactctggttataaatatttagtgtttataacaaagttcgctcatacctttaaaattccgaacaccaataatttctcacatgcttaaatttaaaaactaaataaatggtttaaggttgttattgaatgttcatactaaatatttgttggtgctatctatactacttataaaataacaagttttatacttgattttcatacattttaattctttttttgcgaggtcatattttatttatgtcacactggagtgtcttttttttgctttgattgtcactagttaaagccctttaatgagtacatatcattatttgctttgattgtcaaatactctgtttcatgttgttattgtactctacgtatgatgctcgctgcagttaatcacatactaaattcgttgctgatacgctttttttttctccagagagaatcacatgcagtgctttttcagtaatttgagatatcacagcattttttttatctcgtactgcaaagcaactattgagtggcaagcaaaaattgttcataacttgttttgagggcagtacatattcgaagctgtcatgcagatatcttccgtgcttgtttactaacttcaggagatcataaaagcagtctctgaacttgacgttttgtgggtggatttagcgtgtgcagctaacgagtaagaactgagatcagtgttttttttttctgtgtacaacatgccaaaacattgcatggatgacggaaagaacagtattattttgagattcgaagttctggatgaactttgcgccggcctgacagagctttgccggacaactttggtcttggcttcgtcgttcaaaaaaaaactttggtcttggcttcgctttttgtttcaacttaaattttaagctaaattacagtaagaaggtgtgcgtgtgcgcagtatgctactacatcgttttgtccgtttggaaattacagagaatgcacttccaagctccaggaatcgattcggcatttcggccggcacatgtctttcctgaatgtttttgttttgccaaaactttttttttacagaaaattcgctccctgcaatttaggcaatttggtaaatcttgtactaagacaagcaagtcaggatgcttaattttagagttaattttgatgtttaatttactttttttattggtttttaataagtcgctaaaaacatatatatatatatatatatatatatatatatatatatatatatatatatatatatatatatatatatatatatatatatatatatatatataagttacattgataagtcatttttttccattaataagtgtgacggctgatagaaaacgatggagctgttaactgtcaaacttgtattgggaagagtagggccgcatataaaaaaaaattcctaagttatcaccagaaagatgggctatcaagattcaagcaggaagcaaattctgatttggtcaacagaatgtgtttttattctatgtgattagattgaatacatctctctctctcgtattccgtgcaaaggatgatgatattattttttttaaaaaagagagaagtactataattctagatttcttaagatactgcaaataaatatttcttcacaatgtttgtacttcaaaaaaaaaaaaactccacgatgataacctaagaattgcacatatagcgacatcatcactgaaaatgtagcagtttcagttgtgacttgtgggcacaaaccaaaccattcttaaacttaataatgaagcaaaatgtgatttggcctgaatatgtttgttctagatggttaaattcaatactatatctcaaaatgtaggcggtacaagtctactttttatatttgacaattaatacacgtggaaaacatgtaatttggttacatagaaatagtattggccatcattttttttcttgagtaatacttatataccttaatatgctattataaattgtacttctaaaacttcgacaaaaatctaaaacatcctattatttgtaacaggtgaagttcagcaattaaaaacatcccttatgctcgaagcatcaggattctttagtatgttttaaagaaaagttcaagtaagaaattagatattcaaggaagagaaggcacgttaaactaacaagtcaacagctcatctcatatgccggaccatttaggcctggtttaattcccaattttttttccaaaaacgttacattaaatctttgaacacatgcatgtagcattaaatatagatataaacaaaaactaattgcatagtttgtatggaaatcgtgagacgaatcttttaagtctaattagttcatcattagctataagtgctatagtaacccatatgtgctaatgatggtttaattaggctcaaaagattcgtctcgcggtttccaggcgagttatgaaattagttttttcattcgtgtcaaaaaccccttccaacatccggtcaaacatccgatgtgacatctaaaaatttttttttcgcgaattaaacaaggcctgaatcaatcatgatcgtcatcccctcaagaaatctcattagttgttgtcagtatattgcaatatcaagctttgatcaggtggagacaaactccgaccgaaactaatccccaaacactagctttagtacaataatgtgtctcgttgtgctgttgctaacctattttatgtcaacacgttgcgacaaactgacagcaagcttgcttgttctctcaataatttggttttttgttccattcccaaatgagttggcaacttaattaactcgcaggaggatagatacttcctgtaatgataaacttgatttgatgctcttcatcaattgaatattcagctccaacagaaaatgaatattcactattcagcatgttgccaccaatctgaacaagtgatgctcgatgtgaaagcgaaggcacaattgcaaccccaaaataccggggaacaacacaagatttaatcctggagatcataaaatacattggccagctaacttggtggatagtcttcctccgagcaaaatcaaaatcttaaggcttcccggagtaaccatttgaccaaagtacatttcttatcatcttagcaaagaacagtgtgttctttcagaatcgattgagatagcaccagtcaccaggcaagcatattccaaggagatgagcagaaacacgtccatctgcagacagcaatacagcatggttcaatggagtgcatagtcagcagtcaacttgcatacatgacattcagtgaagcgggaatttcacggaagaacgggtaatgcggcaaagaaggcacaattagataaactttggccatgcactatagcatgagttcagttcaggacagatgagcaccacaatactggatacccatcatgatattgagcaacttgaagcagccctaccagcactactactactactactactctatatgacgatcatctcaaaggaaatcactagataagaaataaaagctgtatttgctcatctttcatgtttcagatgtatggatggctatagcaccactgcaccaatgaactaatatttgcttggcaaatgatcaagaaaatcaaactatcaaactactattggactctatgccatgatattctaatcttgaaatgccaaaactagctggcgaacattctaggacaactctagtacttgacagtcagattaaaaggtaaatcaattcaataaggaaataagttttgtacttgttacatataagaaaacaacgaaaggcaggcagcaaaaatgtcaggattcccttttctatgcacaaccatatgatagtacttatttagcaaccgtaatgatatatccataaccattgatgaattatttccccgtaagaatattgggattaagaacacatagttcccaggactaatgaccatgtaactggtagtttggtactcatattttttatgcattacaaaagccttgtgagaagagtatagaacaggcactctaccaaaatggtaattaagatcaaggactccagatgagcataataaaattgccatctcacttcagaagctaaatcactcccagttgcaatttgccgatcgacaccgggacaaaaataattgttagaaagcaatgcaggaagaattgttacaggctcacagctaagatgtgcaaaactagctccatcgtctcttatcctcttcttcatcaactgggatataccactctggtcgcttcttcgagttgctgtaccggtagttcaggaagagctcttcatcacatatggaccttgtactcaccagcactagagtcttcagaactggagactccccttcctgattaccagaacgtccagacttgaaccagaatgaaccaaatcgtttcattgtaacgggctcttcttcaccaccaaaagtaatgttagggatgtagactctcatgtccttctctgtcaatggaaaatcatatgggcagatcatgacattgggagttgacccttttggtggatggtttgcaaagtgaccaaaagcgagtgggtttcgtcgttcaagcacttccccaaaattttcagtgtgacccttcttcagaggcttgctgagcatcctccatgccctatcagagttgctctcttggcttttggatggcactgcattgtaatccaccaaatctgagccatcccatatttctctgctatcaccacctaattgccatggtttggcatcaattattgttccatcataccttgtgatcagatagttgttgcacgcgtcgatttttgggtatccagggatatatcgataataagcaggtgaatatacaactccagggtagatggctaggacagcaccagcattagtttctccagataagaacagaccttgccctgcatctttgtgagggatttgtgacggcctgatgtcaagggtgtattgaaagtgatccctaaatttatttgacaattcagcgcgatttaaaggcctagtagaagggacatctgcactgcagagtaaatggatcagaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagggctgcaggaa

SEQ ID NO: 1431 - DNA, 362 bp, Oryza sativa
cctcccagagggcggtaggcgactatttccgtcaattttcaaaatggaaaattatttttgtaaaacttttaataagaaaaattataaataaaaaaaattcccacagcagagagcatgccgggcggagatggcgacggcccgagcggcccaagcggcccaagcagcgacatcaccgggcagagcagcggcagggcttggcgcttgccggtgcaacaacggcaaggtcggcggcgcagtagtgggggactgcgggagctcggcggcgcgatagcagaggacgacgggagctcaacggcgtctgggcagcggggtggctcgagcacctcccctcttctttcgaccaccgcggatcaaggggtagc

SEQ ID NO: 1432 - DNA, 437 bp, Oryza sativa
agatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaaggggccgcctgcaaaattccatgccccctcgccgcccatttgcaggcggccccccgcacagtgcaaaa

SEQ ID NO: 1433 - DNA, 3490 bp, Oryza sativa
gttccctagccattggatctcaacgtaagaactcaccgatgtctgacggtgcgacctgaacttcagaaagcatgccaaattgaggtctctagggttggaggggcgacgacgtacagatccaacgtcacaataagtgcactagagttgcaggaagacaagaggagcggagcaaaattattgagaaagcggagcaaaattttattatgacattaatctattaatggttggcatatactctattttggaaagctttacacatgttatgttcaagcaaatactttagtgtagatttctacaaaaaaaatgacgttttattttacataaaaactactccatttggtcaaaatatatatattttttgaaaattcttacaataaacataagttaattttgaacgttgttattatttttatgcaagttgtaggtatatgcaaatgacatagttaagttttatataaataagaaaaacattcatgatactccatgcatgtttataactattttttatttatgcaaaagaaataagtggtcaaaattgtatatcttataaacttctaaaagtataattaaaaaaacatcttttggggtataaccggaggaattatgttatatactggtctaaatgtcttgcatatccttcctattgcttaggttgcaatttattaatttccggataattggtgctaattaagctgtagcttggtcgttagtgcagcaaatataggtccactcagttaattagtagtgggctgaaccatgcttatacgcgaatatttttcagcttcttgttccattcttattggccgactacaatttcccccttttcgtccaccatatgtatataaacaggttgaaatttccctaatggtagtcagtagtagtagaatttggttctcatttggccatctctctggtcaaaaactacctttaactgatccgtacgtataaggtgagcaggtttttctcagtagtcaccaagttgaagatctgctgctgatgactgatgtgatgaggcatctttccaaaccgacaaaaccctaacgatacacactagtgtggctagaaaggcaggtgcgttcccacttgtgcaatacgcgtgccttcgcatgtgtggagagacaaaagttgagggggaaatgggaggcagatcagcacaaggctagctaggagaagagagatcagtgagagagatggttggccgagttcaagatatctatatatcgatctagctagctcctggaccgcatatatgcagctctccccgaaactttaattattcgtagaatcgtagtatatcagtacaactgttcaacatgcctatcttattaagagttgagcagagcagagacagtggtagatatgtaacatgcttctcagatggttttgatttgatatgcatatgtcaagggagcatgtgactctctgggtgcccacttctctcactcttgctactacatggaatttaataatttgtggctaaggttagtatctaattatcaagaaaaggatctgtaggatcgaatcacaagaactaagccaaccagaggaggggtgaatggttggtatacccaaaaaccaaaaacttttagcggaaataaaagttaccctcgaaatcgacggagatcggtctgaccgagattgatctgtcggtctgaccgagtggatgccgccgatctgaccgatgtagaatgatcggtcgaactgccaaagtcgcctgccgctcgctgtcgccgccgccggtctgaccgccacaatgccatcggtctgaccgccggtgagttgccggttagaccgccgaaacccggtgaaacacaaatcgaagaactcttaaagtagataacaactttattgcttctctctgtgtttacaaagtgcaccaacagcactccttacaaaaatttcgactaaactcgaaaccctgactaaactagcaactcaattgctctcaaaagcgatacaaaaacgataccgggaagcctcacgctccccctctatttatacatgaggtaggcagcctaaagccacgaaccaaactcatactaagagtcctaaacaccttaggaaatcctctagtacaagatacaaactttacataaccaattgtaccaaatttggactccttccaaattcgactccgcatcccatacgcacacaatacctccatcgtatgccatatagaatcttcaccaaccacgtgcatcaactctagccttagtatcccgcatgatatctgaccaccacggacatcgtcttaccaccaagccgactcccggttcatcaccgcaaatactctcccgaggcatcgagtcacctacacatgaaacaaacaaagaaaccatattccgagaccaagctatcaccaacttgactcattgttagcaaacaacagtattacatacgtatagtatccatctagaagccataaccatgaaacaatcacggatatccaaagaaacaacccgaaaccgaaaccgacacagcgtcggccggtcagaccgcgggccggccggtctgaccgctagatcaccgccggtctgaccggcatacacagcccggtcagaccggtcacataaaataacagtgaatctgatcatcacctgaaaattgattatctccaaaaccacttcgacgataatctccaaatatcaaaaccaataatcacagatgccaattgttcatcacagaataaaaatcaaaacacacattgatcttacatgatcttcacgtgccttagtctgacatcatttgtgtaagcaaacacttgttttcagctggctctgttgaagggaaaaacattaaacaaagccaacacgtgttattcctattatatcggtcaatgatatacctatcttatcttgttagagtttcacatgagggtttgaaagcatccgcgttcaagtactacctctgtcccaatatatatagcaatctattatcggatgagatatatcatagtacaacgaatctggatatatctcatgttcagattcatagaactaggatatgtcttattcagtatcacgttgttatattttgggttgaaaagagtagaaattactattcaacaatactaagtttattatgtaaaaccaagtaaaaattaaaaaagggagtgtgtccatctttctcttgaaaactagctaaatcttagtcactattagctctaaattcagtcatcctcctcgtccctatataacccacaatcctatggtcaaatcctgatgtttcccgttactattagctctaattaaattcattgtcagtttgtcacccccgccccataacatacgctggctgaccaccacagtatgtgtgatgtctactaggcttcccacagagctgatgcattgcccatgtggaatgccatcgcactttttcatcctcttagctgtcttagctttcaccttgtaccatttggattaatttggtctccagtctcattttaatttagggtgtactattggtgaggtggtggacatccactagttca

SEQ ID NO: 1434 - DNA, 8859 bp, Oryza sativa
acagttgtcgcatattttatcaaacgacaaaattatatatatgatactaaaaaagttaagtatatatactagttaccgaactgtatatgtgtggactatgatatattatatttaaccaaatgctggctatttttaaattatactagttggctaaaccaaaagtaaattaagtccatatatacatagttaaaacttgctaactattagtttgaatttcaaaaccaaattataaaggactaaactgagtttccactatgggtataactatatttctgttaactctgaaacttttagaattattagatattagaaaaactaaaaatatgtagtctttaatatcttcaatggcatgcttttatttaatatcgatccatgatacatatgaattacttaaattagtagccagatctttctacttaacatgagaacttacattgagcttataattaacgctgtggcagatagatcaacatgcttgattctcttgatgagtactccctccgtcaaaaaaaacctaatctagttgggaatgacagtacctaactaggttaattagggtttttttttatagtgaaaataactacttgtattattttcatctggccaacgagtgcatatagatattttaacatataataggcgaatagttaatcgcagttttgtctccgtcgcacgaaactaaatcgaggtcttatttttttaaaatagaaaatttactatattgactggagatttgattgaaattttgaacgaaaccaaatgttgggagctgggacaagcatagtccccacaattaaatcaaatcaacactcatcctggtgatgagttaaactggggcatttatacacagggacctagctatggcaaaggatataaccataggccgctcttgatgcgcactaaaccgctggcagagattcttctctatatgctcaactatcccctgcatatgtatatatttttgcagtacaagctagggttcttttaggctgtacttccctggtaataaaaactctaagctggctaaacagtccaggtaaacggcgacgatgctcataaattgtgtcatatatacgcgtcgttcaaaggtgagtttctggaccacacacactagctactgcaggatactatgcacggtttcgttaataacagtgccacagctacagggacgaacgatcgtcagggcagattaaaggagcacaggtggtgataattcaaacacttgctgccatgcatgcatgatcccgtaagctagctagcgtggaatagtaaaaggggaatggatcattagagcacagagttaggtctctgaacactgcagaaacttaatgctggttgggcctgaacccccaaaatattccaaagtcgctgttgcgtttcaccatcgcctccaagctagtagtaacaatcacacaagaacagcagtccacttgtctatagcgatatccatctagggatgactatgcacagtatataaacatgtatatatattgtgctacacaacctaacacatgcgtatcgatcgatctgtacgcatgcatatgcatctcaccttggaaattaattagtaccattattttcaaagccctgctactctacagcaatagaatgcacacatgagatacagcataacagcaagatcagtagtaggacgcatggatgcaacatatgcatggatcaagagccctttttctggttttctccttagcgtcaaactgtcaatcaagctgaaatggagcgcgtgcgcgtgcgtgaatgcatggcatggcacgcactctcacacggaacaaattctttgcctttgtgcagcggcccgcgcgcgcgcgcgcacacacacactactacaccaaagcacgctgcatgcatgcagcatgcataaaatggatgcatggtcgagtatcatttgaactttttgcatgggcaaatctcaagcttacacgtcttttgcagtagggaacacatgactttaaagggcccaaattttgctgcctggctgcccggccagcctttgctccaagtaccaccactactactacaacaacaatacaacaaccaagtctcatgttgacgcacacatacacgctgctggcctcactacccaccagccagagagtgaggaaaagactgttttgtgtgtgtgagatcgagagagagagagagagagagatagctggccggccgggtgtggtccagggaagaagaggtgtcagtgacagtgagctagctagctgggggtgatggtgcatggcatggcactgctcacattcatgtcgacacacacagatcgatgcatgcacgcgactatgttctgatcaaccggggagtaccacctttcagccccaaaatcaacggtgatacttcagtcctacagtagctagcacccaaccacgtacatactgattgatggctccatgcacacacacacactagacactactatagctgatcgatcgagacgtataggtgtgtgtaccgtgtatcggtgtatgtgtaggagtagctcgatgtgcatggcgagtagtatgtgtaatttgccgcgtccggccgtatgaccgtatatcgcttgtttggttggcaccgtacgtacgtacaagtacgtcgcatggagttagtgttatggatacggacgtacactgtacgattatctcatgttgtgtcgctgcaagtacgtaccatggggttgatatatacctggcgatacgctggtgtagcgtacaccgttacatctgtacaagcatgcagctactagcttctagctagctcgatctcacatttactggcgccatgaatgtggtagtcgtagtagtagtaagaacagcagcagctgcaggggtacatggccatctcacacagatctgcagaggcttctaattccacacctgacacatgcatcatgatgttcaatcttttccctctccccactgttggccggtagaggccgaagacctgcaactgaaagcaattaagcgagcacacctagagagagagagtgtgagagagagagaggagcatgcatgggcattgtcattgggacgcagtggcagaaaggaaagataaaactgatggagaggccaaagagatgggcagccttttgctatcgtagaacatgcaaaacaaaaggccccttctttttcagagagcggcagaaggaaggcaggcagggcaggggggggggggggggcgcttcgctttccatttccacgcagcccaaaagaggtctcggtttcttctcatctcatcgatctcggtttctccctagctcgatcatcagctgccccatgcttcctctccctctctaccggtcgagtagcttcttgttgcattgcgtgatgctacctgcaaactgcattgcgctatctcccctggcatattcatatcgctcgtaacgtagatcagctggcattaatttgcacaaatgcagtactactacatgcatgggatcaccggccggcacaagtcattgcagtaactactggcacatgggactgtacatgtgcccgcagcatatatgcatgatttgatttttcaaaaagatgcacgagtacgtgctcgcctaaacgatcgcgactctaattcatggcattgtacagatcgagcgcgctcgacatatgtaagataaatacaagttatgcactgcaatcgccatgagctagtagtgtagttctgaactccctgatcttatatcgcctaatataagtttataaccctcatctcgatctctctacgtccgtacatcgcaaagtgtatattgattaatgaactgccaggcacgcaggtttcgaggggttatgtaacgacacgctagctgcaatacagtacaggtacatactccatcagctcacatacaggtagtacgagatggcatgcatgcgggagttagcggcgtcgctagctggactggccggctagccacctctctcttagcagcaacagagcaacaggctagtcgcgcagtgagcactcactgagctccgcatggcacctgctactctgctagctgagctgccgctactcctccaagctgcatcatgcgggcggaggcccacgcctccgcgacccaagtaagacacgcacatgatcgacatgccgcgcgctgggccacgcatctctctccaccccatctctaccggcgactaggtacgtactactgttcaactgtatgccacgccgtcgtcgctctgaggctgagactctctctctctctctctctctctctctgatctatctctcactccaaacagtgcctgcttgacgactccggccaacagacaggcctggctggggtacatggggcatgcagggcattcatgcttccaagccatctcgttaatgcgaggcctatggactttaaccagcccatcactggactcgattggtggtccaaactcctcctcctcctcattatcagcatcccctcgattatttggttccatatcgtttgctaagaattttttttttcggaatggttaggtggccggaaggacttttttgggttgtttgaaacatgcataccttgatgatttcaattagcatgatcctcaaaaataatgttcctgtaataattaatcatctcttgatttttcagtaaagaaaaatcacgttgaatatgtggttcagattttggattgtggtgtcggatatggattatgtaagatctctctagtttgctgtttcatgttacgggggaaacaaatttggtgtggtgagggagttgtaggcatcagagttgaaatccttgtgcatctataaatgatacaggaaatgaatgttatatattttcactgccttaaataaagtttcctacgatgactccaacacattcaccaccttatatatgtagtgcactagtacaaaaaaatgtttttgcatgcatgcggtcagaatcgatcttcacaagggcctaggcggcccgcctgtacgtaggtgtctacagaattcaatattttcacgtgcgggcgatccaacagcttgcgaaaatctattatcgatcgtaggcggttgcctctcatttttcacagattgtcagatgttgtgttttttttcacagattatttcactttagagtttgcctctcgtttttatctacaaatttagtcgctaaatttcacataaccgaaaaatcacatgatcaaagttgaaataagttttattcgcaaaataaagttgaagtaacaataagtttgattgtatgttttcaaaagcattgattgaatggatatatggccagggtgaaatagatcgatcagtatatggcctgtaagggtgcgttcgttctgggggattgggtgagaaaggtacatagtattccgcacgcacgcttcccaaactactaaacggtgtattttttgtaaaaattttctatagaaaagttgctttaaaaatcatattaatccatttttgaaatttaaaatagttaatacttaattaattatacgctaatggctcacctcgttttacgtatcttcccaatcttctcgatccccctctcctcaaactcaccctaagtcaagctcatatataatcctttgggtcccacacgcagccttgcatgcatgcttagtgaccacggtattacgcctgccgcagcctgcagctagccaacctgcacctccggacttacttggcgcatgtgagtagaaccatccaaccagaagccaacaagctgcattaagggccgggtaaggcacgcgcgcagcgcgctcaatcttgcacggcaagggaaggatcagacgagagagacgacagctgagagagacgcgtacgtgttggtcgttgagggcgagagaatcagagaaagcaaacggatccggtataatacggtctgtgctttgtgtagcatcacaactggattgagagaaagaggacggacgacgcataaagccaccgatcgatcttgccgtctttggggcccccggcctctctctatcatatatatgatgtacactagaaaaatatccgtacgttacaacaggtgaaggttattttaattttattattgttatatacgttttagtttaggtgaaatctactgtgagaactcgtttgaatatatattttatccaacttcctttcgtgttgatttggtgtttttcatcatctgaatttgaaaatttagagttctaatttgggaacttttgaaatggaggtttcatatttggctcgtgggtttgattgcttgtggttgtcagccttgcgtggtttacacaggatacggaagacgcatgctcgacgcgaggtggtggaatcggacagcacgagcgcgtgcgacgatggaccaaaaaaaatctacggaagccaaatttaaattcagtttaatttatttattactacatccatactaatcaaaatataaaaagttttatagttggacacaagtattaagaaaacttgtgaaattaaataggaacaaattctaaaggctaaaattattaaattttgagacagagaaaataccaaatagcatactctatggccaatcacaattagaagattatgggctgatacgttacttgggctgaggcccaggcaggcattgaggacgtcagccccttcgctgtccgtctcgcctgcaatacctgtctaatctttttttttcttctcactaataaacgaaacggctaaacagaataaacgaaaccgcaaaacagaaacagaattggattagaaagacgtacgaaaatttgtggcaaaaatatctttaatttttataataggtaaagatatgggatgctatacacagatcgcggtcgatcgatagtgagggtgcaaatcgtgcatactacgccgtattatcgcatgatagtgtgtatgtatgctgcatgcataggctgtaggggtgggcattcggtctaaccgaaaatttcggtctcgatcttcggtctttcgattttttcggtctttgaaaagggaaaatcgaatttcagcgcaaaaaatgttaagaccgacaaattcggtctcggtcctgaccgaaattcaacaacattttcatatatgcaaagaaataatagaaattttcaacataaaaatcacaaaaaaaaaatcgtaagcacttatgagtaaagactcttattagcttgcatgcctagaagaagtatggatgtgaaaaaatagagtttaatcctattaaacatagtatattgtaggttgcatttagacattttttttataattcggtcttttcggtctattcggttacccgaggaaattaaccgaattgaccgaacaaaattcgttttttcgttacgtatgactgaattgatgaccaaatttttcggtctcggtttttttgtttggttttttttgcccacccctaataggctgggagctaggctcgctggagcatgcatgcctcgatgtgccctggcccctcatgatcaccatccgtttcctctctctctctctcgcgcgcgcgcgatccatccaccgtcctgctctcgaaccgccgtctcgtcacgtcgctttcgcgcggcgcgctttccccacccacctcttgtctctctctcgcgcgcgcgcgagagcgcaccggtacaccaccaccaccaccaccacgtcgtccacccgatcggccgcatgtgcttccgtgggaggcggcagcagacgtgcgcgcggagagaggatgtgtacatcatcccgcggcccgtgaggccgtgacaaggacggccaatcgccagatcgaatgaagcaagggcgcgcgccggctaggcgcgcgtggaaggggaatatccacatgcacgccggccggtgtggcccccggcccgggcgcgacccctgccttgccggcaagataccgatccatccacgacaccgaatgcgcgcgcgcgagatggacgaatcaaaaaggggaattatggagtagcgctgcatgcacactagctgatctactgtagattcacctactacgtacagtatatattccaaatagagcaaagacatggttgagcccatcgcaaataatattgatgatcatgatgatgttgagaaagtacaactatacagagacgagctgccaaacaccaaccaaaaagcgcattccgttacaaactatcattaagtaacatgacttttttttcagctatcacattttcggcctctaaaatgcggcacaaagccaataagttctttaactgaataacagtacgtgatcaagggataaaccccaactaccctaacaaagaaaatcgatcgataaattaaacttaaagaaccatatagattctaagaaataagcctacaaatattgtggcatccataatgaaataaaaaatcctttatctaccgactcgaatagtgtagcaccattgcgtataatatcatgcttcccgatgtcataacattataaactaatattatgcttcccgatgtcataacattataaactgataacaatccggcaggcctaataacttaaggttgcttggaccccaacagttcttatgcacacccacccggggaagggctcaatctccctaaaagactagtccaataggggaagggtggctctcccttttaagatagcttcctcctcccaagttaagcaaggtggggggaaaaagactagtccaataggggaagggtggctctcccttttaaggtagcttctccctaaaagactagtccaataggggaagggtggctctcccttttaagatagcttcctcctcccccttttaagatagcttcctcctcccaagttaagcaaggtggggaaaaagactagtctcaataggggaagggtggctctcccttttaaggtagcttccttctcccaagttaagtaaggtgggattattcagaggctcacacggtcgccgcccgacttttgcgtttttgccaacgggtaatagtgtaggatgaacttat

SEQ ID NO: 1435 - DNA, 4128 bp, Oryza sativa
aaactaataagtccattggaagtaaaattgtaattgtaacagggtagctcgtgaatttgctcaatttgctaaatggacatctcattgcgcggtttggcatgatcatgctccgccttatgttaagcaagtgttagagcatgcaagattgtaatattattacataaccagtaattagctctcatttccctcaaaacaattattgtttatctctatatagaaatacacctacatttatatgcatatacaaaggtggtatcacttaaagaatatcatcctataataattgagacaacaagacctcttaaccattaatgtaaaaaacattttttattagctttgtttttttatcccatgcaacaaaaattcttttaataaatgctaggagtaagagttaactttgagccgttgtcaatgatatttctcttatctccgttctctatttttcacgtcactcgatttacttgcatggcaacgtgtacatgttcataataacgatcgatcaatctgcgaccatatcaattcatcgtgatttaattaatggctttaatctatcatattcttttattggtagaaatttccagaccatcacagaacaaaagtagtggaggcatgcacctatccttttttaaataagacaaatagattgattgatagactacatatcatttgctttatctatctgttctctttcattctcaagtagaggagttatgacggtgcaccagcacgccttgccgacacacacaaactgacgtagagaagcatgaagtggaataatgtaggcggtgttgcaagggcccagggttaacctggcatataccaattgccatttgtgagtaatagtgtggtgacaacattacaatgataagaacaatgcatgcatatgccttggggggggggatcgtcaattcggtgaattcttatgggctatggccctcatgggagactccacagataaacaaacactcttacaaatattgaattttacgtgtaaatcctttaaactaaataaacacaaacgaccccactaaaatataaagtaacaataatcgatcccacagtatataaatttttgctttgctactatttcagaatacgacaacgtcaaggagagcaagggtgaattcatcttattgtgaacatgatccgtcagaattcatcatagtgatcgagatgcaaatagctagtgtattggtaaggagtgtgtgtggtatcaacccaagattctatgtttacttttttaacacacatattatttcttctacttatttaataatcaagtcccttcttggtagtcctcctcgatctctctctctttcacagaattcatggaaagggtcgtatattttttcgcgcttttccgttgcttgaccaacgataaaaagttgctacgtggagccgtgaccaaccgtgagttctttcttaccctttcagaacacctctccgttcacaaatttatgtatttatagactataaagattaagaatgaaggggaaatgaacggaaagagtactactacttaaattgggagtgccttaggttgcattcatcaaattaattattaactagtaataggaatatattatattcatttggggggtgcatttggtttagaagaagttgcagtctgcagattgggtgtagacatcagcatagaccttgctacagtgtctttcagagtttcagttggctactctacctgagctgtcgaacagggtttctgacgttcatgtggagtatggttatgattcgcaatataatgtgctacagcattacagcaatacggcatgcatgccttaaaaaaagtatagtactacggcatcatgcattagacaaagacaagacctcgtgtttgagtgattcatatcgattggatggtttaaaaatctactacgaaatggatataaaattcttaaacctattggttgtggccagtccagcgtggaggctccctgcgcatatgcatgcatgctagtaaaatttgtctattgattgatctggacgttacagtaattttatccacagtttgaaccttacacagcttatttattctttatatattccgatggaacgagctcaaatgaactagtacttttcttgttcaacagagagagatcgaaagagagaaactaggatgaaccaggctgaaaaaaaaaacctaatccgcacttctttattttgggactaatggaccttacgtcatcgtgcgatgccagatgaaagagagaaagtcaatctttagtccctcgactatcactcgaatctaatccacataccttaattaacgataaaactgggtgtatcgtccccttcaactatcaaaactggcttattttacctttccgagtgattttgaaggtggttttatccggtgtgacggttacatggcattaggtcagtgtttttatctgatgattttgatctacttgcgctagcacacggtgcttatgctgcataaaaaataaaatcactactgccaccttatccctccctctcctcatctctctctctctcccgctgtcacattgggaacagtgtggcccaacgcgcgacgcgacagacaatagcacaacgacagtggcaacgccgagcaaatccaagtgattaggaaagtgcttgggaaaacaatggcggagaggtggtaggaagaaggacatgggatgggaaaaagccaaggtcagaggcgaacctagcctttttgtcgtgagaagcccgatagcagtgagagtatgaaacttggaggccgcgatgatgacaagggcctcggagagctatgcttggatgaggggcgatgcggtaaggaggagctatacgtagtcaaagagtgggaactgggaagtggtggttagcgtcgtcactgtagagggagggcttgggccaatgacgccggaggaaattcttaatatggacaagttgtggcatgaggaggggcaatggcgagcagttctagcaagaagccttagaagcacacggtgaatactaggctctgatcagtggcgagatgtacggtggcgttgggggagagctacttagcgaaccattccaccaaagtatcgagcatctttagcgccacctccattcctaccaccaaggttgatagaaggcaactgcattttgattgaaccaaggagatggggagaggagttagagtgccattaagagagagagagagagaggaatggtgaagaggatgagaggtagtcacttacatgtgtcccccatttcaaccttttcatttcttgaagagagaatagctaatgtttcgctggatctggcagaccagctgtcggcaggcgttgcttcacatttgtggtcagtgtaactcacggactcacgagaacggatagttcgtcacttgcaaaagaaataactcaagcctattaggtttttcttctaatcttctttcgactagtataaaaaagggatgggaaaacaacacagcacggttgtaattaacaaaaagtcatacagtaccatacaggcagctgctgctccgtaaccggttgcccctggggcctggcacatgagtacttctgtagttctgttcgctgatgccggccgggcggctgctactgtagtgcgctgtgctcgaccgcatccgcgcatgtccgtcgaccgtcgttcgccttcttcgcggtgcactcagaattaaccaagcaaaattcctccgccgcaataccgaacccgcgagccagtcggctgccgaaccgaccgtctcttgcgccggtgaaatcctatcccaagtcccacacgctgacacgcgcgcctcatcagcgagatggttcggtctcgttggtttgggagatgcaacggttggcggacgaggaattcgggacgttgggcttaaggctacaatgggcaacaaaaattaggaataatttcaccggaggtccctcaacttaacaatgagatttttttaacatccctttaaccataaaagcagaaatgtctacccctaaactcactcaaaccgttcaaagaaggtcccatgataacacatatgggtagtttcgctgatgtggcatcctagtcagaaaaaaataaaaaaataaatatgtggggcccacatgtaagtgagaaaaaaaatgtgggtttaaccattctaatcagcaatctcctactcttttc

SEQ ID NO: 1436 - DNA, 3419 bp, Oryza sativa
cgccagatgcgttccggtttgccggcggcgcgctcaccgcctcgctgcttcggacgggcgcttgcccgacgccgttgccacccgctccactccggtggtcgccgcgcgctcgcccacctgctccggccgctctcggtttccgctacccgctccacaccgccgccgctgtcgccgctccgccaaccgcgctctctcgccgctgccgttccactttgccggccatgctctcgccgccgcgctgctccggacgcacactcccccgccatcgccgccacccggctccactctagcggtcgccgcgcgctcgcccgcctgttccagccgctcatggccgcccgctgtcgctccccctctatggcaaagataagaacgaaaagaggagagaggaaagaaaagagaaaagaggagaagatttagaaaaagaagatatgcgggtcccatatttttttttccttttcacttacatgtgggctccataacttttttattttttattttgttgactagaatgccacgtcagcgaaaccaaccatatatactgccatgggacaaactttgaatggtttgagtaagtttaggggtatacctttctggttttgtagttaaaggactaaaaaaatctcgtggttaagttgggggacctctggtgaacttattcccaaaaattaagcccagtcaatagtccaaagttccagtcagttaggttgggccgtctgcgcaattgctagcagaaactgagtaaactgggccgtgtaatctgtatgtccattcaaaatcaggcccactatatgttctataccgcagcaagacaatggtaagcgagtagcgacaggaaacgaccactcacgaaccaaaatctcctccactactggacattatccagccgaacattatccctggctactggctagattcttcattcttgatttgtgaataacacatcatcatcctgaacctgcagcatccgtgtctcggtgatagaatggctgcctggatggatggctagctcttcccccaacatgtcacacagccgatcagttcctgcatcgatcccgaatatgatgccaaaagcaaaaaccgtccttcagcattagcatcccccctgcaacatgctcgtgagcacggcatgtgttttgatgtcaacttaccacggcatccgtccgctagcgctagtatttatacgcctagttagtctccgcgatcttctccgatatatcgtgcacatccatatccacgcgcacacgcagccggctggaaggaagaaaaaatgctgcggttctggaggacgcagaggagcgtcacgtcgtcagacgccttgtctgtgagtaaaacatgtaaatgcaccgtcagaaggagatggagtactatacattttccatatgcatttctgagtgctgtttgtgtatgtgtgcctaagatcgtggagatgaacgtccacatggactgcgagggctgcgagaagcgcgtgaggaaggccatgtcccggctcgaaggtgccagtactgtttcgtgtgtgtaaagtatactccagtacgtgtgtgtttcgtgtgtaaaatgcgtgcgtgcgtgcaggcgtgagcacggtggagatcgacatggacacgcagaaggtgacggtgacggggtacgtggaccggcgggaggtgctccgggcggcgcggcggacggggagggcggcggagttctggccgtggccgtacgacggcgagtactacccgttcgcgatccagtacctggaggacgacacctacatggcgacgcacaagtactacgtccacggctacaacgccccggtgatcggctcctaccccaaccacgccttcacccacatcgtcgacgaccacgccctcgccttcttccacgacgacaacgtccacgcctgctccatcatgtgacctaaaatataatcttatttaaaatcctacatgccagcgacagatacatatctgaccaaatcgaacaagctaagtgacctaattagtggtgcaaaataagagatgaaaaaccaaatctaacttcgtcgatcatctagtaatggtcaagtagttgctcagcaatccaacgtgcaaagagtgtggtgatatgatagacaaattaacgaataggaattaaggtcgaactaagcttatcaatcgacaagttgttcttaattaattgcactatgcgaccctttttcttatgaacatgaattaaaaggaagggagcagtagaactggattgctaattaacccgctatccttttgaattgactattcgacgggcatctgcatggtatcgatgcttgctgttgacagcacaaggggaagaaaagggtggccctgaaaattttcaactgttgatgctagctagcggctgatctcgctgaggtatctgtgccagtaatttttgtctgcggataggacaacatggagaggatgactaggaaaaggagcactgttcaaactatccaaatgtctccaaccaaaagtgatgacccatccttgcatatgtgcgcatcagtgcatatgttcttatgctggtgtggggtgaagattctggtgtgaggggcaaacggtgacaacggaaaagaaggttcgaatataccctgttccctgattacaaatacagttatgagttctgaccattggattgtatacatatgacaaaaagagagtaaacttcagttcacacatcagaccaaattgagtacaggtgctaccagtatttggctttcgaagatattttacattgggacagcgagaggagtaagttcagttcacacatcagaccaagtttgatgcagctgctcaatgctctgtttgttcgttttgtcagggaatatgggctaacagtgacccaatctggattggattcctatcaataaataaacaaataaatctggattggattgtggaaatgataagaacacgcgtgcaatttgatccactttttatgcgatcaatttgggaggaaatgctctttcgtttcgctctcacaaacctgtgaacaatttccaccctctgaactttcagcattgttcttgtattccccacttcctgaagttcttaattctgtcaccaaacgacttggcatgcagaacaattcagtccctcacgagatacagaacaagaagatatattatcttataccccatgggccaggtaggtacaccagcaacaatgcaaatgccgtcgcatcgcatctcagatacttatgcccactaagcttgaccattatgttaacttggattaggggtaggctagagattgattggggcttatatgataacactacatatacacataaaccacaaaatcaagctatcaacattcctcatctcgttgatgccgacttatatctgccctgatagcgcctaattaacccgtgaacaacgtgtcttttcatcgtccaagtgcccaaccaacacatgacaaaagcaa

SEQ ID NO: 1437 - DNA, 12256 bp, Oryza sativa
ctggacctgcccgtgtcgaatcaaatgctaataactcgaatctggaacaaaattaacgccaaaaacaacacaaaaaacgactctttttttttctccaaactcgactcggctttgagagttctaatcttagccaggctccaccccaacctgtgctgccctgttcgagcgaagaacgaaagcgacacgagccgtccatataaatccacgccgtcgccgccgaatctcgcgaaaaagctcgcaaatttctactcggggaagaagaagagccctctccaaaggatctcctcgcccggccggcggcgatggcggccgcggcgccgatgccggttgccggagcggggtggtgggatctcgtgaacggctcgacggcgtggcaggacgggatcttcctctccctcgccgctctctacggcctcgtcgccgcatcctccttcgtaagcatctcgccgcagtgctcatctcctcctcctcctcctcctgagtcctcctgactgatactatactctagttatgcttatgcgaaagcactgggggaaagattctttcagaattttgtgtcaagatggattaaggggtaaaaggaataacaatacacgtactccaactgggttggtgacttgagttcatggcaggagaataaagacttgatttttggtgcttgtttgatgggaataccgcagatttgcgatatcaccatcagcgagtttaattgggaataaagacggttttgtattagctttgtgctttgagcataccagtgttttgcatctgaaacttgtaaaagctgataatgaggacgaatattttacagaactttagatcaatcaatatgaaaaacctgcgatttgaaatagagatagctggacaaggacttgtgattatctgccatgcttatctttctgatatccggaaatcctgctggatgcctggatagacagtacaaaggacaataatgtgtatttatgccttggtatctgaataatgagtagttactacattagtgtgggaagtatgaactgcagatccagttcctatgcttacagatatggtgcacatgtgaatgctcgctgttaaatgattaaatttacttgaggaagacaaggcatacttaattacttatcatgtgatatgcagatccaagttgttaggatacagtacagagttcctgaatatggatggacaacacaaaaggtctttcaattacttaatttcattgtgaatggaggtatttgttcaatttcacttgtagtacaagttacatgctcaactccctttgtgcttttgagtttaatgtgatttcaatctgcagcgaggtgttctatctttgcagtccgccgccaagtccaacaagtgaaccctgaggtctggacatctttgctattttctgtcttgtaattgttatgtttcacccaattggccagagttatattcttcattcatttttattccagatctttcagcatgttattcttgatcttccggggcttgcattcttcacaacgtatgcaatgttggcacttttctgggctgagatatcttatcaagcacgtggtctagagactgaagggcttagatcaggtttctacactattaatggtgtaatatatgtgatacaggtaaagcaagttatctctaaaagtctgtattgattagtgattgctatttatcagattttgtataattccgttagcattgcaataatcaatagtacaccctattgcacaagttgcggtgatcagatattttctttggaactgtgaatttcaagaaatttgttatagaccatgaaaagctgtgatgcgcttatccatttttccctgaaaagaaaagatatactgttgctagtatgcactgatgtgaaacaatgagatactggatgaaagtagaagggaataactttagctgttattgtgccacttatcttgtgatggttcagtgcttgcttagtataaaacttccgctaggctgcgtatctcaaaatactcactcaagtttatttcttcaggttctgctgtgggcgttgttgtggcacaatccaaacccatctatgatagtcctttcgaagttgttcattgcaggcctatccttttctgcagccttgggttttctgctatatggagggaggtaggactaagagtattactgaatgactcttaaccaagtttcatcaatcatagacagccaaattggctggctagactagctgcaaactatgtaaccttgaaccatttagtctactaataacttatacgtagaacagtatttcaagaaaatgtccacttattcagtgcttcatctagcatttgacattaacattcatttgccctgttttgattggcaggcttttcttcatgctgaagcgttttcctattgagtcaaaagggaggcagaaaaaactgagggaagttgggagagttgccactatatgcttcctttgtttcttggcacgatgcattatggtaaggttttcagttctctgatccttggatgagtttttgagtttcagtgttccatttcttacttgagcggttttgacactgcccaatttgttttgcagatgtgctttgatgcatttgacaaaaaagctgaccttgatgtgcttgaccatccaattcttaatttcatctattacctggtacgcatgaatcctgcgaccatattgtttacctcagtgaaatcaactttttttccccgttatcagttctagctagaaattgatttccattatcaataccagctaaatatattctgtacttgttcttatcccctgtttggctgtacttgcagatcgttgaaattcttccttcatctcttgtcctgtttattctgaggagaatcccttcgaagctacggctcgcccagtatcatcccctcaacagtggctaggggatgaaaacggatgaaaacatgaaagctaaaaatatggagaggcctgcaaagtgacacggctgcaagcccaggacatgaaaaaaaaggatgacccatggtctaaaatctctaacccttgttcaaaatgtgtatagatagggatctgaaatctgaagttttcccacaaccttcacctcctgtagctaaccttggtggttcaaggtgctgatgatttcgtgtaaccaattgttcctttgtaacaatggaagcaagtgtcctcgctcttttgagcgagcaagccaatgtttgtcttgaaaaattcttgggtaatccattggtaattgcttactactgataatatccgctttgctaattgctagcacaactcgaatgtgctggatcaaatggtaatccagacatccagtatcaacgaaatttttgaagttttgcagagtagcagcgtgatgcaaggtttctaccaactccgcttcgtcagaagcgaacgccgccacctaccaaacgcatgaatcatacgaaatttcaaaattgaagtcttgaccctaccaaactccgccattcttctgttctggtctgcaaatatttttttctctttttttttttcgataactactcgaggcttggaaatctccgagccgcgagcaaaccctagccgccgccatggccttcctcgccgttgcctcgacccgcgcgccgttcgccgtcgcggagtcctcctcccggcgccgcaccgtcctcgccgcggccgtcaaggccaccggcggctccaacccggccgccccgcaccccgtcctctcctccctccgcctcgccgcctccgccgccgtcatcctcgccgccacctccccggcggccatcgcgtgcaccccggcaccgccccctcctcccccggaggtaaccgtcgcggcctcgcccgacgatcccgtcaccgacgacccccaccccttcgagaagctaatcgtcgagaccgccgcgctcgccagcttcggcggcgcggaggccgcgcgggcccgcttctccgccgccgccgccgccgccgccggagtcgtcggcggccgcgagcaatacgcccgcctcctcgccgcgcaggagctttcgtggacggcaaggtggacgacgcgatcgccgccttcgaggagctcgcccgggaggaccccggcgactaccgccccgtgttctgccaatgcgtgctctactccgttctgggcagggccgccgagtcggaatcgatgctccggcgctgccgcgagctcgccggcgaagaatccgtcgccgatttcgtaatgccggtctcgccgttgccggtcgattcgtcggaggcggaagcggagccggattcgccggaggcagagacggagaagctgtgaccggaatggccggtgtcacggttggaataaaggtattcacttgactcgcgatacaaatgtagggagatattaaatggcgatgatttgataatttttcatgcaattttagatttcaaatactacatgattttacatgtcctccaaataaaatgaagcgatcatgagaatttgatcgtattgataaaacagtttccacgatgatcgcattgcttagaattgagtcatttgcaggaatatcttatttattcctcaatcctgatggtggttaatccaccgtcgcagtgaaatttgttggaatcgaccgatcaactaagctcatcttcactctttgctcgtctctggactctggtagctgatctaagaacgtatacaatcaacatgtatcgcagcgacaaatgatcatcgtttcagcactagcaggttaggcagagcagccacaaatttcaagacaacgttgttttacgctgtaggactccatgctaatgccagtgctcaatgctgatacccggtcacattatttgtccccattctgagcgaacacggtgaaatcatgtattgctgctgtctgtgttgatgttgagggaagttatctgtggatcacgtaatgcggctgctagtaacagaaatatctcctagatagcattgttggcctgctggggtaatgacttccaactgatgaatgtacaaatggcatgtaaaatgacggcaaactagccctcgtgctctctaccaggaaaagagagttgtctcttcctacttcccatgggattgtcttgtgctgcatagctatccaggcggtctcaactcttctgcttgctataggaccagatgagttctttctttttgccaaccaaattcaggacgagttgggctgttggagtttggccggagcaaaacacgttacgagattgttgccatgaggtgcaaggtggtctaacgtgcaagcatgtttgcagtcagcaacgtacaatttttcatttttttttcttcagcttttgatgtgtgcttaatctccttctattaatataacgccaagcaacctgtttggccctttgaaaaaaaaaaaaacacactgacgagacaacgactcaataaccatccctggtagttagaaactcgacttgctttgctggtaaaaggagcattcaacataaaaaagacaaccatttattatgccattcaaatacttcttatcttgattttgaaacatcagttgcatcaccaaacataaataaaaacacaatatttggttttcccgggcttcaccgtggtcaaagaaataacttggcccatgttagcaatcccgagcaacgttttggccgatcgagcaagttgccatggcaacgaagccatgcatgcaacacaagatgcagagaaagaaaaccagacgaaaataaagttgctaatgcatctgcataagcatgacacacttgaggacttgaacaattgacccacgacctcgatcaatcaatactggcggtggcggatcagcgacatccgggagcctcgcagcttctcctccacgacgtcgtcgagcctccgcgccatctccggcgacatgtgctccttccagtctccgacctcacccttcctgaagaaggccgagttcttgaacgacgaccaggtagccccgtgctcgccgtctcgatttgcctccacgtttctcatcctttccatactgcagagctccacgatagtttcggggacgccaccggcaagctcctcgccggtgaacgggcagccgaggaagccggcgagccgcctcacgctccccacgccgtcctccttgaggctctcgtaccggaggaacacgacctcctccggccgcgccaggctctccttccagtactcggcggcgtggtcccacataggcccgtacggcgagacgccgtcgcagagcagctcgaaggcctcgtcgaacggcgtcatggtggatccctctggtttgatctcgtcgaggtaatgccggagcgagacgaacgcgtccttggggtcgcggcacaggtagacgacgcggcacccggacgccttgaccgacgcgggcaggctcgagagcggttcgtgcactgccaggatgcgcggcgacggcatggcatcgaggcgatggcctggcgcgacgcggcagctgcggctgatctcgtagatggagtgcaggaatggcacgaggtcgtgcgggctggagtggaggagcgggtgctgcccggcggccggcgcgtggcggccgcggtgcacgacgcagaaggcgagcgccttgagccacgtcgagccggacttgggcatggtggcgaggatgacgtcgctggggcgggccacgaacgtgtcccgcgcggccagcgtcgccggcatcaggtgcgccgggtaccagaatccgccgtacctgcggtacggggcgctcccgagaccatggcaagacggtagggaggacgcgagcgcctcgtacttggcgagggcgttgcaccagccttccccgtcgccggcgctcatgtcgtcgcctgcgcctgcgcgcggcgagagcaggtgctcggtcactccggcggtggccatggcattcctgggtcttggaggaccaacgcctctatctatagatggccatgcatgccaatctgtatttactactccctccatcctaaaatatttgacgccgttgaccttttttaaaaatatttgaccgttcgtcttattaaaaaaatttaagtaattattaattcttttcctatcatttgatttattgttaaatatacttttatatatacatatagttttacatatttcacaaaagtttttgaataagacgaacggtcaaatatgtttaaaaaagtcaatggtgtcaaacatttagggaagtaggaagtacaaaatagtactccatccattccaaattgatctacatatttcataggtacatcaagactaagaaaaactaataattctctcatactatatttactctagcaacaaacttaatacatgcatcatccccactatttcctagccaatagcaaatcaatatattgcatgtgggttataaatacatgtgtgcatggatgcatgcatcaatgtctatttactccaatgcagaaataacgaatagacctaataaatgaacacaaatatgcagatcaatttgaaacggatggagtaattaactgggggtgcagaacttgtgcgtgttaaaaaattattgcaagatacacatcaaaaggtacgattatcaatctttttgcactaatgcgccatcgcctatttgactcttccagtctaccgacacttgttaataactagtgccaaatctctacttgcctctccaaatctgcatacaaaataaaacaggtgccaagcctaatatactactctttgtacgactgattgaatcatttccaatgccacggccacgccagcatgaggtttttttttagccatagtgtagtattttactagactagaaccaatctgatgagggtacaagatgtttgctgatcgacttgcacaaaagttggtgcctcttgtccgcctaaaccaagttgcaaattctgaccatacttttcaaattatttctatccagctagcagagtttctacttcgaaattctaacgcatggagagagtaagatacttcgcaaatcatggatagaatcatagagagccatgcctttcatcatatcaatatctcatcagaacttcagtacatatggttgagaactatattggatacatgcatatagctactagtatatatatgctttagttgaaagattccacatccgggagcagttcgatgacacaccggcgagtagaggatggattctaatctctcgggtggacgtccacccgtttcttacatgtcacctaaatgattatgaaaaaaatcaaaaaaaaattacaaggtaggttaatatataatatatcacttcacaaacatgtaagttcaaatttgacttttacgagtctatttcgccttcagtagtctatttcgccttggatttctggaaagagtaacggcggttagttactgtaaggaacggttactgctcaagcctcaaggccttagccaaacacagaattcagaaaggcgttaagctagctttctttcgcattaactaattaatttcactgcccaaatatgctgcatgatatgaaagagcacggaagaggacacgatcaaatggtaaagaaaataaatgtttaaaatgtcaggtttaaacgtaccccaaatcgcgagccgctaagacgcagggagtccatctcgagcaggtcgtcgacttcgtccagctcgatgacggccctaattatcgcattgttgagttctttatcctcgctcgcgttaaagaggcagcctctgttctttgcatcagccactatctcacgccaaatggtctttgctactcgctagagtatttgcattgccaagaatccaaagacagtgcctgcaaaaacaaaaacaacaatggatcaaacaacaaaatcggagtgaaatcaactctctgtgcgactgacgtaattggccgggaggatcgaggcaacctacttggcccgggtcagcgcgacgttggtgcggttgacgttggagaggaacccgaccgatccggtggtgttgctgcgcacggcggagaagatgatgatgtcctcctcggcgccctggaacccgtccacggatcgcaccttcacggtgaagcccccgtgcgtctcgtacgccttcccgagcctctcttggatggcgcggacctgccccttgtacggcgacaccacgcccacgcacagcttcctcccggtgtcaaccgactctgcacaaaccaagctatctgagctcagcgatgccatgccagaatgcaagggcatgatgcaatgtgtacctttgaacaatctctgaacgatccgggtcacggcggcgacctcgatggggttcatgaggctcttgtcgtgcttgcccttgctctccttgccggcatcgacgttgatgaaggagtaggagccgtacattggcccggcaaggggcttcctctcgtagtccctgtgtaatacgttctcgccgtcagatatcttgttctcgtagaagcttgagaccgggaacttgctgatccctgggtgcatcctgtactgcacatccaggaggtgcttcgggtgtcccagcgaactcagcctctcaaacaggctccttccaaactcagcatcttcacaaacctgtgaagaaacaaacagacaattgttacatagcatagtaatagagattgtgaatgttctactaatagagatggtgagagcttaccctgcttttgacaagtgccggcagctgaaattcatagccgatgagaacggcgtgacgaacgccagggagctggagaggtatcagtgactcgcactccttcagctgtgctgcctcgtcgacgacaaggagatcaaacgggcttgcttctggcaggtagtgcagacgggatgagctagaagctgtgcagagtatgcttttggcgttccggactaggaaatcttctatcgaacgcttgtcgaaaacgttcggaagttcaaagtgatcagataggtgttttagcttctgaagacactgagctctagcatccttcagctctgtactcacactatcttgcacatatgtcacgaagttctgaaacagtgagctgatgctgccatcggggctgagtttgaacagggttttcaggctctgttctgatttgggctccacaagtttaccaaaaaattttagcatgtgcagggcctgggtcatgtaactgaaattctctgcagttgtagctgacctggggagataatcacagaaagtcttgacacaaacattaagatcattctcaagccgtttgtaattacttatgaagtattccttgaactaggaagatagcccgcgcattcgcgcgggcatgtattgtgggctgcatgtttcaaaaacttataagaacataatattaaccgaatagcactgtcacacttcgaagtatgttttctccacaaatattattcgttggtatttgttattttccacaaacgtgttatctaacaacttaaaagtgtttcacattgttgtaatgtaagcaacatgttgttaatcatatggtttaaaaatctttgtggcttttcctaaatatttatggctgaccaatagctagtctccaaaatatgctctaaagtaatttatttcttttacttgttaaatatagttaatttggatttcgactcatgaaagtttactgcaaataatctaatgaggtgcactaataaaaaaatagtttagatggtatagttgtttaaaaatttctatcacgaaatatgttttctatctaactaataagcatgaaaatagggcaatgggagagaaggaaaagaggaggcgaggttgtgctcgtgcatgaggggggagggcgcagacatgcacatgtacggacataacataataggacagctagacaggagggatgggattgggccttttctctttttgtctatctattaagataaatctaatggtaaaaaaataatgagaccatggtaaaaggcatatttcatataaattatgagtatatgtgattttttttaattatttcatattttattaagtcaatttagatgacatgtaaaaaaagtagggatgttgtctcttgacaaaacactatttaatagtcgagtttctaatttttgtttgacattgtagttttaatttacatatgaatgtttctagaataatgtggatgagaggaatggggaggaaggggaaaagatgtttttttatttaaaagtttaatagagatagatttaatgttaaaaataataggtttatcgatttaaatagaaatcattgattaaatgtttcttccgcagtatttgtagtactttttataatttattagatgtgccatgtgatgagctagaaacactataaaggatgtataatggaccattattatataatggatagatctgtatgatattttatggggatctgcttaatgaatctttataatataataagcattatatagtaattatttatatactaagctgctagctagaaaatatggataataaagtgagtaaggagagagggtagatcatttacaatggcatgatatgtattagtatttagttatcatataaaggatatgagtttatatccaaatggtctatttcttatatgtatatacacaccaacacatggcataattgaaatcaaatatattataagaaattataattatttaatattaatattttaatataaaaaatttgctacctataaataaatggagaaaaaagagagaaggtgggggacgtacgtacgtggtttttttttacaagcgtacgtacatagtttggtgtatgtacgtgatggagcggatacgaatgggttttgagattttttttccttgatataagatggatctaatggtgtgaaacgatgggtccaccatgttaagttgtagcgcccgtttcgtcgtggcgcctagtgggaaaactatctcttaaaaatcctaaatgcgaaaattttctccttgtttgttgtccagtgtccgtgccattccagatctcaattccccaatccattgtcgaaatccaaaccctaatctcaaatccgtcccaaatcaaatcctctcgaaaagtctattttgcctccctcgagttcgtgggccaatctcttctccccggcccatttcctcctcagcccaactctcctctcccctccatccttgcccgcacatgtgaggcacgtgcgccgctcgggcgctgagcgagagagagactctctctctctctttcacttctccctccctctctgctctcgttgccacttcccgccgatgccgctcaaatcgccgcgccacccgttgcttcccgcgcgcgcgcgccaaggtggccgaccggcaagtcgccgccgccatcagcgcctgctgcgcctgagcccgcgtctgccgccctgtagccgcgcccttccaaaccgccccaccgtcatcgccgtcgtcatcgacccggccccgctactccgcgcgc

SEQ ID NO: 1438 - DNA, 24384 bp, Oryza sativa
tccgccattgtcgcctcgccccgtgccctgttcgtcgtcgcccttcgctgtcgcgtgcgccggaggagccggtgcgcgctaggatcggaaggggactccgggcactcgtcttcttcctcttccccggcccgaggccggagagatcactcccgtgccgtcggcctctcgtcacagcgccccgtctcgtctcggtagaacacctccctgttctccctcctcgctcttcctcctccccttagactcgagcagtagcttgtgtagcctccccgtagctagcctgcgtcgccccgaccgctgccgccgctcgcagtaggctcaccgccgtcaccgccgtgctcggtagtagccgcctgtcgccggccttcctcggcgatgttccgtccaatccgacgctagaaacggattcccggagtcgcgtagatgctctagctcgcccgaatcgatctcccgtcacgccatcgctgatttccccctttctcgccgccggttgctgccgccgcaatccgccgccgtcgagccccctccggcgaatccgagccgttggctcgctccctctcttttccccttgtcattctagtgtacacctcgtcgccctcgtcgtcgcacagcgtcccggagaaaccgtcgcctcccgccgtccattcgcggccggcgccttcgtctttctcccgccggcccgcgtggcagccacgaaggcgccacatcggcgctagctcggccggaacgggtcaagccgaccccggtcagccgctccctccgtccccgctcgcgtgcgcgcggcccacggagagctgagaggctgcgcgtgggccacttgcgcgccgcgtccaccgcaagccacacgcgtgcaccgcacccaccccaaccctagcgccgcgccacatgcacctcactcacggtgagccgagccgccgacaagcgagtcccactcgggaccacgcgaggtggacccggcccaccggttcccctccctctctccccgtgcgtgcctttgggccgccttctcgagcccgccggcccattagctcggccgagccgcgccccttctctcgggccgcaccctagccgcccgagggaagtctgttcctcctccctctttcttttctttttcaaagggtttaattaaatccgtattcctttagaccaaaaatccaataatcttagaaattcaatatcttctcaaccgtacatccgtttgactccgctcaacttccaaaaatcctcaaatctcgagatctacccaatggcacgcttagaggtcaataatagggctttaatttcgctgtttgttgagtcgtctcgttcgcgtgtagcttccgagctcgaagacccagagtgcgcggatttcgaggatcaagcttaagatctcgagcaaggcaagtcacctttgatcatcttgcacctataatttaaatctaagtatttcttttccgcaaataatacatggataggattaacacaagaaatttggccgcggcttgcgagatagcctaccggcccccatcctaattgctgcaattagcctccttgaattattgaacacttaaacctcctttgtcgactgttgtacttcgatgtacgggccttcgggcacgcacgtcggagtcctcccctcaaatttaaaatatccaacgatgggtaaaacttgggttttacaaaagacttggaaaaacccgacgcctgggtcgatgcttgcgaactaaatgaatttccaaaaatcgcagaccgggggacgtgccgggagcacggtttcctgctcttgcacttaaggaccgattcctttggaatttcatctgaacatataacaagtacgaccacatgggtggaatgggacacccctggctgagtaattagctaatcaggggagccttgatgccgggagacaagtggattcgccagggtggtgtcggggaggacccctgggcttcctggcatagtatggtctaggacctaacctgttgttggtctgggacccctctcgtcggcatatggtaaacctgtgtcggctctcgaaatgccttgtcatgaaagccttaaggtcaccagacgtggctgttctccatgggctgggtgatccgggttagtaatgtcgtgtgggtaaagtgtgccccctctgcagaggttattaaactgttcgaacagccgtgcccacggtcatgggccgatgtaaggtgattccttagtgtagttttgttcgactagtgcttggtgaaattgctgttgggaatttgggttcgatgtttggaacatctgtagctgacgggatcagctaggcccgggtggccatttgaaagttgtggccgggtgccaatcttgaatcaatcaaagactgatacattgcacatactctgaccggacgagatgtactgtctcatccgtgtcgtttgagaagcactcacttagttgttttaaaaatgagtttaactaaaaatcaattgtaaaaacaacagcctttcctttgaagccttcattaaacacataattcccatgacttgctaagtactcctgtattcacccttgctctatataaataatccccccagtggctgaagaagatgagatggaccccgctgacgaggagttcttcaggagcaagtcggctatgatgagttttggggtttcgatctggttcccaagtcgcgcctgtgatgttaggttcaagtcttggcttctgctttcctcttttgtaatgcagttgtgagctcggggtctgtccgcagcccaacatgactgtactcctactctataataaagagacctctgttgctgtgatattctgtcttcctgtgataccagctctatttcctgggattggtatcggttaacaggttaatttggagcgtcacaggctggttccgttcggggctagttcggggcgtgacataagtgaaaactgatggttggatttttattttttcctcataatttctataatttgttagagtgccacatgacgatataggagtgttcgtaggagccacatggcggtttaggagcgtttgtaggaagtttaatggacttttagtatataatagatagatggcattattggtatgaccttaggaacatcctcctttacctgctttttatcattctccttgttcttgtttttgttccttttcttctcagcaagatcctcttctatctccctttcaatttgctccacatatgaatcatactgaaccagaggttgctcaagaatccgtatcatggagctcagactgtgcacccaccctgaacctggactcaggcacttctgcagtcggcgagcgcgcttctccaagaagatctttgtcaggtttccgtccacgttcatccgatcctcatttccgaacagcacaacatcactcaaaaaacaggcttttccactgccagcagaaggatcctcgaggagattgaggacccgagatgcgacctcgacgacggcggtgttcgtcggagcgcaggtcagtgtcctgtggttcttgaccagcattgcccacaggagcgtgctgatggtcttcgtcttccctgtcccgggaggaccccagatcaggcgcacggaagagctccgctgctgcatcgctgacacacagtctagtactgccaccttttgcgacttgttgagcttgaaatcttcaaggccaccaagtgctctgtccggtagatgtaaaggcagttctgaagaatatgaacattcttggccgacctgccgtaagaattaaagaacatgcataagcaccaaattgcatgcaatggagcagatatattacatggtaatgcatacctttggattgcaatttactatcatccgaatgatgtcagtgttcctgacactagcaaccaccgcatccagttcactccatatgcgattgtacgtcgtcatgttgatcaggaacaccgcgaagagagacgattccaatccaaactgctgctcaacatgcttacttgacagcctgacgacggtgttgccttcagcatcctcggctttgagcaccgaggcaatcaccaagggcttctcaccgcgtcccaggtcagagatgtgcctcggtttccgatccgtcagcaacagtgtatccgcctcctttggggcgtaaacttcctgaaaaatgtccttgggatcagctttattggcgaaaaaactgtatatgagctgctcgtctgagcaaagcttaatcctggtcacttcagctgctggcgcatgcttgatgccttccagtgcagagcagagatcagcacgagtctcttcgatcagcggcacggtgaatgatcccatgtactctttcagcgaggagaaaattgtgggtattttcttaacctgcatcaaggcaagatcatccgcgagataatactcagattacagcgagagaacaagctggataatgcgatgtacgctaccattacagtggaagagattgtgtgcaaactgcagttcatgggataaatagttattccctccatttcatattacaggtcatgcaatctttttaagttgagtaaattttacaaaactacacgttttgtagtccaagttgcagaaaaccacaaacattttgacacttggcacttaagtacatatattttgatagtgtagtttcacaaaaccacactatcaatgaatagattcacccgtgagatgacgtgactgtttcatataggacgaggacatgtcatcctattaacagccatcgcacgaaattaataggatgccacgtcttcatcctaaatggaacgaccatttcatctcacgggtgaatccattcatcgatagtgtggttttgtgaaactaaactaccaaaatatatgtacttaaatgccaagtgtcaaaatgtttgtggttttctgcaacttgaaccataaaacatgtagttttgtgaaatttattcttttaagtttgatcaaacttatactacctccaacacaaaacatatatactaataaaatatatttaatgttgtatttaatgaaactaatttgatgtaaaagatgttaaatttttatataaatttgatcaaacctaaaaaggtttacttataataagaaacggaggaagtaacaatctactgcttggttacctttttcttgagtaagtctttgttgagcacatctttgagggaccaagagaacatctgcttctccaactcgctctgcgaccacgaactgtacctgccatcttttgcccttgcggatctcgtccccgccccctgctgcaccagcacgacgtcgtcgtcgtcgctgtcgtagtagtagctcatcgctaccagcacgacgtcgtcgtccgtccggcgagcgaaaacgtttctggctccggttggaagctttgcaagtgtaggtgatgatctgattctactttctaggctgcagcaatgcgtcgaggatttgtagaggcacaagaccggtgggattccgtctgcgaattaatgtttgagttggggtgtgtagggtcgatccacccttccgtctctcagtgtgagtgtgtgacccatcgttctgagaagagaagcgcatgcggttgcattcgctagtgaaaaggtgagagggtgtttggtttactaggagcccaacaagtgaaatgcaatttactgattgttcaactgatcgtctgagggttgtttttctttatctattataaaagtttaagatgtttttactagaattttggtacgtcatctgtgtttaaaacggttttagttttatgtttcggtttaatctatatctctacgacaagaaatttccgacttctgtaaaaaagaaagaaaaagaagtccgactcaaaaaaaggtaaataaagaaagaaaagaaagtccaacttaacgagcgattttaaaaagaagcttacatcgtcacttaactagcgattaaaaaaaaagcttccgtcgtcgtcagtaaaaaaaaacatctcttgactatgtagaaaaaggaaaaaaaatctcccagtaaaaaacaaaaatgttcgtttggtttttttggcaccgatatttttttccttttttctttgcacgcaaaagagttttttatatgcacacattaaggtttttggtttttttttcctttttttaatccgatctattcaccgcgcgcctctcgggtactcttagtttttttggtcaatcttttttatcgccggtttttttctcccatgcgctagctttttgtttttctcatccggttttataatctcatctgttcaccgcacgccttccgaggtgaaccctagcgctacgccaccgccatatcgattgtatgttttctcctccaatttgattgaaaaatcgattcctcactcctctcatcattttctccatgattttccctttgattcggctttaattgtcggatttaatcactgttctacaggtgccgatgatgacggcgatcttccttggtcatttttatccgagttttacgctttgatttttgggtaaaaagagtagatcgagtggattaaaaaccctcgaccaattttggtttaccaagaaagattcggctggatttgattgggagatttgctctagcaaacgtgtgtgcacaggattatcttcgagaggttgaagatggtaatcacatttgaaagttgaagatggtagggtcggaaaccggtagcaaatacagaaacattaaattataaaaacatatatttaactttacataagtatgttatatgtatacataaattcaaacttatactatataaattataaattaactccattttagtcatgcacaaaagttagagatttgattgaagagtcaatcaatatgtaagctatgggtcaagtagagacatgccctataaatatcgacatatttagaatacggtaattaccatattacaagaaacgataatttccacaagaatacggtaaatacggaaatgatcagtataacagcaaaaccatttctgttttcatttccatattttttaccatttccatttttgtttcggtcgattaccatttccatatggctcggccggtaaaaagtcgaaaacgaacgccggtcggccgggaattactgttaccgttttcacccctaatgtaaggtcatgtaaaggctgtgttcgattgtggggttcccaacccctctcccgcagcacacaaaacgaagcggaagtttagcgtataattaattaaatattagctaatgatctataaaataaattaatatttctatagaatattttataaaaaaaatacatcgtgtagcagtttgaaaaatgtacgcgtgaaaaacaagtaactaaagttggaattcaccaaagaacacagagctagagactaaccaagcactatcatattcccaaattttaatagcatagtaggtggatctaggaaggataaatttgtcttttcctaactcagagcttcagatctatttttgaatttggaactctacgatacaggccctaattcactcatatgtcttgcacttcacattgactttttcacaaagagttaggacctcatcttttcacttatgcttatacttatgagccaaaacttgaattttccaactttaaaattgaagctgatttaaggttttttcatcgaagtttatttttcagcttttacttttagatcactaagaacacatatataaaaattttattcacaaactacttttcatttgcaaatatgccgtttctcttaaaatctacgaataagcgaaatgatgggaccgttaattttctcgttctgtgtgtgtttggtgtcctcaatgtcagcctctcacctttactattctctccgtttcaggttataagacgttttgactttaatcaaagtcaaactgttttaagtttgaccaagtttgtagaaaaaagtagtaacattttcaacccaagataaatttattatgaaaatatattcaattattgatttgatgaaactaatttagtgttatatattactatatttatctataaacttggtttaacttgaaattgactttaaccaaattcaaaacgtcttataatggggtatattatatggcaatgctatagggtggctaaaagctaaaagtttcaaattttatttttctacacacatggcttatgataaattaatggctgttgcttaaacttaattgctcatttggaacgtaggattttgaaaattgtagcaataaagaaaattataggattagaataccacgtatggacaaatcctgcaggaattgaaaatataggaatctagcacatatcacgtttggacggttcacaagaatataacgctaggtatctaatggaattaagagagaaaaatagataaagagagaagaacaagcattggacttcttaaaggaaaaaaaaggtttgagctcttggtaaaatttcctatagaattagtgcataggatggtaatccatatgaaactgatatactaaaaaattctgtttcaaacaaaacatatagaaaaaagttcctaagatttaaaatcatttgaatttccttcaatccaaagttgactaaaaacttttaaagaccaaagtatgtcttaaaaatatcaattgcggatgtcagtgtaggatctgccatggagatcgtaaggttccaagcactagtaccgatattgcaaccatatgagcaatcattgagtctccattaattttttctgtcatatactatctctattataaaatatagcaacctctaaaaatacgaatctggacatgaagatttgtagtctaggataggtcttatcccatcgtttaagttgctacattctagaacgaagggaatatctattagaagggggctatagttttgtatagtttgtcggtccgtcttatcctatatacctatacaagtcatccccactaagtgcaattaaaactaattttttgttctgagagtaagccacgtcaccttgattcattccagccatcggattgcacataaacgtttggatagcaatcaatcaatcaactggggatagcaatcaaaataaacatttagcaacaactaattaaagaggcccacctagccatctcttaatttcgaaacatacagttggaataccaacagcaacacatgtagtagcccagcagttataagctctttaatcttccattgaagttattttatctcctgtaaccggtgaatcagatgaacagtcggtcttcatgcctttatatactctctataattcactgggactttgttctcgattgatcatctgtgcttggcagtctttccatgcatctagttgatttatttgcccactcctctgctcatgctgatgcttcaacagatcaacatgcacaatccgctttggtcatctctctcttgcttgcttgctcatggatttatttttctttttcttactaatatcatttgttgtttagttgtagaatctgaagagaagaaaagaagtagtagtttcaaatatttcttaactttctgttctttgtgaaggttgcagatcttatagagagaattgaagggttggtgcattactatattcacataccggttgaaataataagaacaatttttttttcagttggttaaaataaataagaatacctttttgtttcagtaggttattgacatcttcgactgaacttttgaaagtttctacttcattaaaactatagtttggaataagcaattacatagcatctttgtgtaatcacgatgacgtatattgtctaccatttttctgtcttgctacatagcatagaacaatctatgttagttttttttttgtaataatagaacaatctatgttagtaccattcaatttattgcatctgtgttcaattggccttagttctagtaaaaggaattggcctttcactagacaatcagcgtattctgttatgattcaaatttcagttgcttattattataacattggtgaagtgttcagtgtataacaatacaatcattcatacctaattttttatctttatattactcttgtatttccgcagcaacgcgcggggtgtcatctagttagatattcttggatccgctcgtaactgcgtttgaattgatgatggaagtttcaaagtactagtgttatggatcagatcattaacatgtattaacccatattggtacactcgtgcacacacgatgggccctgtcttaaactatgcgaccaggatgtatcaagacaagcagttagcttaaccactaagcttagctttgaactcatcgatggcgatgagaacttcaagtcttcggtcgtcaagtcacactcaagagtctcacgttatacgacagaaaacacgctttcaaacatggaaaacctccatctcccctcgggcactcgaaacacaccaaaaactcccaaattccccctacttcaaacgcgtcgatacccaaagagagaaaaataaagaggggaaattcaaaacctcccccaaaaccctcgccccaccgccgccgcccccgccgccatggacagggcaccgccgcgcggcgccccgcgcgacgccgtcggccagcggtggctcgccgtcttcgtcttccaggccgcgctctcagccgcggcctccgcgctctacctcgccgcgtccccgcgccgccgccacgcccgcctcggcgtgccccggggcctcctcctcgcgctccacccgttcctctccctggccgccacggggctcctcgcgctcgccttcctcgtctccgcgtcgccccacccgcgcgctccccccgtgccgcgccgcgccctcgcggcgtccctcctcgccgccgccggggcgctctgcgtgggcgccgccgcgtcgctggtacccgaggactccgggtgggcggctgttgctgggatggagttccgcggcgctgtgttgggagccgtgttcgccgcgcactatttcgggcgtcggaggtggttgctccagttccccgttgtgcaggtcagtgaagtggggaaaagtagggttctcatctagaatggcgttccgaatcttatcaaattgccaaatggctgtagctcctaatagaggtattgcgactatagagatcggaattttaggtttaaagttagcttgttacgattttagattacctacttaggtatgattgatggtgctggtgattttttgttattgaatctaagcatggatgtttttgataactgtggcttgtattattggtatgttgggtctaagattctttgtgatttgttccgagtttaactggttcccacttcccactagagagcttcatgaattgatcaaatgattagggaatagctgctagcacctctgtaatattcaggttgatatacattggacatacatgtgctattctcagatgagaaatttgattatcatgtttgataagacactatagcgctgttttataattctccagaatatacgatattcagaatccacatgcatgagctgtagtttgctttgatagttattgatagagaagtttttatccatctagatcttttttggggagacatggtttatattgatctaaattatatgtgcaattctctgatatctatagctctgtttggttaatttttttgcccttgcgattttttaggcttgcatgttgtttacttgcaatccttcagcacttcccaccaattttgccaattgtcttacttgctttcttaatttgttttttgtccagcgacctccgttctatggtttgaaaatggggcttctgccatctggaaaaagggctctgaaggtgtcacttcaggccttcttcctttcctttatcttgattttcgttcttcctcagcaattcagaatcagaggatccattggaagccaaattatcgcccaaatcggtatttttataatgagcactgccgttgccttctgttgggaaataagtcatcattttgtccaggtttgttcttcacaatccaacttcaaaggaaaaaagatgttatatgatgtacttgttgtattgcctggaatgcggagattgacgtcatttcctgaaactttatagttcataaccataattcaactgctttcaacaaatttcaggttgtgcatacaagaaggtgcagtttcgctccaccacagagcactgctgctgcagagactaatcctactgagtatatcctagaaacattggaactgagtgatccaagatcactaatgcagtatcttgcataccaagatttgtgtgctgtatctgaatgtaacttagaaccatggcgtcgagcggccttctttgaggaatctggtgagacttacaaaagaattgtgacagcttgtttgaagccgcttgaggagttcacgtcaaaaattgctgaagctcttgaagggttttctagtgagaaaccagaattgttgtcacaacagttcaaacttgctgctgcatttaatgattcacaggtaagttactcatcagtttcttctatctgttttacctcttatgttgtgttcggctgttttcctgtttttttttccaaattgttaatcatgtttgcatttgtgttgatatagaacatgaaatggttcctttgtttaggagttaagaccaaaaacagttggatcttactgtagaatcagttcggtgtttactgtttgttttttgctttgtcactcatgacagattatctagagttgaattaaatgtacgtactataatcttaactgcaccacattggttagtgatacacatacataatgactagatctgcatccaggaagatctgcttgtaaaggttagtatcatagtttgaagtgttcagacttcagacatcttaggagttcattttgagattgatagcttgtgagtgctgatgtctactttatttataaccagtctaatttgtggcaacacatttagttctagtggatgataattggatatttagtgagtgttaactatcatcatgtgagattgtggtctctaaaaaaaattgcccagcactgcaacagacaatagcatatgcactctcctgcagcaattttggacatttgggcgtgtgggatgtcttggtattactgtcatacattggtctcacgtggatgtcctgtattctatttcattggtatagtggaagtgaataatccatttatgcttcttattttagctttacaattgagcaagtttaagtttggtggttttggtctttagcaggtgaccattaacttaggaagcatgttttgcttcagaaaacaggctagtaattgtggtaggaagacattgttttatttgacaaaatcataacagtacctttgcaactacttctgtagttggaatattttttggtatttacaacataattgaacattttgtccgttatggctagaacacgtagcaccctgactatggctgaaatggaggctgccagcaggtatgttgggttgctatctggaaccatgcaaaatagcattccatttgttagctgctccagctttttctgtatgttgggtcaattaggtcatgctttacccatatttttagtttagcatcagatggccgttcatacagattataaactccctcctgtcaagaaactagaccgtttggagattatcgttttgttcacaaaagcaagacatctggaaagatttggggtcatttggccacctatgccccttattaaatgactttatgcatgctaagttgaaatttctagaggaagttaattgcgacagtattatgacaagtcactgattaatcattccttggtagatgcaaacaagccccaaacattttcctttgctgactgaagggagtattgtttccacaaatttgtgattttggtagcattccgaatggttgaattgtcaacagtgttgaccacgtccagactagttcctcaaatgtttctatgtttgataattcctgatgaaaagttaatgtgtggcttgttacatgtagatatgcacatggtgcgctcggacattgtcatctttaactgcacggtcacgccaagaagatcggtatggagttgctcaactcacaggctgcaatgctgctgtgatgtctactttgctgtctgcgctagttgccgttgaggcctgtttggggaagaaaactaacccacaacctgcgcactcactgggtccagcaagcattaagtgggctaacttttccaccgggagaaaaggcaatgtaactgccattgcaagcacgcaaagaggtggtcttcacactaaagctttttccatggccgatgttattcgaacttcgatctatcagatggtttcagcctttgagcatgacatgcgggcaaatgctaaagcatcaagtttggagaagaactggatcagtgaaggaagaaaacctgtatttggttcacaggctgtgttggttcagaagctgagcctgtttattgagtaccgtgctgtctgaacttggcatcctgtaccaaatccttaccggccatttaaattattcttggatgaaggttatttcgttttggatttggatgggagagtttgtttgactatgaatctttcgaacagattatgactctcattcaggttcagggggccaatattttatatcaagaacgacttggatagtggcattttctgctcataatcgtcaggatgtaagaaagacatgaattgttatacctatggagagcttttcaaaagataattacatttctccactgggaaaaagccacgctggttttgaaaaactatgccggtgaacctgctgtatactacttttcattttctcaccctggagttgtaatctgtatgttgtcatgggagaaggaaaccagagctgtgctgaactcaataggcttattggaattttcgttctcacaatgtaacttgtttgttagtcttacccacttaacagcttcacctgaagttctagtcaaattctaatgctttcattgatttacgtgatgttgtcgcctaatcttacattttcattttgggttacttgttacagctttgagccatttgaaatttgagttggcaaaactcccttgtgctttttctatgacagtttcatgatttcatcttggatcaaaactcagaaggcacatcctggaagaggcgtactttctaattgagcattctaactatccacctcatcaatcgtggatttatgttacaacaagctcacccaacaaattaccacggacagtggaaatggaccaccaaacagcgaaaatgccggtcattcagagtacttatgtacagacgggtaaacacgttgcttcgactgcaactatcaccaaactttctactacctagttaacgacgagaaacttagctgccaccccctccggcctcgccggcgcggccagcggcggccgcctcggcgaggcggcgagcatcgagagggcggccctcgcggtcgccttcttggcgccggcgacgacggccttggggcaatgccggcgcggcgacaggacgcgcccgcggtgcgcgtccaggcctcccccgcagctctgcgacggcttgaggcgcttcctcggcggcttcgccaggtcctccagcgaggcgaccgccgccagcgacgcgaacgactgcgactttccgtcgaagaacctcgacaaccccctcctgcaaacgaaaaaaatgaaaaaaaaaaacactccggtgtcagctcagctagctcaaggatcatcaaagatcaagaagaacgcgaccagctagagcaaacggcacgcacttgaacgggagctgcgtcatgaggtcggacatctcgaagcggcgctccgccgagctggaggaggaggaggagctcgcgtcgtcggcgagctccgaggacgaccccgacgaccgcgccgagctccccgccgacgtggacggcgacccgatatcctcctcctgctcctcgcaatccgccgcgccgccgcgccggcaccacgcgtacgcgtccatgtatatatccccaactcttgactctccccgaccaacgccgatctcagatcaaggcaagcgaacgcagctcagatcgatcaaagcaacaaccgagccgtgtcgtcgtcgactggtggaaagaaggcagctggtacaaattataaaggtgtggaggaggaggaggagaccgtggccgtggtggcgaggtgagtcactgctggcagaggaggataagaacgagcgagaactgaagtagtagcggagagcgtacgcgaggcgagcggatgagataaaagaagaaaaaaaacaccggtcgtttatttgtttatcgcgtgtgcggcgcggtagggaagggaaggagtaaaaactaaaaaatagattcggcgttatcgcttttcttttgggttttttatccgctgggttcggcgttcgaattcttgctctccgttttttttttctttttccggagaacggggggagggggagagagtggataaggcctccacatgcgtatacgtgtgttcccgcgcgcgcgggcgcatcggaggccacacgcgacgcgatgctgctgcgtgcggctgaggctataggctagcggagtggagtagtagtagcgagtgggcgttgcttgtgattgggggaaacggaggagggccacacgctttacagccacatctttttaacctaagctaatgcttagtactcctatcagttaaaatttttttttaaccaatttaaggttattttatcgaaatttactttctaaattttttgcttttagattcttaagaacaatacgtaaatgtttattcataaattatttttaattttcttttgtaaatactacctccgtcccaaaataagtgcagccgtgaatatccgtgcccaacatttgaccgtccgtcttatttaaaaaatttatgaaaaatttaaaaatatttagtcaaacataaaatactattcatattttatcatctaatagcaataaaaatactaatcataaaaaaaatttaaataagacaaacggtaaacgtgaatagtgtaaaaccgtatttattttggaacggagggagtatgttattttgtttattcatgtataaaccaaacaatggtgccattaattcccgcctgcgccacgcgggtttgtgcagtccacctgctacggattttacttggatagtgcgggctgtgcggctactactacaaatgtgtgtttcgatttaccttgcgcgcgtggcgttcccatcttgttcttccgctgttgctcgtatagtggagtggactgctcgtacttgtggagtactgctctcttatatttaaaggatatatcttaaaatgtgtatgagctttgccctaaagcccattacaaaaatttgattatcaaacaaactaaacgcacaacgagcaacggcatgtgttcattaatcattatgttagtactttttagctagaagcctagaaccgcatcaaagtggcaagatggctttagcctttagttgtccaacagcagtagtatcgatggtacgtaagcttaataggacaaagacagaccatatgtggcatccatttccttttgtctaaaatatgtccccttttgctaaagaacaaatgtacatttgcaacctttctcaaaacataattaaaaaaatgcatgctatttgtcattgtatgatggaatatgccagatccggtaatctgcgactattataagtgtggaacaaacaacttgctactcctttgcaccactgttaccctcctgacagtgaaagaaacacaaagaaagctgcagctagctgagatgagactgtctctaatttaagaagagattattgacatagtctccaaaaaaaagagttaaatgaggatgattctctgtgtacttatcgcgcttcattacgagatgccgattgtgcaaagctgactcagctgacctggtaattgcccccctgaccactaactcgtggtccaatcttcacttttggtcttcgttgtatatcctttcaacaatatggggtacttatcctttcctacgacttgaatttataagctatatggtgatggttacattgggtatgaaatggatatgataatgaaagttggctctataatgagtccatggttttgtttggaggtgaggtgtgaatacactaagttttttactttctccgcttcatattataagaatttataacattacccacattcatatatatattaataaatctagacatatatttgtgtctagatttattaacatctatatgaaggtggacaatgctagaaagtcttataaactaaaacggaggtagtagcttctaacttctaattcattttcttaattttataattacatctttactcctttaaatgtatcttatggttgtgctggtgagtctgtctcaccaccaccacccaatatttggccccacataaatagtattcttaaaatcttgaggatttatattaggagtcggaaattctaaaacaagtagagccgctatggcaagggggaaaaatgtactactggtagagtctacttgtgattaattaaagtaggaaagcaggattagtgcgctaatcgattaagtcttatccgccgctaagtcaacagagtactacactactaatgaacttgcctgtgataacaaaggtacgaatccattcgttcgttctcctagtcacacacaagaggtagtataagaaaggcgaaagcaagtcctttttttgcgacagggttgtaatcttcgggcccaaacccgggaatgccatcattctgatttctggggggcaacattgacgacaccatgacgggttaattaggtaataaaataaactcgaggagttcgcaagcgaaagcatcgatcagaagacgatgacaatttatttaccctttgcctgacggtaatcaacgccgatcaactgtagtatactgaaaaaaatagagagaacattttgacacccaacgcgcgggaacaaatcgaaatgaagtagtatgaaactgtgcagcactcacggaccaatcaccaatttgagtctccgcgagaaacaaacaatcaccaatttgaagatttgtgtattttggatggatttcgggcatggtgcagcgagccaagctgtttttagggtgggcgcttgggccgtactgcacatttcatacatacgggccaggctgaaaaggcaagcctagttctgggctgaaacaagcccaccattgcttgcaacaaattcagctcaacatctcagaacaaagaacgttcatatttcaaaatccgaatcactccagcaacgaaatgagaaatacaggagacaaatttaattttcgcaaggattagaatcacatcatttcatctacggaaatgagcaagactgacaagtgagtgagtgacaacatggagtaataaaccgagtttctaagcatcaaactgaagattgtgtgggcttgtggcaatttatttgccttcagctaacagtagcaacaccaaccaagcatggtaaatacgtacgttttgactgccatttcccacaaacaaatcagcacgaaatcacattagcattcaagaaccaatcgccaattcgaaactttgttgtgttttttttctgcagcatagttcgaacttcgtatacagagatactaccactattctgttgcttttagatgattctctcaactactgtacgtgcttcaacaacagcttaccccttgttgcaaattcagatcagcattcacatctcaaatcacagcagcaacgggatcagaaatgcaggaaacaaataattttgctacgattgaaatcgtaatgtcattacatctatggaaatgagcaaatcacaaccaggagttgggatactactaatcctactactaaaaacccacccgtggcacatccgggtctctctacaccagcaaagcaaaaggacacaacaagagctaaaacaccagcaacagccagtccaggaggcggcggcggcagaggcggccagcgcgagggcgagggaggaccggagggctcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatgagcccggagatgcgcttcacgccccccctcctcgccagcctccggatcgccggcttggtgatcccctggatgttgtcgcggagcaccttgcggtggcgcttcgccccgcccttgcccagccccttgcctcccttgccgcgcccagacatcgccggagaccgagacgagaccgagacgaatccgagatggaagaagagagaagtctactacttggggagatctgaaatcgctgtggctcttggtgagatggatttggatttgggggtggttttatagaattttggggggattttgagtttgtgtttgggcgggagaatttttggggatagatttgcgcttttggtgggtgggtttgggacgttggattggtggtggacgggcgccatgggttggggtgtgtttccgtggattgatgacgtggtgggaggcgcggggatggatccgtgggtggggggaggattgccgttggattgaatcggatggtggggaagctcgtcgttgcgagtggagcggatcggtgacgtggcaatggttctgtggccaggcgaggaacgtgggctgggcccggccgccggttttagccggtctcctgatcagtcacgaggcccgtagcgtcaagtcaccggcccaccaccaccgtccggcgaataaacccgccgcctctcgtttcgccgccgccgccgtcgtcgccgtcgccgtcgccatctccaggtgggtgctatagcgataggctatggctttcgcgccgtccgcgcggagggtctcggccgtgctgtaccactacccgtgcccggacggcgcgttcgcggcgctcgccgcgcacctctacttctccgccgccgcgctccccgtctgcttcttccccaacaccgtctacgaccccatcaggtaaatcttctgtaacttaagagatcgacctttgggccttcgaactactagtttctgcttccaatgttcttctcctccataggttcgtttgaagagatgtgaaatcggcaggaagctgcaagcgagtacaactcttcctttacaatgtctaactgtagtttcagttcgtttagaccgaccaacatctgtggagctgctcaatgttcactttggcattgctttgcgcttattaagctttccctttgtattttagtgggagaaaattgcatctagttggcattctgacaagtccctttttggaggggaaagattatgctttggggtttctattctgtagtgacgtttggtatagtcaggcctaggtgaaatatacatttttttcccggatttcaatatttcatgaattatgaaaatgatgaatgggaggtcaaaattgaacaaagctgtttgatgattttgtcatgatatgagcctctgcacagcagatacagtgatgctcaagtgtttctctttactatagcattattcttactgttaccctctctgtaggagtgatgctcttccatttgatgaaatcaaagatgtttatctcctagactttgtcgggcctcctggttttgtcactgatattgccccaaaagtcgagaggtttgtaagcatttatctactgctatttgctttaagttttgttctgtgtgtgttagtttcatgtgcattatgctgttaatcttggattcttagaaataagattcagcctatgttcattctgtcattcatttaatatacagattcgatttccgtacacttcatgagtagattcagtatattctgtaaaatattttggggaaacacattgtggccatcaactgttctgaatattgctgaactgtagattgtagaagttatgcatcaatatttctatacattctgaattgttttgtagaatattctatccctaatgctaggacaattctaatgtttttatcttgttcagtgtcacaatcttggatcatcataaaactgcctttgaaagtttatgcgggaaccccacactcggagaaaatgtcaataaggtgattgacatgcaacgcagtggagcaacaatcgcatttgatttctttagcaacaaactcttgacaataggtagtagtttatggaatcatagaagtggcaattcttttaatggggtgaaatatctacctgataacaagcttgaaaccgtacacaagcttttcaagtttatagaggatggggatctgtggagatggaccattccgaatagcaaggccttcagcagtggcctgaaagatttggacattgagtttgatgtcaatatcaacagaaagttgtttgatcaggcaagtaacttggtactagtgttctgctacagtagcatatcctcattaaaaattcatggtacaaatctagcaccaccacttttgcatcactaaacctatatattgctagcctaattgttggttaaaaacaaagtctagatcttaaaatacattagtgccttctatacttggacagaatgattattgatgttgtcctactatacgagagctgttacaaaacattgaaatcaccgagctagccatcataccaaaatgctttttcatccaaagcttgtattgttttggtccaataacttcctgtgaagtggtattgttgcagttactggaactggatcctgaggaagtcatttctcgtggacaagcaacattgtcacacaagcaaaaattaattgatgaatgtctggagaaatcctatgaaattgcattaggatgtggcaggttcggtaattgtctggtaaatacctgcaggttttccttttctcttgattattttgtatgttcattaatattctattcatgttttgtcaacattctattatgtgaaggtgaatcgtccctacattcgtctataaattctgttatactacttgtttgatggggctgttgttgcaatttatgatggtccatgagctatatgtttgatccaaattagcacatttccagtaaactggatcagtagctatatttcgtgaccagggattaaaatttgacatattacaagaaaaaatcctgtggtcttttttggtacacgtagctttccagttccaggttctggaaccatctggtgtgcaactccactatccttacataaccaggacgtatcttttttccattagttctgcatgttttttttatttgtgcaatcattcccacctgaatttcaagatagcttacttatggtagctttatggttcgccgccatcgaatttgaggttctcttattatagcttaatactttactgatgcagaggcatgcaaccattcctacagcctaatgtctcagtatccgtaatactttttactctctttgtttgcattttaccaacattacaggctctgctgaattatatttttattgacccttaggctgtcaacgctgatgcaatttcaaatttgagaagcgaacttggaaatcagctagctgacaagagtcgtaatttaaatctgaggcaagttttctgttcaacctctccatgttgatgaacaatccatattgtttcttcaaagcgctatgttgttctaacacgaaccaatggtaccttctccagaagtattggcgctgtagtgtacaaagtacctgagttgaataatgacaatatgctgaaaataagtcttagaagtttgaacgaggaagacactacttctatctctaaggtacttcatcctccgatcaaatctataaggctgtaaagtagcatctgaaaatgatctattttaaggctgttgatttgttggcgtttgactctttttgtaggaatacggtggtggggggcatcggaatgcaagctcatttttgttgagcgttactgagttcgacaggtggaaggttggagctgaaccttgcaacactaaaatgtaagaacttcatcaacaaattgaatggttcataaagaaggaaatgcaggatgttacacaaaagcacaaaatggaaaaaacatcaagtcctaggccctgttcttttgttttcttagctaggaccagccgtgtctagctatctaggcacatgcacatccggtcagtggcgtgcctgtggttcatgaacatgagcccccagtatcattgtaagaaaaaaaaaactgtcagggtcgttttgaacatttttgttggagaagccaattgttagggactgactaggcgttgatcggctgatcgctattaaaggtgttttgaacgattagttgtcacaagcaagtactccctctatcaaaaaaaaattaagctaggagatcctagtagaacgaatttgtattaggagaaatctcctaggttgagttttttttaagacggagggagtagaccggatgcgacggtatgattcatgacatgaactgagcatgaagggaacaggcttggggcatgatcggatggctcatagggcgttcaaagtgcaaggacgtggccttcagccccatagaaaaaaacgaatattcagcgccacatcagcggtacgcgaagccaaacgaggttctcgtagccaaacatggatgctcgttc

SEQ ID NO: 1439 - DNA, 7211 bp, Oryza sativa
aaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtggtgcaatagaaggttatttttgggaactaatgccgatggacagcactggtgcttggaaacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggacttttatgacaggtaaataccgaggtcagatattgacagcaattggggtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatatttcagatccatctaagtttagggtgaaaaagggtcgacgccaaactagacgcatcagaaatgatatggatgagtcagaagcaggtaggaggactttacgctgcagcaagtgtgatctgcgcggccatacttacaagacatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcactgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgttttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgctcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgtgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgtcagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtacttacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacatcagcacacatgaaaagcggcagctcgagttatcactatcaactttcggcgctgcctgttgacataaagtgaatcacgcccacgcgtgatcctcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatggcctaaaaaataataaaattgtattttaccaatcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcttgctgtggggaaaggagaagaggagagagagggggagaggaaaaggtggtaaagtgataaagttagtactagtaggacccactatagacaacttgcactgtgaaaacaagtagctaatattgttcttagtctaggtgacacgtgaggctcaccaaaatttggtgttgcactgtgaacgcctttacagtacttgcttgacgtgttgttctgaacttcaactatatgatccatgcataacagttgtacagtatggcacagtgccacagtgaacctggagtcctctatgctctgcttctgccttccctttcctcttcgttttatcatctactgcctgtcaaaaaaaaatcaaaccctaagtttgactatg

SEQ ID NO: 1440 - DNA, 33203 bp, Oryza sativa
tatttggcaagtttattatatatgttttagaaagagctaatgtccggtatgtatgttgtctttttcgtgcttgagtttctggatgaataattctgagtggagtattatcagaaaaaactaatttgtttatattcatagccagggtaaattttttaatataagaagaaacgatggagtatgtgcaagtgatacaccctgatggttcaaaaaaaaaaaacaccctgatcgattccctctgcttcgagctagtggtgactttttcgaaacaggttggcgcgccgcccacggttgcaccgacccccggcagccagtacgtagcacaggcagtgtaggcacgtaccactgtaccagtgtgtacaactatataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaaagaggatgcgacgcttgccggtcccatggctttagtgagaacgtgcacaggcaggcaggcaggatgcacgggttgggggctaatgcacgaatgttcgcgtgtccgggccacacgcacaaatgcgtctaaaacagcccacgttcgtctgccctactgtgaggtgtctgactcggacttcactcggacctgtgcacttctctttttttttttttcaatcaaaattcctcttggaccttcggatgccaaccacagcctccctctgacgagctttgtttgggcaaccagattttcccccgcaccacagctgatatagcgaatgacgactaaccttgtcaatcgctttagtcattgatcactcaagacacgtcagataaggtgatacatgaacacacaatatttgttaatgaattagtcttcctacgttacactgcattgtagtcgccatctgacatatattggatgattaatgaccgaagtgattaagaaggttaatcatcgctccgagcctccagcaacgagcgttgccatcatctaccacgtccagccctaactggttggcgcccttttctcctgccaccaaactcatcccctgccctctcccaatctacaaagttgtcactggcctcaccatcaccaccgccggtcgccactacttcggttatccctctaagcctcgggaacacccccacaagcaaccaaaatttgtttgtgtggagactctctacctagctatccatcccatatctactaattgtgttgctataagctaggattagagatgataaaggtgttagcctataggaaatgcaaaagtacgggatcccatccttgtatctgccactactaggaaaactattttttccagcggatgaaaacggttttcctaagtggaccggccgtccggtccacctgtaagcaaaagcctgcgaagatgcattttcgtctgtctaccaaaatgcatcttcacaggcggacgagcatcccatcccccgttgccgttttcacaggaggacatttagttccgaaaatgatacccgcctagaaaaatggaagggtctcgttttgcgaaaatggttttcctagtagtgtgcttctcgcacgaggtgcgcaccgccgtcgctcctcctcgataacgagccgaggaatagcacaagcgatggtggtgtaggtgaccaggggccataaggaggtcttcttgcgccatggggatggagcggtaagttgatgcaagacctagcggtgggacaatgaaaacgactgacggcaggagctcggtgcaaagggagccacggagactgacgtcagggtctattgggtgggacgacagttggatgtgcacagcctgtgtgccacactggtcgtgcaccacctttccacgggtcgaggattggaggatatgcatgccagtgccatgaacagtgataggcgacagcttgttcaagatcaggtgtcgcagtcttcctctcccgataccaccgccgcccactacccacatgcaccatcaccagcgcgtgccaaaacatacatagagaaggtcaattgagaaggcgaagcatcaggaagaagacaacagcggattccctaactcgtaccaggcattcatttctgctaggtggatgaaggtggctggtatcctggtgatctaaatgagaaacgcccaggggttttccggctagcttcacaaggtggtgggctatacgatctgagtttaaagcctcactccttctaattatttgatattaggtcattccctaatacgtatgtcttttttttcacggcaatcagaactccgcctccttctcatgcacccgatgccttttctcctctcctcctaacccaggtctaaaacatgataaatatcaatcaagaattaagaaatcggatggagtagttatatacaaatcaatccgtaaagtgagaattatcgcgtgatccaattaaagctttcaccgagcaaccagggtgctcggcatgtacacgcacgaaccatacaagcaagtacagagaccacacaaacaaactccattttcttcaccacatgcacatgcgagggtccagccgccggtgacccacccaagtacccaaactctccatttacgggcgatgccgggccaggctgttgctgttccttcccggcaccacgggcgcggcttctgttcacgccccgtccggcacgcgtggccgtgcccgtgcccgggaaaccgcggccatcatccgtgtccctccttttccacctcattgtttgcctcctttcccatgcatgctgctgctcaaactactgtactctgcatgcaaccagggtttcccttattgttattggcgcggttatcacacccccatggtaaggtggttacgtaccgtggtaactgcgcggttaccgtgaaaactgtgtggtaaccgcgagacatatcatggttttaaaaactgaaaatgttaccatgcatagtaaccgcatgataatcgtgcggttttgtaaacccagcatgcaacccatctgaacttgtaggccttaataactcgaatgccattcgttaaaatgtggattctatgtaaagaatcaaagatgatgctaggcacagatcgagattatggttatatgaattactgatgatgcagagatcaaagatgtatcctagtagcttgttatctaataaaagaccatcaagattatgctggtgcgagttagtactaggctttgccggtagaccatggatcactactcattagaagggacccaacacgaacgcatacgcatcacgcatgcagtgcttcaaagagcgagagcgtgcagttctctgatcactccagcggtgcttcttttgacatagaattattaccgctaggacacactccaagcaaggacgcatgtcatgagctgggagaggtccctactcctccggaagtgtttagatgggactaaaactttttagcccatgtcacatgggatgtttgaacgctaatttagagtattaaacatagactaataaaaaaactaatttcataaatgagagctaatccgcgagacgattttttaagcctaattaatccataattatcaaaagtttactgtagcatcacattgtcaaaatcatggcgtaattagacttaaaagattcgtctcgcgaattagtccaagcttatggaatggattttgtaattagtatatgtttaatactctaaattagtatccaaacatccgatgtgacagagacttggaataagtcctggaaaccaaacagagtcttactcctacatggctaacagatcaatattgtgaacctaagatggtaggacatggacagccgcgtaggccatcgtatgtatttatgcgtggacacagctagtaagtgtatctgtgtataatccaaggacagctttgaggcgcattttgacaactccgtacaaagatcacggatcagcccctgcatgcatgctgttcttcactttcatctgctcaaaatttcaaaaaaaaaaagtttcacctgcgcgtgtatgcatccaatggatacaaacgtacaattgcaatataatccttctaagagcgagagagttgaggagactagcaactcatcgcatgcacgaaaagccaatttgatacatggagcggtggagccatcagccatggatgcggcatgtgtccgagctacatggactaactaaattaaccaatgttggcattattgtccactaattcactcttgcatgttccaaagagagaacctctcataaaggttccgccgaggtgcatgcacttacagaaagtaaatggtgcaatgcacgtaggcattacgtcctaaattctccatctaatggcatcacaacaacaccgagttgcacagaaccctgtcacatgacaggaactcagcaagacgtactcctagtacgtgccattgtgccaatcaccagcgaccgatttgacgcaattattcgggaccgtgcccgatgtatgtagtacgtgcctacgagtagcgcaaccaccggcctcaatttaggccaaatcaaactttatacccagtgaggggatgtgtatgtttttcacctacttcgtactgtatggcttcacaagtttcacatgccatgccttccagtcactccacatgccagcagacagctagctcctacattttgtctcatccacagtaataaaagggttaatttggacttactggtactatttgctgcacctgtttttacccgtgtaggaggcatacaaatatgccttttttgagaccgtaggtgcagaacaagtgcaaatagctgcagaacaagagtagggctgtgtataagattatggtgccattttgagcatgaacagcgggtaacaatcgctagagaaatcgtccacgagttactgccaatgccatgacgctacacgggaaatgcaaggggaacaaatcaacacatttactgctgttgaggaggcaggacaagttttatcttttcccttggcccgtcatgcttgtctcgttggtgctttcacatgcctacttgccttctctaccttttcttccccaccatccatcttttcacttccagctgtaacaacatcgtcaccttaagcatctccatggctccatgaccactggtgttaataagcaatctacccttgcaaaaacactaacactaacctttgcgagaacaaggtgacgaattcaactcctacctgatcagtggacaccgcagaaaatccttggggatgcacacgaccaaagcagcaccagcagtacaactgatcacagtacgactgcaataggataaatgcgcaatgaatagacatgtcgtgagcaaaggtgagcgcataaatgcacgtagcaccggtagacatagtacatttgtaggcagtgatactgatacatacagtactggggagacgaaaggtagaatacgaaattatgagctacgaagacgtcacgatcgctgctcgttggagaaaaagggagagaaaaaacgtaccccagcaagatcaagtcagcaaaagcgaccgagacggcatcatttgcagacaggagtgaccaaacagttgtgcaggccagaacgggggcagcgcctgcctacgctgcacacgtgctgcatcactacccccctccatcgtctcttctttcggaccatcatgtgctgtcccaaaatcctaacagcagtgcgtggatgcttgcctctgcaaatccaacctcattactatctaaaacgtccaaactcatgatcacgatactagtaccacgtttctggaccacagctgggcaaggagccaaggatggttaactggccaccctagacagatcggatgcccgtgaattttaaacaatgtaaggttgttacggtagtggagtaattctgttattcgatgcattctttgagaaatgctgatcatggtaatcagagatcggatgatccaattatgcaagattttcagcaaaactgaggtagtttaatgtaccgactgatgaagagatgctagggaaaaggaaggcagtgaccaggttttccggggcttgtggcatgcagttgtggcaaatcctgagatttgacatgaaatccaagatttctgaagcgcctactcacgctaacagaggaaagctaaatgccactgctgttcggtacactcgaagtcacaaactacagagagatgccgcactagcactacccaagagaaaatatacggaaagcgaggggcgcagaatcaaaagggagaacaggatttacctctgcaggttgtgtcgaacgaagactgactgcctgcctctctcatctttaaacccagcagttaataaaattgccaccgtttccttttccggggcccctgaattgcgcaggtcgccttcagtgacggtgctggttcttttcccttctccgtgcgtgcttaagctctggccccgtgcgtccgtcctctcttttgctttgcttctttccttgcgtgggtctttctttctgtcactttgcttgcatattttgctttcttccactgttgatcaaaggagggttgaacttgagcttaactcaagggcaaagcatcgctctcccgtttttttgctgcggttttcctggcttgaatggctgggagctttgaggggaggagccctgcagctagaggagtccagcaggtatgcaacatgaagcgtttttcttttgcatcttcttttaaagcattgtggtatattcatgcttatgccaatgattcttcttttgctctcctacaattccaacaatgcatctttgctaagttggatggatttgctcttattgtttgtcttcaaggagccaataaaccctgcattgttattgagaaagtattagacaccattatttcattttcaggatatagtaagctatatgcacgtcattttttttccaagatgttgagtgagcatgacatttgcttctgtggccgcccaaagttccaaatgcgcttaatataatgtcatttcattttcttgtctgtatccttttggggttcacttataacagaagacatcaaacctgaaaaggacatcttcctccattacgcgatttaattttctggttctttccttcaggcgcttgttgctctgaagaagggtgcacatctcctgaaatgtgggaagagagggaagcccaagttatgcccattcaggctatcttcagtgagtagcttcgttactgtaattatgcttagcagcatgctaaagatcgattttattcattaactttcatggattacgcatgcaacctagtgacgactagagacatgtagcaaaacatatgttcagtgcctatgagatatttatttagttgtgttaatctgaatgttctgaacatttaacatgaatgactccattacaggcttatttacttaatgcacggaactttgatggaagaagtataataactattcagccacttgaattaaacaaataaaaattaagtccgcatgaagctcatgccaagtaaattaactgatgctacttagtttgttttggcttccaagttcttcaccatgttccgttgagcagagccatgaccagaactcttagatgaattccgcccagttatccacttctccttcatctatctgcatatcaagatctcacgatgttcctccgcaacctttcaaagatgttccttgttttcccaccgctgataaacagatgacatgtcacaatgagattaacatttatggccatacatacagctacgtcagtagattactccaaatctagctctctgcactcccaccatccatcctttattctgaaattagcaattcaatttccgtaatgtagagaagattgtaacactatgaacacaacaaggtatgatgtttgaatattaaatattctaaaattaggtctgcaatatctacttcttcccagttcccatggaacgtatccagttcagataagtagattgagtaaactgcacattaacgtcttatctttttaaaacattagaattcaagatgctgtgcctctaaataacattaacatgcttcttttgcaggatgagaaaatgctcatgtggtattccaaagacagggaaaagcgtttgaacttgagctctgtctcaagtgtagttcttggacataagacagtatgtggttttcatttctcaagcacattgctattctttgtccatagtacatcattaaggatagaacacgttcattttctgaggattctagtattttacagacaaaacttttacgtctgcattggccagaaaaggaatcccactcattgtcagtcttctacaagaatggtgaatgttcacttgacttggtatttttactcactaggcctgttgtttagactttgtaaattttatccttcacattattaccttccgtaacatttttctaaatcacatttcgcagatttgcaaagatagggatcaagctgaatgttggtatataggcctaacaaccttactatcagttccatgcagtccagtacttttgattgactcaacaagtagccgtcggataaacagctgtacaaatagccctcctagctatattcagcaaaggagtaggctatttgctgtgcatgacacaagaaagtttaaacaggttcattctataacttgtgcatgctgtgatttctatgtgataattttgcaacttaccacaactacaagtgtgttttgatttttcctaagttatgctaagtaacacgatttgatccataggctcaggaaattgtaaatatgtaatatttcaaatgatggtcatgctagttgtgttgaaatattattcatttcaactaattagttcttatccaaatataacaataatgatacagctaaatgacaaccacattgacagacttttgcataaatgataagcgacacctctttttttttcttgcaaatcatgaaactaagtagagcgatacgacctacgattggtcataagttgccctatgttctcagttacaaagtgtgtttcacctttttagttgaaatgacatgtttttctacatgatttctccatcaaggtacactcaatatatggcagtcctaggctgatgcagaaaaatgttttgcaaagcaatctggatttctcagaaccattcttctctccaaggcagaggacatggtcagacctagactactacatggaaaaggtcactcccgatgtggttaatagggtaaaacacagttgcagggatataaaagttgctgacaaacttaacgagcaaataattacccaactgcctaaacaaaaatcatctgaggggttacatgttgcatatggagcaacttctctgaaggacatctttgtctggggagaagttcctggcaatgttttagatcatggagatgtatcaaaagccaatgtttcacttccaaggttattaaacacgacacatattattgatgtgcagagcgttgcttgtggagagaaacacgcagcgatagttactaagcagggagaggtcttctcctggggtgtggataatggtgggagattggggcacaaagtgagtgtcagtgtatcagatcctaaaattatcgagtctcttgcctctacacgagtgaaggctattgcatttggagcaaagcacacctgtgcagtttcaatttcaggagaactttatgaatggggtgaagggactcactgcttgggtttgtggggtgatcagtatcaaagaagccaatggttcccacataaattgtttggtcctttggatggcatctcaatcttgaagattgcatgtggtcattggcacacggctatcatatcctctgctggccagctcttcgcatatggagatggaacctttggtgttcttggacatggtgacacgctgaccgttgctcggcccaaacaagtggagtccctgaaaggggtacgagccaaggccattgcgtgtggaccatggcacacagctgctattgtagaaagaatgggcactgtcaagagcaatgctcctagtgggaagctgttcacatggggtgatgcggatagagggaagctgggtcatgctgacaaaaagatgaaacttgtaccaacttgtgttgagccactcaatgattttgattttgctcaggtatcctgtgcaaaagcacaaaccattgtgcttacaataaccggtgttgtttttaccattggaagcaaggaacacggacgattagggaaccctctgtctgaggacacatctatttgtttaattgaggggccacttaagacagagtttgtcagagagatatcatcaggctcttcacatatagcagttttgacaatgaatggaaaggtgtttacatggggcaaaggaacagaagggcaacttggtttaggtgactatgttgacaggagctacccgactctggtcgaggccttggaagacaagcaggtgcatagtatagcttgtggtttcaacttcactatggcaatttgtttacataggccactctcaagcaaggaccaatctgtgtgcagcaactgccagctaacatttggctttacgaggaagaagcacaactgttacaactgtggttccatgttctgcaattcctgcagcaataacaaggtttccagagcagctcttgcaccagataggagcaaaaggtaccgtgtttgtgatgcatgtttcagtcaaatgcagaaagttgaggagcatagaaaattagatccacaacagaagatccaaaaggatgaggtatgtccaatagaaataagatcatatacgccaaaattggcgcgcatattcaaggaagcaaatgcaattatggagaaaatggcatcagcacaaagcccccatcagagaagtcagaatttggctgtgccagatcatgtgaggacattaagatggggcctagtagagtgccccagtcaattcagatgtgtgagagagagcattccttattgttcaacattgaataaacagacagtctctggttctattgtacgggtaatgaatgagacaatggcacctaaacctgccagctctttgctcaaatctgctaatgattcaaaagcggaattagacttgatggaaaatatattattggaagaagtgaaacagcttcaagagcaggtaactgacataccatattctctgtaataaacatgtttcgtggatcggtttaaattatttgttttcactgaatgtttgttctggtatgcaacgtataatttagtgataaagatggaaattatgttttatataagcaggtaactactcttgcaaaacagtgccgccaaaggagcctgaaagttcagctgtacaaacgaaaagtcgaggagacttggttaattgccaaggatgaggctgcgaagtgcaaagctgctaaagacataattaaggttttgatcgatcaggtataaaaccgatgacctatctccatttgacagatttaccggcttttttttctaaataagttgtgtggggtgcccaattgtgcagcatgattttttatcaaagaaccttttggctggtgagaaattagacaactccagaatcatgcctagccacatcgccagtgcaaaatcactaaaagcagaattaccagacccacctgacaaaaatgtattcaccagcgaatttcaacagtcgaagagcaacagagatcaccacaacagcaggcaggtggatagggaatgcacacaaccttcaattgcttccatggcgaattactcggttacgcatcagaattgcagaagaacttccaacggcagcaccagatgcaccgagggaacagatgccaccactgctcctaccgattccaacggtgtgatcgagcagatcgagcgcggggtttacgcgacagtggttacatcccccggtgggaagaagtgcatcaagcgcatccggttcaggtgagatcccccaagaacctagattataatcaatcagttgtcaacgatggcatcatgtcttacctttgcaataactaactctttcaatctcgcagtcggaagcactttggagaggatcaggcgcagaaatggtgggaagccaatgagagcatgatttttggaaaatacagcagcatggaacaaacggtggggtaatctcttctccaactccaagcaacccaaatgaagaacataaaggaatagtcagctctgccgccaaattgttaataggacacagtagaagtagatagaaatatgctactgctcgatgaactggcgtggataggatggggatcatggagaaaaatcagaaaaaggggttgagactttgagagaccagctctgaacagtaaactgcatctggattgtgcggctgtggcttgcggaatttggagtaggatctaggtttaacctctccacccgtttgaattggattaggaattgacgcctctttggactgatttcgattacgcgagggttagtatgtagcgtggacgcgttggccttccctgatcggagagattaaaagcaaaggacagaggagacgagacgtaccggagggtccagagcggcgccgtgacctgatcggcgcagacgcctgcgcgcctccctccgccttcgtttcctcctcctcctccccgtttcggctactcgcctcgtcgttgccgacggtggcgtgcccacaccacctcaccgccgccgcgcttcgcaaaggcggattccgatatcatgttgcggattttggtcgatccggtgttgcggcctgcacgtatcttaaagcgctattagaataaatcctagcctttggcttttctgtttggaaccatattttcgtcctcctaacttccattttgcgcttgccactagctcatcattatctgagttgttatctttagagcaagtatagcaggaaatacctctaaatcatttataatcaatttatttaatatgtaatacatatataattactacatctgtcccaaaatataagcatttttagctataaatctggataaacagttgtccagattcacagcaaaaaatctatctatctattatattattaaaacagctttgaaaggagtcaccacattcgctgtgggggctagaaattcccacattaatcggagaaaaagaaaaaaaaagaaaagaagagtccaagtagaagcacaatctaaaaatagctgaaattcggatttaaaaataagcaatattgaaagaagtttccatataagaacccaatacgagattaatcaaaattcgaaataaaaataaaataaaatctaaaattagaaaaggaaaggagagtccaagtagaaatacaatttaaaaatagctgaaattcagaattaaaaataagcaatattggaagaagtttccatataagaacccaatacgatattaattaaaatttgaaataaaaataaaataaaatctaaaattagaaaaggaaaagagagtccaattaggaatacaatttaaaaatagctgaaattcggaattaaaaataagtaatattaaaagaagattccatataagaacccaatacgagattaattaaaattcagaataaaaataaaaataaatctgaaattagcaaaagaaaataaagaagagttcaagtaggattacaatttaaaattagctgaaattcggaattaaaaagaagcaatatttaaagaaaaaccatataagaacccaacacgagattaattaaaatttcaaataaaattataataatatccaaaaatagaaaaattaaaacagagttcaagtaggaatacaactttgaaacaactaaaattcaaaataaaaaataaaaacattaaaagaacacaatacgttattaactaatttttttagaaaaaaataaattctgaaattagaaaaaaaatattttaattaggaataaaatttataaacaactaaaatttgtgataaaaataaagactattgaaagaaaagaccatctaaaacacatgacgagataaattaagtaacatgcctataaagtagtagagttggtggcggttaatactgtcgacgggtgatacccgtagaccggatatagagggtattggggtacgttggtacaaggatctacgtagtacgacatcaagcaaacaaaagacaagaattatactggttcaggccccttgacaggtaatagccctaatccagttgatgtgggattatatggtaaaaaacataggttacaaagagaacaagggaacttgtcggatccggcgagattgtagtcgagttgattcgactagctctcgatgacttggctccttgcaagcttcggcttcgtaggctgtggaggttgtgttgggtctaaaattcgatcctaaaccctccccgggagccccttttatatcgcagatgtggaggtctcctcatagaactcggaggtatcagaccctatacgatacgccaacgacccagttctgcccgagtaggattcttcccatctgtagattccgtgaaaagtttccttaggatatacaggaaatatccgcatgcgcgtgggtatgccatatcgatatgtaacgtatatcgaagggtaaagggtatgcctaacccgtaaccctgacagtagtccccgacttctgcttaaaatgaactcgtgcaaccatttgcgacttcgggtgtcgagactgttgtcattcccggtgcgaggaccgtggagatagaccgtagtcgagcacgccatttgaagcccaacggtcacgagcgaattttaaactgaagtccaaaaaaccgccgcgcgtaacgggaccagaaatttccggtgggcatctctctctgttccctggaattcgcaccgtcggtagtgcgcctatttaaaggaattttgggagtccattttgaagtccgccaaacctgttatacacgcaccacctccaagaactctttgccttctcagccgccgcaagaaaccctagttcgtcaacctaggctcgttttccggcgaccttcgatcagcaatggacctcggcaaatcggcttccaccagtgcaacgttgaagaaactccaggaggatggcactcttcctggctgtggaaccatggagagggaagcatgaggtactaatcctcagcccatcttgggtcgcatggttgtgatcgaagattatgttctctgcggttttctccctccaccttccgaatttcttctcctggttttgaatttctatggtctttctcttctccatttgaaccccaattccatcgccttcctcagcatctttgtgcatctttgcgaggcctacattggggtagagcctttccttgatctttttcgcttttactacgaactgtgttggatggaatccaacagggtatctggttgcgtcgggttccgacttcgggatggcctgaagtcgcgttacattcccttccagtgccttcttctcgcagcaagtggaggaataggtggttttatcttgagatcaagaactcgaaccctgtctttgtggttcccgaagatcaaccggataagattccgtcttggaccgcaaagccccccttgaccccctctcttcagtcgtttatcgacatcatcgacgatctccgagtacggggtttgtcgggatatgaagtcgttgcagacttcgttggtaggtggatccagccgcttcaggctcgggcccatccagcttataactattccgggtcagaggacgcgacccgggtttctcctcggggtatctttctcgcatttatcttgacatacttgtgtttgcattcctcttgacttatcgaaggttggttctcgattaacaggtctgagcggcaaaaccgtggagcgccgcgtcggccaagtgatgatcagtggcccgaccacggtgagtgacatccctgtgcccctttgtgaaaagggggcggcggaacgtgataaagccatcaacgtaagtatattcgataaacatcctgcattctcctttcgaaatcactttatgacttgattgagcgtaggctcttcctttgactgatgtcatcggaccgctcgcggaccatcaggtggcgtcatctctaaaagtgaaggtcgtcaaggaggtgtctgatgctgccaccactagcggtggcaatgttccgacaaagccgaggaaattctcgtctgtaagcggacatcgtcgcaaggcgtcgaccccctcggtaatttattttgtcgttaaatcatgcagcaagaaggatttttccttactttgcgttgattgtctttcaggcctcggacgcgtctcccccacctccacgacgacaacgcattgtgacgatcggcgagaagtaagtagatgaattcttgaatccccgcgcttcttattcgattattgtctgactcatggtcgtcctgtagggaggcgcggacaaaggctgcacgagccaagtctagaggagcttccagtgcgtcgcccgtcgtggcctcaacggatgtcgtgcccgtagccgagagccgggaggcgatgcctagtggcccagtcagcgaccccgcggtaggtcgtgatctgccagctgcagtcctcacctgggaggagctccaagtcgagatggggcgcctcctcgaagccggtgctcgcggcatcgaccgcgagattgcggaggcgaggtcggaagcggcgacggcgaacgcgcgtgctgacagactggtgtgcgagttggttgaagcccgtgaagacctcacgaagatgagggagttggcagccggcaacgagcgacaacggaaggggctcgaggaccgaatgtcggaactcgggaacaacctatctgagatccggggctcgttgagggtcacctacactagccttcaccagctcgtcggggaatgcggcgtcacgtccacgatcccggtgaatcccgatgagttttcgctgacctcctctctcgcagaattggtgacggcgatgggggaaatcccctccaagcatgcggctaggattgcggaggagacgtcaaacggaatctacaccggggcgtgtcatgtcctcgcgtgtgtaaggctgtcgcgtcttgaactcgatctgcgtgagatcttggaccagggggcggccagcgacacgcgtaaggaggtgatggaagaagtcggtgatctgggggagtctgttctccccctttttgaagagtaggacttcttgtatttcctagataatgtgtaaaactcgaactctgaccgccttcgtgcgtgcgattactatcccggcttactttggtatgctgacctcgggaacttttgtcctctgtagagatactgatcacgaggatgtccagcagcgcgggcagctcgagtcactggcagtaattccggtactcgagtttgaaccacacgtctcgcctgaccatgtggatcaaccccttgatatagagggaaggacggcgacgacttcctcaggttagtagtcccttcaccccttaatgcccacctgactaggtcagccatatcccgaaagagatgtatagcttgacttagtggttatcacgtttagcagatctcgagggtgtccttgctagccaagatcgttgtatccaatactggaagacgaagtttgaagtggcagagctcgagagaaccatgctggccatgaagaaagagcagactgtggaaacgctccgaggtcgtgaggtgtggtttaactcgtacttgaagagttgctgcacatccatggccagagtatgcagggagcttcgagtagtccgcggagatcccgaggagtcggcggccgggtacatctcgtggcttaatggggcctgtgcccaactcgatggaatcggaaagcgtatcgacgaggccttgaagcaggagtgtcatcgatcgagccgatatgctggggggcacgtgttggcttgcctacgagatcatcgcccgcgcctggacctcgaatatcttcgtgagggttttgctcgttctcgaaggactccggcggagatagaccatctggcaaggtcaatgtcgtcgttggccgagaagatcttctagtctatggactggcgttggccttcttggtagtactcgtaccctatgacaaatatcttaggaaaagatgtaatgtagcgaaagatttgtgaaaaaactgtaaggagtattttgtgaataaagaaatctatctttgacaaatgtctcttactctggatgtcatgtgtaagagtgcgttctcagttaacgactttagtcagccgtttgagtcgtacactctccctagcccccagccttgtcgtcggaggaattttctcggaggataaggctcttggacctttgacctgccttggttgaataagctttgatcctagcccccagccgtgaagttggaaagttaatttccgatttcacggcttggttaatacgcacggcgagaactcttacacgaccagatcttatatggtctttcgtctctacaggatctgacaaggccttatcggctctgggcgtccccagccgaagatcccttaggttcctcagaggccttgtcgagacggcgtaaagggacataaggacaggtttcaacactaggtgtcatcagagtgagggatcatcgggggaaacacgttgattgtaatatgggcctagaaatagcctttattaatactgtaagggtgcttacaggtatggatggtattgactcatacatagaatttacgtagttggtcaatgttctaagaatttgctaattcacgaccgtcgccgtctacgattttgaatgcgcctggctgcaagacttgtgtgatcgtgtaaggtccttcccatttaggtgagagtttgtttcgccctgcttggctttgaactcgtcggaggacatagtcgccgatcgaaagtatgcgtgcacggatgtgcttcttgtgataacggcggagggtctgttgatagctggctgctcggacggcaactcgttcccgatgctcctcgagaagatttacatcgatatctctctactcctcctggttcttgtcggagtacttctgtactcgtgtactctgatgttgtagctcgcctgggagcatggtctcagagccgtacacgaggaagaagggtgtttccttattagacgttgtcggtgtggtgcgtacggcccatagtactgatgggagttcttcaacccaccttttgtcgtgtgacatgagcctgtcgtagacgcgggttttcattccttgtaatactatgccgtttgccctctcgacttgtccattgctttgagggtgagagaccgaggcgaagcatattttgacccccaacccgatgcagtagtcctggaaatcggcgctgatgaactaggagccgttgtcagttatgatgcggtgtggttgtccgtatctgcaaaatatccctttgatgaatttgatggcgttgtcggccttgatttcccccgtgggtactgcttcgatccatttggtgaatttgtcgatcgccacgaataggaatctgtagccgccctgtcctcgtgggaatggcccaagtatatctagcccccagcacgagaatggccaagtcagagggatagtctggagcgcttgcgcgggtagctttgtgtgtttactgtggaattgacaggcttcacatcgctggaccatgtcgcatgcatctttaagggcggttggccaaaaaaagccttgtcgaaaagctttgccgaccaatgtccgaccggcggcgtgtgacccacatatgccttcatgtatgtcgaggaggaggtgtctgctgtcgtcggtcgagacgcatttgagaagtaccccgtttggcgctttcttatatagatcattgccgaccgtacagtagatctttgctttacgggttattttctcggcctctgtatcgtcctcgggcaactcctcgctgctgatgaatttgattagtgggatgcgccagtcgtctgtggtttcgatgtcggcaatggcgcgttctgcctcggtgacctccgagctaatgtcgggggtgttcgggctgactttgccgctaacctctttcaccgatggcttcgtcaggatgtcgagaaaagtgccgggctcgagcgattctcgtctggacgcacgtcatgctaggtcgtctggctcgacgttgtccttgtggtagacgtgtcggacctcgatcccatcgaactttttctctagtttcctgacttctgcgtgatacttggataactcggagttagagcatttataatctttgtgtacctggttcgcgactagttcggagtcccctttgacgattagtcgcttggccccaagtgtagctgcagctcgtatcccggcgagtagtccttcgtattctgcagtgttattggttgccctgaagttgaggtggattgcgtgcttgaattgatctccggagggagacgtcaagataaatcatgcccctgctccttggctgttgagtgcgccatcgaacgccattgtccatgtttcattgtcgccttggttgtctaatttgttatctggcatagtccaatcggcaacgaagtcggcgagtacctgggacttgatggctgttcgtggcacaaagtggacatcaaactggctcagctcgactacccatttcgcaatgcggccgacaacgtctttgtttctcacaacttcaccaagagggaaagaggagacaactgtgactctgtgggcttgaaaatagtggtgtagcttccttgatgtcatgatgacagcgtaaagcaacttttggatctgtgggtatcttgtctttgcgtcgtggagagcttcactgacgtaataaactagtcgctgtactttctctctctcgacaacaatgacagtgctaacggagtgtggcgtggcggcaatatagaggaataattcttcattaggttggggagcaacaagtacaggggggtttgataggtagcacttgagtgcaatgaatgcctcttcggcttcctatgtccatacaaatttgtcttgtttcttcaacagagcgaagaaaggttgtcctcgttctcccatcctagcgacgaatctacttagtgctgccatgcatccggttagtttttgtacctccttgagtcttgtaggcgacttcatgttctcgattgccttgatcttctcggggtttgcttctattcctctgccagagacaaggaatccgagcagcttgcccgacggtactccgaacgtgcacttctcaggattgagcatgaggcgatatcgtcggaggttgtcgaacgtttcccgcagatcgtcaatcaatgagtcgcctgtcttggttttgacaacgatgtcgtcgacgtaagcctcgacattgttgccaagctggttgctaagtgcgccctggaccgtgcgctggaaagtattcccagctgttatcagtccgaatggcatcttaacatagcaaaataccccaaacggcgtgatgaatgctgtcttctcttcgtcctcttttgccatgctgatttggtggtagccagagtaagcgtcgaggaagctcaataactcgcaaccggctgttgaatctaccagttggtctattcgaggaagtggaaagtgatccttggggcacgccttgttgaggtcggtgaagtcgacacacatcctccattttccgttggccttccgcaccatgactggattggctagccactctggatgaagtacttctctaataatgccagctttgagaagtttgtcgagctcttctcgtatggcttgttttcggtctggtgcaaatctccgcagtctttgctttactggcttggcatcgggtcgcaccatgagtttgtgctcaatcaccttcctggggacccccggcatatcggacggctgccaagcgaacacgtcggcattgtcgcggaggaaggtgatgagcgcgagtttctatttctcgtttagtgttgccccgatcttgacggtcttgtcggggttggaactggagagtggaacaatcttgatggcgccgtctggtttcggcgtcttatttgtcttggtcactttcttgggtggctcagtcgtggcgggtgggctgggcgtttgctcgaccatgtcgaggctccgcttgtcgcattgcaccgccagctttgcgttcccctaaatagtgattgttccctttggtcccggcatcttaagcacttgatatgcgtagtgagatgcggccatgaacttcgcaagtgcagttctcccgatgatggcgttgtaagctgtatcgaattcagcaacatcaaaggtgatctgttctgttcggaagttgttggcttggccgaaagtcacgggaaatgtaatcttgcccaaaggtctggacgatgattggggagtaattccgtggaagggttgatcagttggtgtcaactcgttttgcggaattcccatcgcgtccaaagtgctggcaaaaagaagattgattgagctgccaccgtcaatgagaactcgcgctaccttgatgttccgaatagtgggttcgaccatgatcggatatcatcctgggataacggcggtcttggggtggtcttcttccgagaactctatcttctgctcagaccacttcatcttgggggcagccccctgccatgtcgagcagacttcacgttccactttcttgtattctcgcttagaggagtacgttgtggaaccgccgaagatgtgtgagacgtggaggttggagtctagatacgctgagtccggttcgtgaggagccgtctcttcgttcgtctcaacaacgcgtactcgcttgcctttttcaaatgccatgtgcttctcgagcgactttttgaaaacaaggcaatcttccagagaatgtctgtccgtcttgtgtatggggcaccatgatttctttgtgtcgctgctttgtgggtctgggtgtttgggagggtttgcgtattctgctgcgaggacttccgcttgagctttcattttcccgtttttgcgatttttcttcttgcttgactcagatgtgtccgtggctggtttcttctctcccccggtcttcggcctatcgttcttgcgtcttagcacaacattagcgtgggcacatcgctcaacgatctcgaataatctccgagtgattgtgatgcgtcttgtcgccaactcctgggtagtgtagcgatctctgacaccggatttgaaggcgcgaattacaaaagcgtcggtgatttcaggaattgtgtttctgcactcattgaaacgtcaaacatattccctcaatgattcacccgagttctgtgtcaacgcgtgtaggtcgtcttcaatcgcgtggcgcttgtatgttccttggaaattggcgatgaattgttgccacaggtctgcccacaaagagattgagtagggaggaagatgcatcagccatgaacgtgcagaacccttcaacgcggttggtaaatagttcgctatcgcgttgtcgtctgctccggcagcatagagtactgtggagtagacttgaaggaactcctctgggtcggtgctcccatcatacttttctattgctccgggtcggaatctctcagaccatcagacatcacgtagggaacgaccgaaagccctacacccagcgttggggcggtgggttgttggcgatcgtgtgtccttcgtggatatctgtctgacgatgaggaggacgcggatgatgacgatgacgatgggtcacttggttccggcgtacgattacgaggatgacggcctggatctcgagaatcctgtcgtcgtcttccactgttgtctcggcgccgatctccatcgtcgtcgtcgatacggtggcggccatgaccagtattgtctggcacccgtcgttcgcgatcgttgtgatcgtggtggttgtcgtggtcccggtcctcgtttgagcagtctcctcgatttccgttatcatggcgccgtgaagagacatgacgtcaagagcgattcacgttgtctcgtgtgcgtcgtgcttcccggcggccgttgatttgatctcgaagatcgccagtgccgcgaggtgaaggggtagctcgttgaggtgattccctccgttccggatcttcactattggcctcgccagttggtggctgctcctggtgtgctgcggtagcggcttcttcaaacgcgttgctgaggttagtcaccgattcccatagtcgttctatccaacgctcgaggtcaacgttcagaacgggatcgtaaggagtttccctcagtatcgcttgaacgggcctgatgtgctgggcttgagtagtcgattgtttccccgcttctgcgttggcgtgcgctgacgtgccaacatcatcgatagccaatacctcccgcggcgtgctcgttgtcgatgacccatagtcctcgaggagatgtaagaccgatggttcgtgaggatcgatatcgattactccaacgaatcgatctgaagttggagtcactccttgttccttgtcattatccctgatggggacatatgacttaggagactgagctttcatggcgccgagaaagactttgcagctcgagaggtcctgattctttgtcttgtgaataggacaatagacatcccgagttggagaagtacgctgaattccacgttctttgcaggcgcgaatttcagcacggacgttgaggaaaacccagcaatcttgcaaggtgtgtttcttggttttgtggataggacaccaagaccttgtggcttcggaagtcatctttgtcggctcgtggttcatgtcggaaggacaaggtttggccgtatcagaatccctcttgagcttggatgtcgtcgatattccgttctccgtctcgacgagaggattttttgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttaagtaccaaggccccctacctagcgcgccactgtcgacgggtgatacccgtagactggatatagagggtattggggtacgttgatacaaggatctacgtagtatgacatcaagcaaacaaaagacaagaattatactggttcaggccccttgacaggtaatagccctaatccagttgatgtgggattatatggtaaaaaacacaggttacaaagagaacaagggaacttgtcggatccggcgagattgtagtcgagttgattcgactagctctcgatgacttggctcctcgcaagctccggcttcgtaggctgtggaggttgtgttgggtctgagattcgatcctaaaccctccccggggggccccttttatatcgcagatgtggaggtctcctcatagaactcggaggtatcagaccctatacgatacgccaacgacccagttctgcccgagtaggattcttcccatctgtagattccgtgaaaagtttccttaggatatacaggaaatatccgcatgcgcgtgggtatgccatatcgatatgtaacgtatatcgaagggtaaatgtcacgaccggaaataacccaacgggcgttccttacgtgcgtgtattattccttgtcccaggaggcaaggtacaccaaaagttgatacaatacagagtttaacaagcggaagtgtaaatagataatttattacatgggcggcgaaggcccagcacacaggaagacaaacgaaaaaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagttataacatagggggttagggtttgcagtaaacagcattaaaagacacttagttgctcaaagctattttgtaaatacgatcctagagctatgcaatattattaatcaaggccgtgaacccacacgaacctgccttaacccaagacctacgatgattcagaccgaactggcaacccgaccctgggtcccagctcgtcccaagccaacccaggccaaccattccacattttagttgttaagcaggttttaagaattaaaacactaacttgggtacattgctaggcttgcctataaccgagggcgcggctattcgaataggttatactctaatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctctgggacaggtaggcaggactgagcccctagcagcaggacaccagccctgtgccatgacatctcgactaccgggccgcagctcgtgtagccttcatttgccctagagatgtccatcgacccctgacttcgtccatctccatccgtgtacttttgtttataaccagactgagccacaaactaagccttacccactagacatgtggaagtacggtagtgctttgcaacataggcccgaagaccggtccttatgtggccgaggtgctacaatcaaaaccatgcaccccgagcccagcctaaaaccattttgaggattttgaatagagggggaggtgtgaatccaattccacaataatccaaccattccatagtgtctaggtgatatgaacattcccaaagtctagagttgtaaaaccacctaatgttgcttaattaagcagcgaagcatctacctaaattcatactagtggtaccatgcatagggtacctactagttgggggttttgtttagtctagggtgaacaaggtaataataacaatagcaataataattaggtcataacaaaggtaaataggcatggctaaataaaacagtgataacgcgggaatttaaataaagcgataatgcattaatttaaatcaaaataattttataaactgggattcaatatgttcaaggatgatgtgacttgccttgatcactttcccaaacgtcggcttcaaccttcacgaagagcggatcttccgaagctgcagcgtctacacgaccaatggaaaggaaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaagtgaatatttgcgaatttcttcatttaaattttaatttaaaaatggtttattgcgtcagccgaggggagagggcgcgcggaccgggtccatgggagtggggcccacgccggcagcctcacggtccacggtggaccgggcgctcccgggctcacaccggcctgcgccgtgggccccacgcgtcagccgcaccccagggcgtaggcggctgacggccgggccccacgctgcggccactccgcgcgcccgaaggcggccatgccggcgcggtcggcgggaggcggcacctgcgcccctatggtcgccggcggcggccataggcacggcggagcatcggccgagagaggggaagggaagggggaaaagaggcggcggtccacggctcaccctaggtcggcggcgacgacgaaaaaggcggccggagcggaggaaggcggcggcgcggcttgggtcgacggggacgcggcgctccggcggtcggcgagcctgacgagggggtggacggggacggtgacggtgcggcgaagccggagaaggcgacgccgaggcgggagacggtcccggcgagcggagagggccggccggaggtcgtctgcgacggaggagagagagggcgatggcgcgagctcgattccggcagggagacggtgcggcaaggggcagaaacaggcgagggaggcgcggggagggtttaaatagggttggaagggggagagggcggccgggagaggaaggaaaccggccgggaggtccggccgccatcaatggcgccggcgagatttgcgggagcaaatccgcccgtttgtatgcgagagagagagagggaaaaatggggggaaagggggaggggatcacggggaatatttccccccactttattgcacgcgggaacggccggaggcggcgggattcgcggcggcggcggcgctaggcgcgggcgaggcggcgggagcgcgggaggaaggagatgacgggtgggccccacccgtcagcgagggtggcaggcggacccgcccgtcagcagcgcacgcggggaggggccgtgtgggccgcgagggaagaggagagagggggagggaagtgggccgagccggcccaagagagggaagggggatttttagggtttttttttataaaacctttttaactttgtttatttcttaacaattattatttgtgctatgaaaattccactaaaatttatttacatattttaggcttttaggaaatatacaaaaatcctctaagccttatttgacttttactttggcacattttaattttggaggctttcacacggattttaattattctaggcataatttagagaatgtattttagggtcgttttgggacgtgacagtaaagggtaagcctaacccgtaaccctaacaaatacggcatataaaaattgttaataaaacaccaaatagaatcctaatgacgattaaaaggagggacgtcaagcaggccataaagcaaacaagtaaagcggttgccgggacttctagaaagtataaagaaaaaaaatccacattgataatcattttcgatttttaaaatctcaatgacaataaaaaggagaagcagcgagcggggtgtataagagtatagttgcagagcctccgacggttgacgggacttctagaaaataaaaaatgaattgcaacgatagttatgttcgatttttaaaattacaatggcaataaagagtaggcggcggacgggctgcagaggggcatagtggcatcgtttgatgagacttttaaaaattataaaaaatgaaactacaagtctaatttttaaaggttcggaacttctaaaaagtaaaaaataccaatgataatcatgttcaattttgaaatctcaatgacaataaagaagggaggcatcgggcgagccgtagaggagtacaatggcaaaaccgctgatggtttggcgggacttctggaaagtaaaaatgaacccaaactataattatgttcgatttttaaaatctcaatgacaataaaaagaagagatagtggacgagatgtatatgagtataacgacaacgtttgacgggacatctagaaattataaaaacgaaacccaacgtgacaataaactctaaaaactataaaatccaatttttaaaggtccaagaatgaatagaaaaagtgatagatcgagcaaacaaataaagaatgagatgacataaggggtagcaactggtgtgatttttaaaactatataattagaaacatgaggatgaggatgataaggtttggtctttcaaagtgttaacaatgagatagctatttaataaatttcaaggaaatcatacttaaaaaaatatatgatttttttgctagccgcgcaattgcgcgggccacccagctatttatattattaaaacagctttgaaaggaggcaccacgttcgctctgggggctaaaaattttcacattaatcggagaaaaagaaaataaaataaaatgagagtccaagtagaagtacaatctaaaaataattgaaattcggaattaaaaataagcaatattgaaaatagtttctatataagaccccaatacgagattaatcaaaattcgaaatgaaataaaccaaaatccaaaattagaaaagaaaaggagagtccaagtagaaatacaatttaaaaatagctgaaatttggaattaaaaataagcaatattaaagaagtttccatataagaacccaatacgagggattaatcaaaattccaaataaaaataaaataaaatccaaaattagaaaagaaaaggatagtccaagtcggaatacaattttaaaatagctaaaattcggaattaaaaatagggaatattaaaagaagagtccatataagaacacaatgcgagattaattaaaattgggagtaaaaataaaaataaaatcctaaattagcaaaaaaaaagaatagttcaaatcggagtacaatttaaaattagctgaaattcggaattaaaaaaaagcaatattgagagaagactccatataagaacccaatacgtgattaattaaaattcagaattaaaaaaataatatccaaaattagaaaaattaaaagaaattcccacattaatcgaagaaaaagaaaaaaaaagaaaaggagagtccaagtataagtacaatttaaaaatagctgaaattcggaattaaaaataagcaatattgaaagaggtttccatataagaacccaatacgagattaatcaaaattcgaaataaaaataaaagaaaaagaaaaaaaagaagagtccaagtagaagtacaatttaaaaatagctaaaattcggaattaaaaataagcaatattgaataattttccatataagaacccaatacgagattaatcaaaatttgaaataaaaataaaataaaatctaaaattagaaaaggaaaggagagtccaaatagaaatacaatttaaaaatagctgaaattcggaattaaaaataaggaatattgaaataagtttccatataagaacctaataaggaattaatcaaaattcaaaacaaaaataaaataaaatccaaaattaaaaaagaaatgagagtccaagtagaaatacaatttaaaaatagttgaaattcggaattaaaaataaggaataataaaagaagagtccatataagaacccaatacgagattaactaaaattcgaaataaaaataaataaatctgaaattagcaaaagaaaataaaagaagagttcatgtaggaataaaatttaaaatttgctgaaattcgaaattaaaaatatgcaatattgaaagaagaatccatataagaacctaatacgatattaattaaaattgagaataaaaataaaataatacctaaaattagaaaaattaaaagaaagttcatgtagaaatacaattttaaaacaactgaaattgaaaataaaaaacaaaaacattcaaagaatacaatatgatattaactaattgttttaaaaaaattctgaaatttaaaaactaaaaataagatatcaattaggaatacaatatataaataactaaaatttgtgataaaataaagattattgaaagaaaagaccatctaaaacacatgacaaaagttcatgtaggaatacaattttaaaacaactgaaattgaaaataaaaaataaaaacattcaaagaatacaatatgatattaactaaaatttttttaaaaaaattctgaaattaaaaaaagaaaaataagatatcaattaggaatacaatttttaaataactaaaatttgtgataaaataaagattattgaaagaaaagaccatctaaaacatatgacgagataaattaagtaacatgcctataaaggagtagagtggtggcggttgatacgagatataaaaattgttaataaaacaccaaatagaatcctaatgacaattaaaaggagggacgttaggcaggccgtgaagcaaattagtaatgcggttgccgggaattctagaaagtaaaaaaaaaactcattgataatcatattcaatttttaaaatctcaatgacaataaaaaggagaagcagcgggggtgtataagagtatagttgcagagccgccgaaggttgacgggacttctagaaaataaaaaaatgaattccaacaatagttatgttcgatttttagaatcataataacaataaagagttggcggcggacgggctatagaggggcatagtggcatcgtttgatgggacttctaaaagttataaaaagtgaaactacaagtccatttttaaaggtttggaacttctaaaaaaataaaaaaaaaacaatgataataatgtttgattttaaaatctcaatgacaataaagaagggaggcagcgggcgagccgtagaggagtacaatggcaaagctgctgacggtttggctggacttctagaaagtaaaaaatgaacccaaacgataattatgttcgatttttaaaatctcaatgacaataaagagaagagacagtggacgggccgtagaggagtataatggcaacgtttgacgggacatttagaaattataaaaatgaaatccaacttgacaataaactctaaaaactataaaatccaatttttaaaggttccaaaaagaatgaatagaaataatggtagatcgagcaagcaaataaagaagaagatgacacaaggggtagcaactggtatgacttttaaaaactatataattagaaacacgatgatgataaggtttagtctttcaaagtcttaagacaatgatatagctatttaataaattttaagtaaaatcatactaagaaaatatataattttgtttgggtgctagccgcgtaattgcgttggccacccaactagttgcttatattttaggacggaggtagtaccctataaacatatacttcattcgtcccataatataagagattttgggtggatgtgaagcatcgtaatacaatgaatctagacaaatgtttgtccagattcattgtactatatttgtcacatctaccacctgattccacctgtcatacacacactatgtcttatagtctacgctgcagctgtctataaatctgtaactcgctactcttatctcttctcatctcttctcatttatattatcgatatgtgtttattatattatcgatggtttataatctagaattgtacctgctctgacatggtccaaaatcgtactatggtaacaaaccatgaaaccaagtccagatatctatgctgattcgatgcacacaagtacagactacattgcatccaacatttcctcgtctttccattgcattttgtggagagatacaagcctagattacatg

SEQ ID NO: 1441 - DNA, 10381 bp, Oryza sativa
agcagctcgctctccgccgcgcacctgttgtacggcatgaagcccctctgcagcagggtgacggacgccgagctctcgcacttggtcagccgtggcgaggccgccgcctccctgctgttcccttggccacgggactccgcgacgtccgaattctgagccgccgccgccgccgccggtaccgccgccgacgatccaagcacgacgctggaggccgtgttcgagcccgtcagcgatccttccctctgcgagactctgaactctacgccctctgaatcacggtggcactgctggttcgcagccgccgccgccgccgggtagaacagcgcgcatggaaggctcccgttgtagctcaaccatggcatgacaggttgcgcggcgaaaccatccgatcgaggaaggaagtagagaaactgttgcatgctgctcggccatggattcgacgagctcccttctggggcagcagcaaaagaaggtactagtatgtttctggttgctctctcaactgaaccactcgttgcaatgttactgccattaagcaggtgcagctggtctgaatccttaaccactacgctctttccgaatagcctgaagactgatgcttctgaggatgcttctttggcatccgtggttgcaattgacatctgaaattcacattcgaaaaacaaaaacagaatttattaagggtgccaataacactaaaagggtatggttatttttccattggcgacaatagatcaaattaataccatgtaaaactgcagatgatcagattgcatatcacaatttgattcagagatactcctacctaaaaggctaaaaaaacctgtgtttctctgaaagtgatgtcagaaattctcgactgaaattattggtcctaaatattgcttttctgatggggaatatcttgtattcttgcaaaattggaagaactaatgccttacaaagttgtccaacatgtgctgcccacgaaagaatataccttagtatttggcgcctgcatagccaactcagcagtcgggatgctcggtgagaggcacccgtcctctctgtccaccgacgacgccggcgagccgccaccgtcgacatgctcatccgtaccggcggctgacggagccagcgacccgctgccgctcgagttattcgagaacccaccgcccagggcctcggtgcctatctgcgccgccgtcagcaccgacgtcggcgagccctcctcctgctcggacagggactgcatccacaacggcggcttctccagctgcctgagcgccgggacgtgcttctgggccgcgccgtccaccttgcgcgggtacgggtgcgccggcttcctcttccggccgcggcggagggatctggatgcccgccgccgcgccgcgcgggacgcgccgcccgagccggtgttactccccgaagattctctgacgacctgcagagcaccgcgcaatcacagcgtcagaaactctgtgaaacaacccgcagtaaaaacatgacatcatctgttcttctctcccatgaaaaaaaattgaaaaattggcgacttactttgggcaatcaagtaacacaaccaatggttttttttttttcgtttgtttgttttttcatggcagagatcagagattttttgttgttgtttacatgagaacgaaaggctgtacgaccttagagaagaacttctgcgcgtggctacggatttgcacggcagtcttggtacctatgtgctctgcatccacacacagacgaacacaaacgttacggcacacaggcgaatacggacaattgcgatcgatcgccatgaaaattcgatctgttcgatgagacataccttgtatacggcgccatgcgcggccgtgcagctgcagggcttccaagaacagcctgtgctcctcgtccgtccacttctcgcgctgcttcgtgatcgtgtacggctttcgcgcctggtcgggggcaagcgtgcaaggaaggaacacaatcttttaagagggaatcgagcagccaacgaactcaagcacacaagaaccgcacgggattttgcagcggagaagccgcgattcggggggaggagtaatttacctttggcacgtgctcttcccctgacaaatccatgtcgccgtagttcatatggctcctgagatgatccacggtgctctcgccgccggcgcgatcgtcggcaccgttttcgtcggttgccatggcgtttccctgaatagcacagaacggccacaaaaagaggggaaaaaacagcacacggtcagttcccagtaacatcatttaatccgaaaaacaaagttcattcaaaaacgatctcgccaagaaaagaaacggaaagatcaaactcaatttaccggcaaacaggccatctccattctgaaaaaaccgaactcctcccaaaccaaaccacactccacaggatcgccacaccaaagccaaaaaatcagcgcctcccaaaccccgcaatctttgcgagttttctcctcgatgttgttgatgaggacgacgagatggggggagatgaggaggagaagggaacgaggaggcaaagaagcgagcgttacgtaggccccgtcgcactaggaggagggaggaggggacgggagaaaaagagcatggcgagacgcgccacgtaggactcgattttttccgccaaactttttccctcgttttttttccctcttctcttttcttttggctgcgttttttccccgtctctttttctcctttttctttatttttttccccctataccttcctcgcgcgaaaagaaaaataaataatccggtgggggaattcgggaagccgctcgttcttgtggctggggatgctcctccggcaacctcgctgtcatgtgttgctaatgcgccattagtaattgcccccgctcactaaacttgacacgcgaagataacttgcagagtagagtagtagtagcgacgaaaaagagtattcgttttcgatgacgagcatcatgtgaacattcctaaatcaccaagggctaaatcttatctccccaagattaaaaagggccaccttatcgtgatgccacgtcaacatgtatggcaacacaagcaggagcagcagtactctcttttatcgagcctcacagaatacgggattgctagctagctactcctaccttatcctgcacggagtacagatacagatcatcgaggaattggagtattttcctagtaaaaatccttttgaaaatccgaggaaatatctcagcctctagatttggagcggcatgcggccgcaacgaccgaccgcgctcgtgtggacgggtccggtcgcaaagatcgccgggtgggggcgaggactttgggactttcgctgcgcttttttgacacgtcaggccacgccgctgctagcgaccgacccgagaggggagccgcaatccaccaccgaactggtggtgtccggggccgacgcgcgtcgcgcctccggaagccgcgcgagcggggagcggatagaacgatagtaaaaaccaaggccgcctttcccgggttgctacaaatgggcgcctcctggccacaaaggtgtggggcgcgcgccagaaaattcacgaaaaatcgctggccatgtgtttttgttgctttcttttctcccggtggatgacgcgtggggccatggcgggactcgtccgaggcgcaacatgtggcagtggttgtcttggtacaggggcacaggggtgggccgtggggtgggggagggggatgacgtggcggggagtaaagaatagcgtcgtgcactcggtgcttcgtgggctctcagtcctcagacggggacataattcggtccacgtcatcagatttgttgggatgcagttaatctggatgcacttttgctgtagtcctactccctccattccaaaatagaataagttcacttcatgaccctcaaaagagacccgaatctaatccatgatcttaaaccgcaaaaccggatatcttcacccacaaactattgaaaccggtgcaatttgactcccttggtggctttggagggtggtttcgctgacgtggcgctgacgtggcggtgttgacctagtctgtgtgctgacgtggcactgtggtggcatttcaattaaaaacatatatgtgggacctatttgtcattcacacacacaagattgtgaggcccactgacatgtgggccctacctgtcatctcttccctttcttcttcctcccggacctcccctcctcctcccttctttctttctgttctccctctccacttcgggcgtttgcggggagcgagcggcggtgggctggagctggcagcggggggcgtgggccggattggtggcggtcgacgagagctgaagcggcggcgggctagagatgacgcgagagaggacggcagcgccgacgccgacgagattgagcgggggcacggtggtctacaggccggctacggcttcggatccatccgcatcgccgggatcagagctcctcgtcgccgtcctccaccacctccccgcatccatcctcgcatcgcgcgggacgtcgacggcggcggtgggcacgggacgtcgacgacggaggcatcgagtggcggctccggcggcgtgcgggcgagcacgagtgcgggaggaggcaccggcggcgacagcacgagctcagcggctccggcggcgtgcgggcgagcacgagtgcgggaggaggcaccggcggcgacagcacgagctcagcgggtccgcttctcccctctcccttcctgcgctcacgcgccgccgccgcctctcgtgtaacccaccacctccgttcctcccttacatcctctcctctcctctctccacttggcgaggctgatagcgaggctaccgccgcagccgccgctgctctggccccgccggccggcgctccagctccagccgctcgtgctccccgtggccagccgaaggggagagaagagaaaaagaaagaaagagagaagggaggaagaagaaagggagagagaggatgacatgtggggcccacatgtcagtgggccccacaatttttattttgtgtgtgaatgactaatgggtcccacgcatattttttatttctaatgccacctaagcgccacgtggaaagaagaccgagtcaatactgccacgtcagcgccacgtcagcgaaaccgccctccaaaaccaccaagggagtcaaattgcaccggtttcaataatttgggggtgaagatatccggttttgcggtttagggtcatggattagattcgggtcacttttgagggtcatgaagtgaacttattccttccaaaatagtgtagttttgcatagttcatgttcaacgtttaaccgttcgccttatttgatttttttatgattagtattattattattagatgataaaacatgaatagtactttatgtctgacttttttttaaaaaaatcataaatttatcaaataagatggacggtaaaacgttggacacgaatatccacggctgtaattattttgggacggagttagtactagattaacttattctaaaacagagaaagtactctctagtatcataggactacaactatctcaaaatgtaagcattttttttgttgacataggcattaaaaatgttactcactccgtcctaaaatgtaacaacttttggctattaatctggacaatatagtttgaattagaggatggttgtaattggttgagaatagaaaatactacctccgtcctaaaatataacaacttttggctataaatgtggatacacagttgtccagattcataactaaaaatacttatattttaggacggagggagtagtgaaggaaaatagttgtgaatagtagaagggaggagataggtattaaacagataactttattttggaataatgtactgtgttaaaaataaactatattttagaacgaagatagtagaacgaagatagtagtactttaagcttattttggacagaataaaatggaaggaaacattgtatggctaaatggtcaaatgattaaaagtatatttcaagccctatcaattggtttaataagctaaagcaaaagctaaaatttaagttgattttaagatatttttaatgtatttttttatgttggcttttaagtcgcagagcaaatatacaattttttaccaataaattaatttttatttcttaataaagttgttttaacttattagaaaatatggccaaccgatgattcttttcatccaccctacaaacgagccgttctaccaataaaaaaagtcgctggagtagtaaatttgatcggagaagtgagaccatttatctattggggcatttgcaaatttgccaccggttttttgaatattgcaaggataccactcgaatgacagttctagtggcatttttgcaattttctagtggcagttttgcaataacgattcaaagtagtggtaaatttgcaattgccccttatctagtctattccgtcaagttatttggcaatgtgttttagaaagaatttattaattaattgcatgcaatgattctgtataacctgatgagtgcgtgtagacttgataaaatggcaactgaatcgaattgacgggagcaatttaatcattttggcatgaagataattttgctgaggaatctaaaaacatcaagatttttgggatagaggaagtaaacgaacaaaatagaattaaaatagcaccttaaagattcatatgcagaacgtttttttttaactttcgcagcattaaattatagctagagcgcgtattcctattatcttccgttttcagtggaaaagaacacatccgggatgcaggtgcatgacaggtgacagccgaagagcaacgcacaagggaaagctacgaaatggtgacctcccatcaaacatgggccgtaacccgtcacccgtgtatcttccatctgcgagtttgcatcgctctgaaaagcaagacgtgcctaggcagtcatgccgaatacgcagtgatcaaaacatgacgagaaatcagaaatatcccactcaccggaaggaggcggctcaatgaatgcgtcgagaatatctcacccatttgcgcctgcacgtctgaagaagaaacaaaagcacctcgtgatgctgcctggagtatatataaacggcacttctccaagatatcgaatggtacaggcagatatcttctagtatctgcacccgttgcttttatcacaacagcacatgcatgcacataaaaaaaacgggtagtcaagcacgtactacttgcgtgtcccgcggtttgggctgttggcaattgccatgtgcttccgcagttccacgatatagcaatatcgaatagaacgtatcctaatagcatgaatctggatatactccctctaaatttatatgattagaataagtctcatctgattttaaattgctatattctaaaacggaggaaattatgaatactagcctaccaaatactaggaataccagtagtaactcaatagtatttcctctgtcctaaaatataagcatttttagcacagtgataagtcaaacatttttaagtttgactattaatagcaaaaaaaaaaagagtaaagaacatcaatcatataaaattgatgttactagatttatcaataaacaaactatcataatatacaactatttttatttaaaatatcttacttttataaatattgttggtcaatatagcatctcgaagaccgtgccatgatctaaaaatacttatattttagaatagatggagtaagattgttggagtactaggctagagtggtacgaacaagttgccggcccttttctgttgctgtggcctaacaaacattcaaacaccaaccgtgagtcgatagtgacaaatttggcatatgaaagctcaaaaccacgttctcctttccttcatggattagaccaaacgtacggcgtcttagtttcacatatatagtgtgtgtttagttcacacgaaaattaaaagtttgattgaaatttaaacgatgtgacagaaaagttggaagtttgtgtgtgtagaaaattagttttaatgtgatagaaaagttgaaagtttaaagaaaaagttaggaattaaaccaggctataactgcagagaagcttcaaaattgctcatatatttgagatttttgttctgcctaagttgttagaactgatatttgacttaaacaaattaaaaacaatgtctcaagtggccttgttcacttgaaacaagattcataaataccagcaaatataactcaactagttagatttcttatatctattccaatttaaattccagatttaatatgggtgatcatttttctgagtaattatatttttttgatagatgatgtccccgtcaacagcaagacacttattataactttgtcaatctcaatatatatcggtccagtctctcggagatataggatgtgcacaacgtgtacatgtgtatgtgagcacatgcatttgtacttatctttttttaaaagaaaattatctatcgacatgtaaattaacgtgttaagtgagtgaactgtgatcttttaaataaagggaataaattcggccctccctttagacagtgagaattatgtcgcaataatatttaagattggaaggagagtgcttttcagatacaatatggtagtaataactttagaataactagatgatttgcccgtgtgttgccatggaatattaaaaaatatatttgattcattttaaaacctaaaaatgtccacctataagccattttttccatcaatttttggatgcttactgagttaggctgagctaaaggtacacatttatgttgcttcgggatgaaacactaacactgccagcattgtgggcccacacgtaagtgaaaggggtgatggcgacatattcactactatatccaaggttgttagtatcccgatccgtatcgtaattaccaagtcgaaacaatatagtatcctaattttcatttattacgacacgatattacgaaattatagatagtatcctgattctacgattcttacgattctacaaaatattatttaaaataagatggtttgaaaaataacgtaaatatatatgcttaagtttatataaaaatcagttaaatatatcaaaactaatgtgatttctcttgataaagtctctatttgcatgatatatattattactatgtattttttattgaatggctatttgtaattaatacaaatcttaattaaacttttttaaaaaataaaatctcatagtatcttactccgatacgatgctatttcatactagcagtactgtatcagtatcaagctgtgcatgcgtcgttttcctcctgaccaatcacatccaccacggatatcaggatatgagtatatgacatgaagacgatccacgcttgcagcgccacgtactggtgtgctgctttcagtccgctctaaacggatcagacattttgcacccttctcttgctgatcagccatgggatcgcgaaggtgaagcagcgtggcagagtgcctcttcccgaacgcaagagtcgccctgcctctctctctctctctctcctcagctctgctcgactccggtttgacatttcggcgcagcaggcagcagctggagtacacttctccgacttcggcgatcgactgccgtgctggtacggcggggcccctcgtaccagcacagccagcgcgggtacggcctaccaccggaggcgcgcttgggtgacaggtcgcggacggcgtcggcgcgggggcagctgccgtcccgggtatggctaggagcggtacacgtattgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttgcatatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagc

SEQ ID NO: 1442 - DNA, 9936 bp, Oryza sativa
atggcacgttggtcccggtcagatatataccaggcttcatcctaaccattacaagcaagactttgtatgaagaggggcgaacatgcagattgataaactgacgcgtggtggacaagaatgaccgatttgtgaccggtccgacactggtcatgtcgtcagcagacagccatgttcccacgtcgcgcctgcttccgacggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggattgatttttcggatccagaaggaccagagagggagagagtaagagctctctggttctccagctcttttgtagcttcttcatacacagatccaccagaacacaggagtagggcattacgcttctcagcggcccgaacctatatacatcgcccgtgtcttgtgtgtttcaattctcgcgaaccttccacacacagacaaggagcttagaatctcacccagggcccccggccgaactggcaaaggggggcctgcgcggtctcccggtgaggagccccacgctccgtcatctggcgcgccaggtagggggttctacgtgtgttcttctaagctctcgcactctttcgtgtgcgccaagcttttcctgttcagcccaatggctgaacaagcaaaggcgcacaacctctctccgagtgttagcggtgacgaaggggagccgaacccacgccgtcgagctcgtactccaccgccccctccacgccaaagtcctaggcgggaggaggcgctcgagagagtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaaaacctctggcgctgctaccaccggctccgtgtcgtcaaggcgaagggcgcggcgagcggcggcggttgctcgccattcggccgccactccttcgtcaacgcctccgacccaggaagatctgcgtggggtgccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccattggcccccaaggttccggcccaccatcgccgaaaaatatgacgggagcgtcaaccccgtcgagtttctccaggtctacacgaccgggatcgaggccgccgggggtgacgacaggatcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcaggggggggtgtgcggcacaaccgcatgctcgaaaagatcgcctccaaagagccccagactaccgcggagctttttcagcacgcggaccgagtggctcgtaaggaagaggcatggacctggaacccctccggttccagtgtggcagcttcggccgcccccggatccgctgctcggacagggcggcgtgacaggaggaggaagaagaggtcagcccattccgacgacgagggtcatgtcctcgccgtcgagggcgtttcgcgggccacccgaaaggggaggcctgcgagcgacaaaaagaaggaggccggcgctcccagtagggagcgcccaaccggcaagtggtgcatcgtccacaacacctcccttcacgacctcgcggattgccgcgcagtcaaaactttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccggacgcggtggtcggaggttgccctcacctttgaccagaccgaccacccaccgtgcgttgcccggggaggacagatcgaaatggtggtttcccccactgtttgcaacgtgaagctggggcgtgtcctcattgatgggggagcagccctcaacatcctttcccccgcagcctttgacgctatcaaggccccggggatggggctccggccgtcccagccgattatcggtgtgacgccgggtcacacttggccgctaggtcctatcgacctcccggtcaccttcggtggatccgccaactttcgcacggagcgggtgaactttgatgtggcggacctcagtctgccctacaatgcggtcctagggaggcccgcgttggtgaagttcatggcggcagtccactacgcctatctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggttaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaatgccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaataatgcaggtcctacttttcaacgtactactcggatttctttgggtagccaaataggacgtaatgttgaagcttatgtcgatgacttggttgtaaagacgcgcaaccaagagaccttactctcggatctagcggaaacttttgagagtctccgctccacccgcataaaactgaaccccgataagtgcgtgttcggtgtacctgcgggcaagcttctcgggtttttggtctctacccgaggcatcgaggccaaccccaagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccatttacttggacggaggaagctgaacgtgccctcactcagttgaaggcgtatctcagctctcccccagttctggtcgcctcggagccaaatgaacccttgctactctacttagcggcgaccccgcaagtggttagtgcggcgttggttgtggagcgcgatgaggacgatcctcattccgcgcacccccaccctgtgctggcttggcccgggagagagcagggaggagaggcccccgagccgaacagtggcccaaggcccccgacgaccggagcaggccctctgcccgcttgtcagacggtgccaggtgcccccgacccccaggatggccagagggccactgcgggaaggccgcacctatcgccctctgaccccgaggataaccctgtgccgactcgacccgggagagagcagggagaagaggcccccgagccaaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagaatggaccccagctctcgagcccgtctcagtccccgaggccagctcgggcccctcgcagctgcctcacaccgcccactgggtgatgcagttcgacggctccctatctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggattgagcttcggcacgtgcccagacgggataacacggttgccgacgaactctcacggctcgcttcctcgcgagcccagaccccaccgggcgcttttgaagaaaggcttgcccagccgtcggcgcgacccgaccccttagaggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccaacagctctcaatgatgcggtcgacctggtccggcgatgcagagcgtgtcaattccacgccaagcaaatccatcagccggcccaggccctgcagatcataccactttcgtggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggtggcgcgcggccctccgagccgcgcgctaccagcagagcctacggcgctatcatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggcttgggccaaccccgcacccccctcgggcgtgcagggttggccgggggctaccacatatgtctattcttatttctcttatatctgtatttcaataaaagcattttcgatttcctaaaggctgtatctgtgctattgtttccttttgaaggatattgacttgaaataggtcactcgtgttcaatcctgccctcgggggctcgggtcggctaaaatcgccaaacggggcccagaaccgagccgtgccccagggcgtggtgaactccgggggggaatcggcaaaaacccacaatcgggtaacccataaccctcggtcaccacgctcccggcctggccagtctcgacatgtggatctccccaggcactagccccaacccgagccatttgaggactaggacctgggcacgagcccttgttcaagccaagacacaaaaggaccgcggcacaggcatcctcgtctcatacacacaacaaatagaattgacacaaaaaatttcctctttatttgattgcagattaaattagtctatacaagaagggggcccgaaggactcggaagaagaaaagaagaaactatttaaagattggcgggggcctgggggctcactccgatgcacccgggtcaccagcctcgtcgccactgtcgcccacaccgccgtcatcgccctcctcgtcggagttgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggcctggtaactcgccagtacgagctccaccgctcctcgggcgaggtccctcgaggatgacttaatcgtcccctcgagttcctcggggagccgctggagagtcccggccatctccgagaggcgctgggcgaggcccccctggttggcggcgtacttcacagtccgcccgccccagagacccgcctgccgcccggcgcggtctaaacgggacacggcgtcgcgaagcatgctgggccctatctcgcctgccaggcgaagggcctcgacctccccggtggacgaatccagcgcgccctgcagatccgcgatggtgtgttcggcagctgcgaggcgggcggctaagtcgctgtcgcccgtggccgccccgccgctacgcgcccttgcatccagctcccttgcctgcgcctcgagttcagaggcccgctggttcagtgcggccctctcggcgcgggcactttccagattgcgacgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcagcgtcaaggaccccccgggctgcgtcgagttttttccctagctccgcctcccagctcccgtattgaaggcggagggtgtcctgcgcctcgttcatcacggtggtggcgatgaggcagccccccgctcctcctccacctccttggcgatctcccccagcaccttccgacggacttcgagctctgagacgtgctggcggtgtgccttgcggcccacctccaccatggcctccaccgagcgtcgcccctcatcgacacgcacccatgcggcgtcgagctccgcccgctctgcttgcagggcctccacctgggcacttaacccgtccaacactgtggtgtttgcgacggctaaggcctgcagaaggggttctgcgctcagtggagcaacggaaggcgtggggaagagccgcctcgaagaggatgccgcgcggcttggcccgccgatggacgtgccggactcagggatgtcccccggacctggtttgatctgagcgtcgcacgagggagtgggcccaagcgatgcgcccgcggcctcgtcacgagttgcctcggaagtcgtcgtcgcctcggcctggcgaagtctggcctcctcccgagcggcttcttcagcttggcgagctcggacggccacctaggcagcttcctcggcttctcgaaggcgatccgcggcctcttgcccgtcagtttcacgggtcgcctcggaggatgtcgtcgcctcggcctggcggagtccggcctcctcccgagcggcttcctcggtctggcgagcccgggcggcctcccgagcggcctcctcggtttctcgaaggcgatccgcggcttctcgccggtcagattcccgcctccgggcctctatggtcgccgggtcctcggcctcaggctggccggacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgagctttccccgggatggttctgtcccccccaccttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagattgttccccctgcggctcccgcccacgccatcgtggcctcgaggagcccgctcctccgacaccccgaccgcctgcatgatggtcaggatgga

SEQ ID NO: 1443 - DNA, 10297 bp, Oryza sativa
  unsure (1)..(10297): unsure at all n locations
tgcatgatggtcaggatggaggcgcggtctggatcgctgcagagggggaggactccttgaggaatgagggatgcctccacggagctgagattcggcacccgttggaccactatcttgaagtcctcaggagcctagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgaggacggcgtcgtagccatctcccagatctaccggcgcccgccagttggaggcctgcgctggaggctagctcggaagtcggaggcgcgcttcgtcggcgaggggggtgtagaaccagtcgctcttccagtcatcccacttcttgcggaggacgcagggaatgtagcggttcagcaccggcccccgtggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcgaaaggaaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgatgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggccgtggcagtcgagatggaacatctcgtgcgcgcgttaattacgctcgccgaccgaagcgccatcaccatatctccaggaaaaacgaaccggcttgtcccgatttttggaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggggggggggtcgggcccgagggtgatacggccgcccttctctttgtctccccgaggggtcggaccgcatccgtctcggccccgagggtcgaggcgccccgaccccttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaatcactcgtccctagccggagccggcgtgttagctcctggagatggcacgttggtcccggtcagatatataccaggcttcatcctaaccattacaagcaagactttgtatgaagaggggcgaacatgcagattgataaactgacgcgtggtggacaagaatgaccgatttgtgaccggtctgacactggtcatgtcgtcagcagacagccatgttcccacgtcgcgcctgcttccgacggaagtggaggtaggtatgggcgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggattgatttttcggatccagaggaccagagagggagagagtaagagctctctggttctccagctcttttgtagcttcttcatacacagatccaccagaacacaggagtagggcattacgcttctcagcggcccgaacctgtatacatcgcccgtgtcttgtgtgtttccattctcgcgaaccttccacacacagactaggagcttagaatctcacccagggcccccggcgaactggcaaaggggggcctgcgcagtctcggggtgaggagccccacgctccgtcaagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccctaccatggcgatagtacacacatttatctgccttattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcactctgtcacctcccaagtcccgttagcgataatggaatccatttcactacggacagcttccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaacttgttcgagaaaaactctccacacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggtttacagatttattgcagaaatcagaaagggaaaagcggaacatgcctccgcactcataacctttaccaataaaatatccatgtttagacacgactactttattagactcaaaaaccatcttaaattcgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaatagtaggtaaattaccatacccgctttcatctccagtgttgccaatggtcacattagcagacttagaagtctgccctgcaggtgccttcatccccttgcgctgtggacacttcctagccagatgaccaacttggccacacacaaagcaagtcctctcatnctgattaggaatggtggntgtcttcttctgcttcttgaagtggtggtctgctaagctttgatttccccttgctcttgttctgggccttgtgcacaacattggcgctggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccaaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggtgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacagcgcagtacagagtaggaggcaaaccctagattgattttgcgtatatactgcgtgaagacggcgggtcggtttatatagagaagggtcgcttgatcagggcgctcgcacgatctctactgcgcgtaaccgaaccggataagtcgcgcataacttatccggactccacgccgtttgcacgcaccagatttttcggaacacatctgcgcaagggtgaggagccaatttttcggaccattcgacgcgtacgtcgtgcacgcgcgccgcctgccctgccaggcgaggcgagcgagcgcacgcgtgtgtttcccctcttctctccaccacacatgcttcaagcgactaggagggcatcatcccttttaaggaggtccccctctcctagaataagcaaggtggtactaaactccacatgcatgccatcccatgaggtgggcttttgtgattttccaaagaattaatcttcgagtgggctaaggcccattcattaattccaacacgtatggtgtgcgtgcgtatcttggctggctaagcttacacgtactagaccgggttaggagccgtgttgctggagaagtgcccaatcgttgagcggcatcaccatcggtagcggcaggacaggacgaacgattcaagcggtggttccggctgctcttcactggttggcagctgttatcttttgggttcttctgtttcaggggcgaaggcgacacattcgtaaactgatctcaacgtacgtttcatgggtttggtacttttgattatcttctcttccgaggctcccccgagcatgcatgggacctaatgtctccctgtacctgagctgctctgtttttccccgaaaggaacggggccgaggaacctgtctctagcagcgtaaacacatgacgaagaaaaaaaaggcgaaactatgaccagtactaatctaaaataaggatagtagggccagtacgaaccgtatgttaattgttggccgaatacaaaaggaaggtgattttccaggcccggaacaaacttgtctcgctccaaacgaataagttcattgggggtccctcatcttaacgtcgcgttcaaatttcgtcctccaaccacaatactagatataacacgtccctcaacttgcaaaactagtgtactatccggttttggctgacattacgagtgaaccccatatgtcatgtctagttcttcttcctccaaccttccctcgtccatctcctattccacgtgaggttcttcttcgtcatgccattcagggaggtcaccatgatggcgttgatgctcaacatccgcggtatcatggaggtggctgccatcaacaacttgggggatacgatgaaggcgacgacggagcactactcttggagggggcacggcacgaacgaccataaggcgttggcgtacataacttggatggtatagtgtggtagtgtgatggtgacggcggttcgactgaagctgcggaattgggtgaattgggtgggaacgagagaggagaggggagatggtaatatgcgctgtttgagatattgggtacaccggttttgcaagttgagagactcgttatatccagtattacgatttcaaggacgacatttcaaactccgagacaagataagggatttaaaatgaacttattccagctccaaatgtacagagcggccgggcgttagcccagatcaccacgagtccagcagtccaaatgacattggtactagttcgctaccagcaccgcttgcacagttggacaccggcatcacaagcctaaaaaaatactccagatacaggtaatagtcaagcatcacaaaattccaatttctaagtagtgctttgctgcccacttgagtcttgaccgacctacatagatgacaaaatttccggaaaaaagatacacacgacgataatagataagaaaaacatattctgtggcaagcaaccaaagagcttactaacatacaatcagagaccgtaaatgtttataactttactcactgaagatttaaaagacgacgcaggttgcacagggatcatcgaaataaaatggcgagtcactactcactaatgacttgtagccaggtgattctgccaaagcaaccagttccaaccattcaaaagtgcacacagaattttcaccgatttttttaattctgagcaaaataagaaatatatttttttatgtaagcaccacagccatctaattctattaataagcaggacgttctgattcaagaagcgtccatctgtttgatagggacgctgtcatttggcagcgactaatttggacgcaaggtttttactgcgttcctggacagaacttggacgccaaaacttaacagcggcctccgccgagcaactgcacgcccgcaacatagaaaagaaatacagatctacgcattggttagtgtctttctttctatccctaaccttcccttactgcagaagtcatgccctagtcttatatcagatgagattagagtttaagcagagatcacgagtaagattatttgcaaggtatgtttacttttcgttgtttggaattgattagacattagtactagtcaagtagcatatctctccgagttatggccagatgttcttgtaatctcatctcacattttgtgaatgaggctgtagctgagtaatatatcagttttttcccgtaaaaaaaactagcagatctggtgtatcattttattcttctatcatggaaaggttgcggcactgctaatcgaaagtatgagtaaattactgcatgaaatgattatatcatcattagctatgtgctccacgttagtagtgctctgtgccatgtatatactaaatattctgatcatgaataaatcgaatatggaaatggatatatatttttcttttctttattactattaggtcatcagaccatgataattgttcttgtatacactggaggtgaaattgtatatgagcggactggtgcagagtatagcattccacccaagattacttttcctgcttccgaagctaccaactttcgaagatgtaaagaatgagatttatgaaggctaaaatattctgaaactgaatattcacttgttatacgggccgatataatgtagaaccaccaagtccacattttttccagttgatcccattatataagaccagatcatggcaaatgattttttacatgcataagcactaaacagtgggcgtatggtggaattatatgttgagttcactccaacaaatagtgattcagccaaaaccacattgttagtaaaataataagagaaaacctagaaccaactatggctacagttgctgagaatattgtgtcagcatcacatcagtcgcttaagcatgg

SEQ ID NO: 1444 - DNA, 2438 bp, Oryza sativa
atcatatgcattgctcgctccattattggaggctattaaagcaactaatcctggaacaagatatcaaattttgtcacaaccgatgactcgtgaagggcatcgagcattcaagtgcgtggcttgggcttttggaccttgtattgaagcagtaccttatcttcgacctgtcattaatatagatgcttcttttttgtctggaaggtaccgaggtaggttgttgatagcatgtggatatgatgctgaaaacaaattattacctcttgcatttgcaatagtggagaaggaagacagtgacaattggggatggttcatgagatggttgcggaaagaggttattggttttggtaaatttgtgtgtgttatttctgatcgccacaaagctatcaaatgggtgttcaagcagccacatattggatggaatgaaagtgctggtgagtgtgtgcatcgattttgttcacaacatattgctgagaatctttacaagcaatgtaaagatgatgatgtggtaaaaacttttaattgggttgtcaagaagaagaaaccacgtagattcaatgaaggtatggaagctatttcaaaaacttgtccagatgcaattgcttatcttggtaaggtgggaaaatatcggcaagaagataagaatgagccggaaaaatctaaaaaggttttccagtgcatggatggtggacatcgatgggggataatgacaagtaatggctccgagtctctaaataatgtgttcaagtactcaaggagattaccagtcatggcaatagtggaggaaacatttaacaagtgcttagaatggtttattgatagaagaagatcttctcttgatcttgcaaactcagggaaaatgtggtctcgacgggttgagaagttattagtgaaacgaggggccaaggccggatccatgcatgttatatcatatggtgatgaaagaggagaatatgaggtgaaggttgaccgtgaacgagttgcattgcatcaaggagatcgtgttgtgtatgttcgaagggatttcaagtataagctagttatgcgcaacaatgctattccgacatgtgagtgccaaaagcccaaccttactagtattccttgtgctcatgtgcttgctgtttgaaaagatagaaaccttaatgagaatcagtttatccatccttactactcttctacaacactcgcaaacacttgggctggtcagtttcacccatatggaaatcaatcggagtggccaacttataatggtccaattattgagcctgatgctaggttgatacagttgggtcgacgaagacataaccgaattccaatgtatatggatgaaatgcaaggtcgacgcttaggacatcaagcacgtcgttcaacccaagataaaaatcaagccggtctgtcataatttaattattgtatgatatatctatgcttcctactaatatagaattaacactgtaggtgtgccatctcaccaacatcaagggtgatacaatccataggatggactccgctgcatcgccctagaaatttatctagcaaatctacttctagcttatattataaaatttggatttagttttctgtgagtaaggacttcattctcatgtaacaagcttgatatttttaaagttccctattgacaattagttgttatttttgtatcttgacaaggacaacactgcttgtcttatttcgctcaatgtgatttgaatggaaatggcaggaggttttttttttttgatacgttgaacaggaaatacaagatacaggttaaaccatatgtatgtaaaaaaatagattctaatttatagaacttacagataaacaaagaaaatcacaagctttgataaaccaaataataacattgtctaacagcaggagtaacaaaaagctctttgccctgatctatgctcaatgtttatcctgagattccagcacatcagaatctgtacctaaactaaggtatcttgtaaatcccctgtttgagtacaaccagtcatccatcacatccatgtttatctcctcaggtttaattggtttaggggtagaaaatggtgatgcactatcatcagatcgaatgtcatctacacataaaggtagacctgactcgcttagcatgctgcttaacttagcctccatattgatatcctggacgttattgtaacatgtacagataagaatcttgcccatctttctccatcctctactcatagcacatttaattctccacgcaacttgtttgatagaacgtagagcctaaattagcattttaagaaaaaagaagtgttattaagtgaattattgcaagtaaaaaagaacaagtaaagaaatgttagtataccaatcgggagagaggtggaccactgggcatgtaaccggtccaatcgaagttatccagtggataagggatgggatcccacaaaccttgagcggaccgagca

SEQ ID NO: 1445 - DNA, 174 bp, Oryza sativa
cgtccatccttcttgatcccacgaaggcaaacggctcgccggagaagacagcgatcccgctccgcgggtacgacgccgtgaacaagatcaaggcggccgtcgaggccgtctgccccggcaaggtctcctgcgccgacatcctcgccttcgccgcccgcgactcggtggccaagt

SEQ ID NO: 1446 - DNA, 750 bp, Oryza sativa
ttatgctacaaggaaaattcgtcttaagatggagattggtaaatatgtgatccaaatttcagcatgcaatatgttcagattgtcaaaacttggtggtacatttggctacaaaggaacgcaaagatcttcagaggagaagaaccggacatgcaaaggacttcacaccagatcatccaagatattcaagaaagcttattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagaaggctatgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactgtattttatctgtatcttcatattccgttaggaatatagattatcttttgtaatccggactccttcccatatataaggggggtccgggcgcctctaggggcatatgctgattttttcccgaatcatacaatcaataatacactccgcggattcatccccggacaggagtagggtattacttcttttataaga

SEQ ID NO: 1447 - DNA, 16669 bp, Oryza sativa
  unsure (1)..(16669): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtatagttctattagtgtatgaaatatcttatgggcataactaagtatattaattaattagttggtgtgtgatttggatcgatctcttgtacatatatgcatgtgcatttgggtagtctttgattcaaaggatatagtaattaatgtaaacgtagattacaattgatttgggggtgcaacgggatgcatggttaattaattagtcagttaattactgtaattaatccaatttgggagagaggttggtcgacacagttgctgcagtgtcttgaccattagctttggatgtgaatgggctgtacatgtgactgttaatctgttaaatatacggtccaattggaacaaactgtgtcggcctgtacataatcaattaatggaataattaagttggtgatgcatattttagtttttgttacacccacaaaaaaaggctcaattaaacaatcaacacgttggttggatgaaaacattgataatatatatatgtcaatttggacaaatatatacgtcgccccatagcgacttttcatggatgtcggctctcaaaacactcgcagctaattcgtcaacccaaacaactcatttttcatccatgaacagttttaaacacctccttggagatctataaaacaaatatatattttcgaacatccaaatgataagacaataaagatgttgcttggcaacggtatgataagtgatcacaaacaaatttatatgtaggttaattatgcgccgtgcaataatattaacaatttaattactaccttactttgataatatttacttattgtttccattgaaaatgtgatccgattgagcgtgtgactgcaacagctagacggtactagctgactagtcgacccttgtatattttgcggcccttaattagcaaaacaaattaagaaattaatttatgatagtggcctctgtacccaacaatactgtcgatcgatggaaccctatgtactaaatcaatgctacaattatatcgtcttaggaagaaggtgtatatcatatctaatcaaaactagtgctgtagatcgactactatagaatgagaaatagctccaaccattttcaacctatatgtatacttctcaagcttgtaattttggagtcgcattgatattttttaaagatatattgacgttggataaatgtgaatcatatgtgtctagattaaaatgattttatagtattataattaatttattccggttatgtacctctattgcaacagaaattaagtcgtttgtatatattgattttcaaatttcaaagcatcatgttttcaagaccagagagatatcatatatatacatcaactgatcgtgtaatccctaacaaaagctagaaattaattgagcttcctccttagttgatgtgcttattattattatttttgaaacacgttgcgctcttataaacgtgtgcacgctcaatctatgaatacacacatgcataccctatatatccttatgaacacatccaaaaactaggttggcatcttaagattcacaaagttacaatgggcatctcgtcgttgatagatacgttgtctagctaccactgaaagaataattagtcgtaaatgcgcgcgcacctataccaagtctaggattaggacttgaatccggctagataggttccaccaccaggaaccgaatcaattgagagctgattacttcgtgatgtgctaattaattttgttccatcataatatatatttcttaaaacaaaacatgatggagaaaatttcaacatgaatttcatgtacatgcttttttttaatgtttggagaatataatagtcaaagagatattaggatacagtaagttcttgtttaactgatcgatctaaatccggtacaatgtataaataaatacccacaaggcttaatattgtatcttacataagtggtgaagaagccaacgacactttcaaacccaaatgactaatactccctccatttatttttgataggcatatttccaaatctgaaaaaattatttttgataggtatatttcatccaacaacttatcatcttaataactttctcgaatttaatacatgactctctattcttccacacaagattagctacataggcattgaaaaatgtaaatattaataaatcgcttgtttacgaggaatgactagtagcatgtttaaatagatgataagtataattatttatctttggtctgtgtgccaatataaaatgaatagcatttatcgatggtcaatcagtttaatttcacggaaatcgatgccaatcggtagcggcggagcccagcccgtcggccacctggcttgcataggagctggcttcaccactgtccagtactccacggtattatctcctttccaatcttacacatatataccctttttgttgtagaacttgtgtgagtacgaatttaattgattgatttaaccatatcaaggtagatctaccaaattgtgtactactgctgaaaaggcccagtgacaatggattaaaggctttaaagctgtccaagatgcaatttttgtgggtagccctaagcttaagtgaaggcaggaaaagtgacagcacaaaagataaaaactaaagcaaaagatgatcaaggagagggtcgacatgcacgtgaatgtgtgtgttcggttgtttctgaatggctgcgtagatcgagcagaactaagcactattgtgtcctatactactatgtgtacgtaattaattaaaaattaaatcagctggctagctctcttgttcttggagatgtgtctctaagataagagcaggtacaataacaggctataagccagctataaccacatatcgatatcgagaagaaaaaataagagagagaagaaaacgggctacaaatttatagccggctgcaacacagactccaatacgttatgagtgtatgagaggtaggaccggatattaatgatgtagaatatttttataggtaactattgtatgaatgggctatagatgatttggagccagcggttggctatactattgaacttgcttaatcagctgggatcgatgatctcgtacacgaggctcgatcgtacttactatatatatatatattaattgcttgttacagtaattaacaagctagctagctnaaccgttttagggaaagngtttaatccattgggcgaaaccaatccaattaagcaatggatatgatgcaattggtcgaattgttgatcagctaacataactactgggttcatttatctttatgggcgaatcaaattaattagttggtgtacatgttcaattatgcgtctgactagatattattatggtaaccttgtttacgggtgtacttcctctctaaaaatttccaagatataattctttatgttttatacttttactagaaaaatgcccgtgcgttgcaacgggtgaagtctattttaatcttattattgttatatggtttagttaagatgaaattcactgtaagaattcgtttggatatatatatttttagaaaatcatgagctgcaattaggagtctgatcatctcaagttagcatgtgagttttttaaaaacaaatttcttatatgattccttctgtattaccaaaagtgaacaatcttgaaaactgactcaaatacgaatatgtatttctaaaagcaaacgaacttaaaactgactcatacacgaatgacgtaccaaaataccggcaaaaacatcttcaatttttataatagtatagatgtaagtctttaaaaattaataatgtgaaagctttgggtaggatgaaccttctcttttcagataatagaaatagtttatatctcttgcctctatcaacaggacacatgaccaacgagtctaagaaaagagataaacaaaaagactcgaggttatgagacaaatccacacatctcctgtccaataatatttaactaaaataccgaatagaaaacacatatagtctgtaatgttattttacagtaactacgccattcaaagtgaaataaaagacttttggctattgattttaagactttacctctattgtgtacattatcctgctcctatcgtgaaagcatcaagaattaagaatgcagttagctaaaagacatgaaaataacctacattagttagacaattttttgttattgaaaactactatatcatcgcgacaatgccaaattcaacagtataaagcattagttccaaacaaaatcagttttttaacggatctaggtactcccataagccaattaccaaaaagtatttttagcatttcggggaggagaaatgttgaaagaacaaaaagaaacatcgccaatcttaccgtgcgacatggcaatgaaagaaaaaaaaattgttgtatggtttgattttcatggcaaacttggctacatcattttaatacaataaaactatattgtaaacctggttataattaacgtaagactaactcggatgataaaatggttcctatattctggtaaatgcatgggtcatcttctcccttaatcagtgcaagataattgggaaaaatgatggtttgtgtcagtaaatttgtgctaagcttcgaggtgaacgatcgatgagtaccaaaatttacacagcgaatcttttgaccaaactttagctcaaaattggtgaaatgcatgaatacacgaaaggacaagtgggtgatattgaagacggtgtcacgtccaaattaaaatgctgaatgcggacgaatatatatagagcctaaatatatcctaatcccttcacagaaattaagaaagtaagtgaaattaaatggtgcaacatttgtgactgtttgagaaagaaaatagatagagaaattaaatagaaaatagttgtaattgcttaagatgaggggtagatggagaatagctatatattaaaataaaattgaactaaaaatatatatattttgagacgaaagaaatagcatatatcataactaatttaaaagtttcataacgtactctctgaatgaacctccaccaaagaaaatttatgtccaatacttttgttgttaaacgtcatatcatagtatgtatttgctgggccagctaactgtggaatggcatatatggtgccataaatgtggaacagtgtagaattaagccctaagctagccactgctgaaaaaaattgattttgccttcaatctggttaactttcttttactataagtaacttggttgatagtgttttaggtcatttccaacccaatgattaggatggtgtcgccatctaaaatgaaagatgatgtggcaagtgagtaaatgaggaaagagaaggaaaccaggtcttgcatgagacatggtttctacataacattctaggcatcatgtgagataaatagcattaaatttaagtatgaaaaagtggtgtttgtattgaaagagtagtgtctagtactagtttcttaatgatgtggagtttatgaaaactatgtctagtgtcttgggttgggactggccttagaccaccgctgtcttctatcagtcactaattttggatcacattagtctcttctacctgtcactaattttgtactgctaaataagttcaatcacaaaatttttttggctaaatagtgtaaatgtttcagctaagtactgtacattagttgtgatatttttcatgtagacttttcaaaagaacaagccataagcacctaattaatcaagtgcatgcagttcgacctgacaaaactataaaatcacactataattatcatggagacacactctaatcaaatcatgttccctcaaatgttcatttgccatctgcatttggggatagccttaaactgcattgtctgtacaaagattcaattccacaaatatctttaattaaccacggatgttagaactagcattgtttggaaatctagtaggctgctataaacggttgtataccaggtaatatagtactcctacttcagtacatggcagaggaaaaaaaagtttgattagacagtcattggcatcctttgattcttttctgtgcatagacaaaaaaaaacatcactcaaactgaaaaaaactgttgcttctacaagagcaatttaaccaagaaaccagtagcagttgtggaagtcagttagtacactatacactggctaccacagcataaaggttgaagagatctagggacagttacacagctgcctttgcctgtcctcattgttttttttttcctaggttcatgttttctttgcttgctttgctgagttctgttcccaatggttgctgctccagttcacagcttgactatatctggcaagtggcaaagtaggttaggatgataaagttcagtcagagtagtgcttactagaataaataatgttggtgaggttgtgcagtatgtgatcactgtggttagaggaaatcttgggtatgtgtgtcttgggttggttacttggttggcatggctggattgttggctgacaagtgtaattttagtttctgaaaaggaaaactggagcatcaaaatatatatttttggaacttcggtagtagtttggtagaaattagagaatctatttgttacacaaatagaatgaaaagaaaacatatttttgtttaatgttggacgcctaagctaatcatggtatatgttcatgactaatcaactcacggtcatatgaaattgtgtcgacatcggtaaactagtcaaaacaacgtattatccatccatacacagttataaaacagggacattgtgatggctttcatcctctgagcaacaaattatggctagcccaagcgccacaatgtgaaaaacaaaccaaaaaacacacaaacgatacaaaaacttacgcaggtttatttagttgcaaattaagaagaatgggcctacctgaaagggtccatatgatcaatgctctggtgatgttttataggggcagccgttgtgcaatggtacatcatgaacagtgtttcgtgttgaatgctgcgcagagtggctggccacggaagatccaaggacggatggcgattgaattaattttaataatcaatgatactagtagtaacatctacttactgaagttttggaaaaattaccacaagggctttctttgtgtcacgaaagcttcctctcattggccagctccagctgctgcctctcctctcttcctgccttggattcagcagcagcttacctgcatatatacacatagaggtagagagatagatggtcagatagattgagctaagcacacacacacactgcatcagtaccttggtttggttgatttctctgagtttgtgttcttggcatcatcatcattattagccatgagaagtgtaggtggcttggtgttctgaattagtttcagtgttctctttgcacttccatgtgttgcacttgcatcagctatagttccaagaaattgtgtttttgatgatataggcttctctgtctccatttctgcatatgtagtttgctttcttgggctgtggtttcaaacttccaagcttttcttccctctcatggaagaattttccgttcttgcaggcagctctgagcttccaagatcacggccatgggcttcaggcgatcaccggccgtggcggcaatggcggcgccgccgctcacgcattgccatggtgggctggagccggagccggagctggatcccaaacactgcttggaacaggaggaggagaagaatcattctgccaattaagcaacacaatcatggaggacacccgaatcctgcaaaaccaccaccaccagatcctcgccgccggccggcagctgcagcagcgccaccacttcccggcaatgccgccggagcgacaccaccaccctcctcctccagctcctggaagccctgccatgaagttcccaatcatctcaggtgagtcccaagaacttgtccaagatttgtagtaagatgatcattggaggtgtgtctcgttcatggcgcattcacgccgtcgcggtggcgccgctgtcctcccatggtggagatggtgtaccggccggccattccgggtgttggccgccggccatttcggttaattactgcggtgcagtgaagaaaagattgtagatatgatgctgtggtcctgaaaactttcatggtccaagtcctaggaaactttaaatgatgatgattttggggtcactgattctgtgaaggaggtgaggttgttgttgccacagttattaagaggtgtttctgctcctaatcatctttttgtttcttttcaagagtaagcaagtagtactgggcacataggagattatttactgtcgagtaggaaagctgcccaatgtcatgcagctttacaactgaagaaaactgaaaaagaaaaaggagagatgttaccactggaaatctggtagtaccagcacacagaaagggtgggcctggatgaactgagttacaaaacttgggaaaaagaagtgttttattttaaactatgttttgaagggggtacagattagaacattattttagtgttaattaatttgttttgtggaaatctatgtacttgttggaatgttcattactggcagatagtatggccatagttttgcaagaatggaatcaggctcccctctaaaggctttggactgaaccagtgcattttattcccttttataaaagtggaactgaaagtcttttgggagactgaacaagggaaaaagctttagagcaaatgacatcactcttatcagaaaaggatctaatgcttcaaatgttttaataggcagcactactctcttctgtattctagatgagattccaaaaacattcttaattgttattccctggttggaatcttccctgcccactaattcccccagcagaacatagtcagacaagatactttgataaaaataaaaaaatatattgtcaagtactaagaaatatccatgatgacaaaatacctctgtggttttcaggtgactctgatcttggcaaagatctgaagttccatgagtcctccgcgccgaccatcgccgcgtactcgccattgcaggagtaccaaggacactttgagctagcccttggccactccatggtgagaattctcttacccaattcaagatttactccagaaactgaatctcaaaaacatctttggttgaaccagctaactgtttgtttctgcaactctgaaggtttgcaccaacttctgcaactctgaacaaagctatggtgtttactccccctatggagctcaaaccatggtatatatgttcttcagttcttgtcttcttgatctctgaacatctctgtccaaatccatgtgtaaacttcagttcagattcagcatcagtatgccatgccattttgacaagaatctgaagaagtttcagatgcttactgtgaatattttctctgaatgttttgtgtgcttcaaaggctgggaggatgctgctgccgccggcgatcgccaccgacgtgggtccgatctacgtcaacgcgaagcagttcaacggcatcatccggcggcggctggcgcgcgccaaggcggagcgggagcaccgggtttcccggagccggaaggtaagacggcggcgacggcgacggcggcggcgagtgctcgtcgtcgtctccttcccttgtcaattcgccggcgaacaggcagtgacagtgactgactcgtcttcttcttcttcttcttcttcttcggcgacggcgcagccgtacctccacgagtcgcgccaccgccacgccatgcgccgcgcgcggggcagcggcggccgcttcctcaacaccaagaacgcctcctccgccgccgccgcggccgccgacgcggcgccggtgagctccggtggcggcgaccacggggcgagcaacaagagctcgtcggcgtcggaggcgacgcgcgtgtacgacgacgacgacgacatgggcgcgggcggcggcggcgacggcggcgacttccaccacgcgatgggtcacctccgctcgccggcgttcttcccgtcgctggccgcgatgatggacggcggcggcggcggcggcgaggggaagtgggcgaccgcgacgcctcaccatggctgccgcgtcgacctcctcaaggtgtgaccgccgccgctggccgtcgccggcgaacctcgccggcgccggtggcaattcatccttggctgtagtagtagtagtagtagtagactagtagtgtatgcgcaatggaaatcaatttcatgcaactgatgcaaactgcttctcagttgctcatgtaaaaaggactagaatttgattttattttgatgcagatttgtttaaatctaggctctcattttgtgtgtcctttgatttttgatgtctagtttgatcttggtgcttagatgactaggtttattaaggtgttaacactgttttaaaaacaatcagagtttgctgacaatgattgtgttgtagaattagttgcaagtcatggaaatcttatttcatagactaaattttatttgggtacaacatttttgtagttaataacattacttaaaagttgaaacaacataacatttttgtagttaatagcattacttcaaagtacagtaatccagtctccataaatcttcataagtgatgaatcagaacaaagtcttgcagatggtaaactgccaggttttccatttgagcaactgaaagaattctcatattatagaaatgcaataaacagcagggcaaagctgaagcatcatccatctataatttctcaggaaacagctgctcttccttgtttgaaaaaaaaaagcaacaagcaacaatcagtgataccaaagcagccaagcaatcttacaaaaacctcaagaattcagaaggtttggttcttgcagctcgtcattcagaaggttaattgttagggagactatatcagggagatgagaaaaaccacctagcaagtagaaaccaagacaagtcatggaaatcttgtatcacagaccggattttattgagagttgaacatttatattagttaatagcattactgcaaagtgaggtacagtaatccagtccccataaatcttcatatcagatgaataagaacagagtagatgcacagtagatgatgaatggagggctgcagatggtaactactaccaagttttacatctgataaagctgaaattctgataacattgaaacacaataaacagcaggacaatagggcatgctgaaggatcatccatctgtaatttctcaggttagtcttctcccttgtttgactacaagcaacaatcagtgataccaaagtagtcgatcaatctgacaagaacataaaacacacactcggtttggttattttgcagctcatcattcagaaggtgaatggttagggagactatattacagagaagcaaaaatcaccttgcaaggaaaaaccaagacaatatacgagtatatgaccatatattctgaattagtctaggcatgtctgtaatctgctggttgctttagcctacacaacaaaaacctactagaccatggaaattttattaatttggacaaacaggagaaatactcgagtcaacatagcgagatgtaaatgggtccatcccaatttaaaacactcctcagttatctcacgtaatactagcagggtaaatcttggatagttaacaagacaatgtaactaaactttttattgcacaatattccaatcctcagacaaatgaaatactagcctatccatcaagcacaatacctatgacaaatttatactgctgctaacagacagtttccctttttcaccacatgatcagaggcattggtcacattagtaccatataaaggccttgttacacaaatatggccaaaatgaatcctataaaagtttaaccagaaccaggtaaaaaaatgcagtaaaattttcaataatatttaaacatcagattgcagtcacagtattgttcacctgagatttctataaaagaagcatttctgactaaaaaaacgctagcaagttactaccaactaaaaatatcgctatcatttagtacaacaaaagcaattgcgattgaagactaaaacctcacagctagtgtatgtatactatgtccagttctcaatagattttagaacattctgctcatggttcatcacttaggccaaacttatccagcatagcgatttcagtggaactcaaaattaaacaagattagacattgcaatcaccagcagtaattagtaactacccagcagtataaaatcaatgcaacaagagacaacaatccagtacaggcaacctcctcatgggtgtgccaaaacaacataatactagcatcaaaatttcctcagtaaattgcttatcatgtccaacaattattccgtaatcggctttatttcccccacaaagggacccaaaaattagcttgacgaatctatgatatagtagctctgctcatatcaatcacagtaagatcataaactcaattgctaaccaaatttgaaaaaaactgttaagttactcaggaatcagccttttcagtcaccacttctttctcctttctctcgtcaatggtggtggtcggcgaggaagaagacgacgacgacttctcctcaacctgttgtttcttctcgtcggcggcggacgcggcctcctgggccaccgcatctagcttcttctccccgccttcctttgccttgtcggcggcgatggcggcgtcggcgtggtcgttgacggcctgctcggcgcggagcacgggggcgtagtagtccgcgtgcgcgtccatgcacctcttgaggttggcggtgacctcgaagcagcgctccaccatgtcggagccctcctccttccccgccgcctccacgcactcctcccacgccacgaacgcctccttgcatccccctcccttcatgaacaagcagaacccacactccccttcctcctcctcctcctcctcatcttccccttccccctccttctccacatccgccgccaccaccacagcctcctccgccgccgccgccgccaccgttacgacggcgggttcttccgcctctaggtggggcgctgcgatggcgggatcagacgccggagacgccattgccgtgatctggtggtggttacctctgcttctttcttgggaaagaagttggggaggaggaagaagaagaagaagaggaggagtcgcgccgccgcccgccgccgagttggtgtcggagagggattcctcctcctccaccacctccttgggccctaatgggctccaggcccaaccaaagataggcccaattacaatgagcctagttattaggacgtgttgaagaagttcattttacatcccacaattcgaccgtggcaaagatgagggacgtaaataagacttatttagtacggcccattaagaagcggataagagattagtagtagtagcaacgccaccaccgctgctccactcctcgcttctcccgccatcttctcctcctccacggccatggccgccgtcgcgttccgctcgctgctacaccccgccgccgcggccctcaccgagcgtgtgccactgcctcccgctcacctacggctccagggccttcaccgccaccgcgtcggcgtcctcaacctcttcgtcgcctccggtcatcgccgccgcattctgcttcccctcgccgccgccggtggagagttctcttcggaagaggaggagtacgccaacgaggaggaagaagagggggaggagtacgtggaggaggaagaggaagatggggaggaggaggaggcgcggcggtggcggcgcctcgcggatactacccgccgagaagccggccggcgctcgggcaagagcccggccgcctcttcgtcggcaacctcccctacaccatgacctccggcgagatctcccagaccttctccgaggccggcagggtcgacaacgtccaggtttccatgaccaaccaatcaaaaccctcaaaaattttcccccattttctgagttatatcttggtctgaatctgatggtggatctcatactggtgcagataatctatgacaaggtcaccgaccggagccgcggcttcgccttcgtcaccatggccaccgccgaggaggctgccaccgccatccagatgttcaatggggccgtgagtttttttcacacaccaattcaaagcaattctgctccatttcactgaaattgagctattggagtaaatgaagttatgaaatctggtcaattttgtggcattgtggctgtgtgccttatgtgtagctgcttggagggaggactgcaagggtgaactacccggaggtgccgcggggaggggagagggcggtgggatcggcggcggccacaagggagaacaggcgcgatgacggcacattcaagatctatgccgggaacctggggtggggtgtgcgtgccgatgctctgagggcggcgttcgaggggcagcccggcttgcttgatgctagggtcatcttcgagcgcgactccggtcggtccaggggtttcggattcgtctccttcaggactgcagaggatgcacaggctgcattggaggcattggatggagtggtatgtgttgtctaaagttctcaactatctaaatctttcttcttgatggacctgaattagctgatgccaactgatttaatagcataagtgaactactggggtgcaaatgttagcactttagcttccattatggaatgcagcaacaaggttactaaggtttgatttgtgatagtattttgtgctcaaatgatggtcacactgataatttctttgttgcttctttatcccatggatagataataatcatacactatgcaaaactcttatgtttgctaaattcaaaatcatgttctagcatgattggaagcttcatttacaaatcagtggctaacatgattgtatatgatctgcaggaactggaaggaaggccactgaggctcagtatggcggaacagaacccaacagctggttctcctagcacagtgcagtcacaggaggaagaaactgcttcagaatcatctgatgcagagacagagcagagcattacctcagaaccttctgaagctgaaacggaagagagcaacttgcagacagctgccagttattagtatctaattgatggttgcactgatttacttattctgccattcggcattccaatctaaattgtacttgtccaattgaaaattttgacacaagagatgctaaaatgggatatgagccatagccaatagaatattattagacatagaggtgctccgagtttcagttattgctgtaatatattgtgcagaaatctaaagtgcaactgttttgcttcctatatttattcagttaatatgttctctgtgtaatatgaagtaaaatattggattcattaaggtgtacctattacttgaataaattggggtgatacttcgtttctacttttcttcaatttgtttctactttttagaaaaccgttacttctagaatataactaaacttgagtaatccaatgtgactgttatagtagatgtagtggagattcacttccttattaacatttgtagaacatgaacgacactctcatagcaagccaatttggcaattgtcgaagtacaagatctttaaccaagcaaaaaaaaaaaaaaaggtagcaaacatcgttaagtgaatatcaaagtaacaaacgctctgtcatgtcccatcagctattttgaataaacgcaccactctcaagctgtgcatcagcagaagcatccaggtcctgagggaagaagagcctgcaaggtagagaaatgaaagattgagctcaataacatgatctgatgaaaattggagacatgcagagctgtagcatcaaggacaaaattactagtaaaatttagagaaattgactgcattagatgagtacttagaccagacagcaaggcatgacgcacggacagcttacctgcacgtgttgtggtacagagttttacttaagccttcaatgtcagcaattcctttgcatccagctacaacctcaagaacttgcctgggattgatgtatcttcagttattaattttcttggaggaaaaagttaggcgcaagtgtaaagtataaacaaaagaaaaggttgatgaaatcaatttccgttccatcgaaagattcatgattgattatgataagaatttaaattgatttaaaatctgggcaaatgattctgcatctatggaaaatgctaaccaaataaatatctgcaaaacatcatattgaactgccaatggtcagtattttgttagtcaagtaagacatttcaacaagcatgtggtaataacaaaatagtttaatgttctcagaatgatgagcattacttctactgtgtttcctcagaagaaccaagtaaaaggagcatgaaaagcaaataataacttcaggtgttcatgcattgcaggccagtcaaatacttactgaa

SEQ ID NO: 1448 - DNA, 9948 bp, Oryza sativa
aagtgttgtggtactctgagttctataattatcaaggtgcagcacatgcaaatttgtaacatcaaggggtgggaaggagatgacctataaacatcttttcaaaggaaagaagcttatcacggtcctctgcagttccagtgaaggagtgtgtaacacccccagggaatctgcgatggagaaatatggttctcagacttgaaaatatgcaaatacgtcaaagtgattttcagaaagtgagacataaagaaacgtaactaaatcttattgtcagcttctttaattgtgctgatctagaacactggaggagtacaaagcagtactcctcagtagtccttggctccttgcctatatagtattggtatacagattgagtattacctatacagattttctgacacaatctcacagaagtcttcaccagcagcccgcatgtgaagaaacattggcaattttactgcttcagccaattcaaattgcttcttgaagtacctaaacagtataaaattgctcagaaaaatatgtgaataactatcattattcgatgtgtttatgtgagagtatacttcttctgtacatccgatggacaaaagtgaagtcgatcataatccagaccacattctcccactgctacaacctgtaggaattgaaagccatatcagaatattgcaagttttgactccgaaagacagaacaaaagagtaagtaaataactgaactacttatgcaaaagattatatgttcagggaatccaactcagggtatatttataactagatattgttacatagtgagtttgtttgcactttacaacaccattagaaaatgcatactgcaaagaagatagaactctgctgctcaatgattttggtcttctgttaatagtaagaactacagacataattcagtgagtccaattattttcaagcaaaatatatggcaagattgcaataacatttcactacaggacacggcttgggaagtctacaagcagatcaagcactaccacagcagcatttcagcactttcttcttactattcttctggagaatctggaaacactgtaatgggtgatcttcaatagcttacctccctcaagaacaagactgctacgacaatgcatttaagatatctaattcctgaaaaaaacccgatggttgacatgtaattcctatatggaaacaggtactttctgccaccctatatgttctcttactatttgcatggtctttgaaaaagaaatgccaaatatattatatatttaggaggggatccccaggtgaacttaaaagaaacatttcactacatgatagacctgcaggacaagtgatacacacaccttgcctttcgcaattccttccttcgccagagccagcagcgcctggaaatgcccttccgggtctccactctcctcaaactcctaacattcagcaaagcactaattacatgacccaatcgcaaaaggcacccgccaatctcaggtaccagcaatgaaagaggaatggaacacaatccacccctaccccgcatctcgtcgggtgcacgcccaccgtgcagaacagcctccctgcatcgtacaagcacatcacagcttctcaggcacattacaacaaacaccttgaaggcaccaaggagaacatagtcaaaacaacccgcatccaagcagctgagctcaccgtcggtctcggcgatctcgagcgcttccctagactccttcagcgagcctccggtgaccttccgcccggaccaaaccaaagaaagcaagagattaagcacaccaaagccgagccataagaaagtagaaaccaagcaagaaagaaggcgaaagggggaatggccggcagcaaagcagcgtacgatgatgcggtcgacgccggccgcccacgcgcgggcgagcacggcggggatgtcggcggcgtggcattgcttgccgtggtagatgcccctgaacatgccatcttcagttcgttcgcatcgcagcagcaaagagcaagacgcaagtagaaaagcgtgagagccagacagtgagccgagaaaaacgagataagaatcgtgaggagaggaggaggtgggtaccggtgaagttgacggcgatgtctgctcgtcgcggtggcgccggagacggagaagaagatgagaggaggagtagaagaaggccgggtcagtccaggtagaagcatgagagtcgcgagcgagagggaggagagggaggagagagagtagagcactcgccgatgagcttgacgccggtggacgccatcgccgccgccgccgccgccgtcgagatggggagagagtccgaattgggccgaggccggtcttcgtgtttgggcctccaaggctccaactaaccaaacttgagtttcgtctcgttcttttaattttctttaaactagaaaaaatgcccgtacgttgcaacgggtgaagtttattttaatcttattattgttaaatggtttagttaagatgaaatttattgttaaatgcccgtgagttcgcttggatatatattttttttagaaaatcatgagctgcagttaggagtctgatcgtccaccggtttccagcgctccagagcggagtagagcagtttggtagctcacgaggctcataaccttgaggtttttaaacagatttcttatatgattccttctattatcaaaagtgaacgatcttaaaaaccgacccaaatacggatatgtatttccaaaagcaaacgaacttaaaaattgactcatacacggatgacgtaccaaaataccggcaaaaacatattcaaaatttataatagtagagatagagatatacgtgacgagcttcatgatatgcccgtttgagattagtcatctgtgacaggtgccataactaatctcgtttgactcatatgctgggccaaacctatctatgacaggccttatacttagctcgattgagatcactataatccatgccggccaaatacccgattaagataatatctcatatcagtgatctttgcttagtgacggtagcccttcccgacaccgattgagacctatcccatgctagtgaatccagtggctaacagaaggtcgcagcacaatcgaacctctgcgtcgtgactccatggccgtgggataagcagcagccagtcacctcctcatcgcagaagcttgctattgatccgatccgatttatgaaaaaatcggagggagatttttttttttctgaaacaagaaggcatcgagtaatgaactgcaggggaaaagttgatgtttcacatgaactgtaccataaaaatagttttgcaaccaaaaaagctaaaatttgctcaacaattaacccaccttacaacaaaatcacgatcagttccttcaagtaaacaagctcacagccattgcgtacaaggatgaagcatcatgctcaccggaggtcatggactcctaccagggccgatgcagccacctggcctcgtcctccttgtccaatcacgaaaaaagaccgtgtgattaatgaagcaaatatgggcgttgttatatggaggcagtgaaacgcaagagatcagttcgaattgagaaagaggagacgaagagatcgagtcggagaagcgtcccttggagaagcgtgggacgggacggacaggtcaggaagaggtgaagctgacggatcaacgtgcacgcctaccgaccggcggaaccgacgaaactccaaactcctgaatcctgatccgatttggacacacaataactgacaaaaaactacggcaaaaacatcttaaacttttataatagtagagatttaaataaatttatattttgagtttataataattgaaacctaattaatcctacactaatttttttccttttttttttgcttccaaatgttgttcggattcggaattattgagcacttctttataagcagcagcaattgcagtgattgattcgttcaagaacaaaactcttcaaaatccaatcctttttttttatcggatcgactgctgagatggctgtctccggcatccgcatcctgtccaagaaattcacgccgctactgtgcagatcatcggtaagtagttcatgaaatttcttaggctttatgatggcagtgtgacaaacagattaaaccctagtaatctttgatcatcatgatgatgttgattaccaatgcatgttccaacctgccatatgtgactggccagttttccttgtttaatattattagaatttaacttgtggttttcatcttaattatacaggtagcaagaactggcatggccttgactaaaaccaaccacatgagtacaccatttgtggattctcttaatggggctaagagacctttttcatccagttccatcatcgaggaccgtcatttgtttcgtcaatcttggtatccatggcctccagtgccaaagtaagtaaatcatatattactagagcccatgcgctagctctaattgtttttttctctgttgattgtgtgttcattatgttgctcaagtacaaattttgcagtctcataacatttctctctttctatttttttgtgctttgcagtattgaggaagaatttacgagacaatggaggattcgtttccttgctaattttctgttcttagtatattccagtggatttatcgcacacaagcgtaggaatttaactcataagatgaaattaggagctactagctttcaagcattgggagcccctgcctgcccacctgtcctccccagagacagagaagagcttgtaatttaagttttggttgtttgatcaacttgtaagtgttgttagttaagtgttactataatggttgtggatgtgatccgcatgattgatgtcatcatgaatatatgcaacatatgtatgaacttgatgcttattatctcaattaaaatctgtcattatgggtgtgtttggttgcctgtacatagggtggctcgcatccagcgccagcgggatgtggtgcatgtgtttggctgcctgctcgcacgcgcgaaccaggatgcgctgatgcaaaatctgcctcccagccaggctgagggggaacgcccgattccttcgtagctcctcgtccaggctcgacttgtgcagcgcgtggggacgagtggatgcaggcgcgcacgagcgggtgcaggcaacgcgtaggggtcggtcgatcccccatctctcatttgtttctctcgcccatccgattgctcctcgccgctcttcgccctcgtctccatcgtcgtcgccgcccaccatcgtctccaacctcgagatccttaaccctcgccgacttctccacagcctccgtctccgtctctacttcacgggctagaaccggcggcctcgagcacgtcgccactcgccaagtcgccatcggatccagcagatagaggctcgacggaggacgctgctgccatatccaatagagggaggcgtgaaggagctcgctggaggtttcggcgactgcccctctctgcgccaccgcctccaacctcgccggccaccggattcctcctcactggtcacggattccccatcttggctgcatctcttcccttccttcatcagccaaaataccaatggatccggcggccacgagctggacgctgccagatccagcagcctcgggctcatggccaccggatcctgttgctccgacagctccgaacagcagcgcacacacgacggcgaacggcaggtcggggcttcggcggagcggcaggcctagcgacatcaacgaagctcctctcctctctgtttctttttctgtttttttttcttttcttttttcaccgactagcaaaccgtgaccatgaaatgtgggaatataatgatgtttactgtatgcattgctaattatttcacttattttataactttgtgccgtgcagatgtgctggtgtatatatatcctgcttatttgacgattcttaaaataattgttgccacgaatcaatatcaataattaatatagaagataaaatcaaatgtttagtacttagaaatttacactcttcatgagttaaattttagcttatctaaatggtagtccacaagttttaggtggtaatctcaccctttagaaaaagagatacctacccctaccatccatgcaaccaaccaaacgaattctctttcaaactgtatttcttatacgagtaaccaaacaaaatctcgtgtcagcctagctagtctaatgcaaacaaccaaacagctgcatgtgcatcatctcaaccaggccaaactcagcctggatgagagagatgggctaggctaggggaatacgagcaaccaaacgcactatatgtgtttgtgatctcgtatgtatgtttttcttttgagataggtatgctggatgaagagaggcgacaccgggacatgcaactatgtcatcagcttcccttgttgagcgagaaagaaagagcttgtagttttaggttttgcatgtttgatcaactagaaattgttataaactgtggttgttatggtctgcatgattgatgttatcatggcacagagtgcccaaggctgcaactctgttcgtgcaagtataaagtataaacaaaagaaaaggttgatgaaatcaatttccgttccatcgaaagattcatgattaattatgataagaatttaaattgatttagcttaaaatctgggcaaatgattctgcatctatggaaaatgataaccaaataaatatctgcaaaacatcatattgaactgccaatggtcagtattttattagtcaagtaagacatttcaacaagcatgtggtaaaaacaaaatagtttaatgttctcagaatgatgagcattacttctgctgtgtttcctcagaagaaccaagtaaaaggagcatgaaaagcaaataataacttcaggtgttcatgcattgcaggccagtcaaatacttactgaacaattaccttattagagtttacgcataattgtgttgaattacctgactaagcaggcctcattgcgaccttttactgtagaatccggctcgtacttttctttcttcttggatggccagacagactttacgagcttgattccagcatgagtatttttaatatcacagtatggagagtctgtctctatcatcattctctctgcaggaataccttgtagaacctcgaaattttcactagtcttcagagagcatccattaatacatgcattggtacattaagtcagtatggtttacctgacataactgaattataatggaatgagaacgttttaattgctactaatatttttattcacatctaattgcccaaatggaggtcttcaccaaaaaaagaacaaacttgcagcagaaactgaaatgaacttcgactacaaatagaagtgttgtggtactctttaagttctataattatcaagatgcactacatgcaaatatgtaacatcaaggggaggggggagatgacctataaacatcttttcaaaggaaagaagcttatcacggtcctctgaagttccagtgaaggagtgtgtaacaccgccagggaatctgagatagagaaatatggttctcagacttgaaaatatgcagacacgtcaaagtgattttcagaaagtgagacataaagaaacgtaactaatcttattgtcagcatctttagttgtgctgatctagaacactggaggagtataaagcagtactcagtagtccttggctccttgccaatatcattatttgtctttgtggtcattatggtattggtatacagattgagcattacctatgcagattttctgatacaatctcacagaagtcttcaccagcagccctcatgtgaagaaacattggcagttttactgcttcagccaattcaaattgcttcttgaagtacctaaacagcacaaaattgctcagaaaatatgcgaataactatcattcttcgatgtgcttgtgtgagactatacttcttctgtacatccgatggacaaaagtgaagtcgatcataatccagaccacattctcccactgctacaacctgtaggaattgaaacccatatcagaatattgcaagttttgactccaaaagacagaacaaaagagtaagtaaataactgaactatttatgcacaagattatatgttcagggaatccaactcaaggcatatttataactagatagtgagttcgtttgcactttacaacaccactagaataagcatactgcaaagaagatagaactctgctgctcattgagttcggtcttccgttaatattaagaactaaagacataattcagtgagtccaattattttcaagcagattgcaataacatttcactacaggacacggcttgggaagtctacaagcagatcaagcactaccacagcagcattgcagcactttcttcttactattcttctggagaatctggaaacactgtaatgggtgatcttcaatagcttacctccctcaagaacaggactgctacgacaatgcatttaagatatctaattcctgaataaaacccgatggttgacatgtaattcctatatttaggaggggatccccaggtgaacttaaaagaaacatttcactacatgatagacctgcaggacaagtgatacacacaccttgcctttcgcgattccttccttcgccagagccagcagcgcctggaaatgccctttcgggtctccactctcctcaaactcctaacattcagcaaagcactatttacataatccaatcgtgaaaggcacacgccaatctcaggtgtcagcaatgaaacaggaatggaatacaatccacccctaccccgcatctcgtcgggtgcacgcccaccatgcagaacagcctccctgcatcgtacaagcacatcacagcttctcaggcacattacaacaaacaccttgaaggcaccaaggagaacatagtcaaagcaagccgcatcgaagcagctgagctcaccatcggtctcggcgatctcgagcgcttccctggactccttcagcgaacctccggtgaccttccgccggaccaaaccaagaaagcgagagattaagcacaccaaatctgagccataagcaagaaataagaagcgaaagggggaatggcaggcagcaaagcagcgtatgatgatgcggtcgacgccggccgcccgcgcacgggcgagcacggcggggatgtcggcggcgtggcattgcttgccgtggtagatgcccctgaacatgccatcttcagttcgttcgcatcgcagcagcaaagagcaagacgcaagtagaaaagcgtgagagccagacagtgagccgagaaaaacgagataagaatcgggaggaggaggcggcggttataccggtgaagttgacggcgatgtctgctcgtcgcggtggcgccggagacggagaagaagatgagaggaggagtagaagaagaaggccgggtcagtccaggtaggagcataagagcggcgagcgagagggaggagagagagagtagggcactcgccgatgagcttgacgccggttgacgccatcgccgccgtcgccgccgagatgggggagagtccgaattgggcccggtctccgtgttgggcctccaaggctccaactaatcaaaaggaaaaagtacacccaaggtcccttaacttatcattgaattacaaaatcgtcccctaaccgtaaaaccggatacaacacgtcccctaaattacaaaaccagtgcaaactaggtcccttggcggttttgatctcggttttattcgatatggcagctgagtcagtgtgggacccacgtgagccccacgtgtcagtcccttcttccccccccctctcttctttcctccacagttcggctcggcagtgggcaaggcagccggccggtgggggaggcgggagaccggcggccggcggccggcaacgggtgacgaagcggcggtggcactgcacggtctcccgcgcatgccctcccacattgccgccaccgggggaggagctgggcggggct

SEQ ID NO: 1449 - DNA, 6706 bp, Oryza sativa
ctctccccccccttgctagcttcacatcaaagctcactatcgctcgacggcgacatcgacgatgagcgagacgacacggccggcggtggcgcgtcctgcttcccggaccacctcctccggttcaagtggcggtggtgcctctgcggttcgtggccgagccggtgacggtgaggtcgtgcggccccgccgacgccgacgcgcgtgacctcatcgcttgcctcttcgccaaggaccccgccgcccgctttggctcccgccgcggcgctgccgacatgaagtccctaacgttcttcaagaccctcaacctcgccctcctccgttcgtcgcggccgctcgttgtccttggcgccggcgccgcgccgctgcaccggtcgtagtcgtgcaaggcggcgccgacgaagctggcctgcctagagtacagagagaagataaagagaggaggaaagagagaggaagggagaggctggcctgctgacgtggcatcctgacatgtggggcctacactgactcagctgccatgtcggacaaaaccggagtcaaaaccgccgagggacataatttacactggttttgtaagtggggggacacgttgtatctggttttgcggttaggggatgattttgtaatttgatgacaaattgagggaccttgggtgtacttttggaggcagagtcggcggagtcgaagagatggcaacaagggaccgctccggcaccaagcgagaggagggcgtcgacgaccacgacgccgatcgcgaggtcctcgggcttggggtcgtaatagacgaccccatgaccacccgaggcagctctggcgctctcttcccatccttggtatcttcctccacatagccgttgccgatcattgacgcgtcctcgttgggttctgtcccagcctcagcctcatcagctccaccccgccgctccgcccatccctctgctccaccccaccactgtcccattccgctgcagctccatccaccgcgccgccgtcccgcatgctctggccgctgctcgtctcgctcagccagccgctacgccctgcccgtcgcctgctccaggggagagagaggatagagaaaataatagattagtgaggctgacatgtggggccacatgagccccaccatttttttttgatcaaattgccacgcagacaccacgtcagccaaaaccggggataatactgctgagggacctcatttgcatggctttgtaagttggagggtgcgttctatccggtcttgtggtcaacagacgaatttcgaactcgacggcaaattgaaatgaacttaatcctaaacttttcctagtacagaattaggcggccctagaaccgtggttggggtggtgggccggggtgttacgttaatgggccgcatcacctgtaaaggtccagggcgtgaggcacggcgaaggtgcgtgcgtgcgtgcgaccgacctgaaaatccaaagcactcgcgtcgccgcggcctctccctccctcctccgatcgccgacgatggcgcgcgccgccgccgccaccgccgcggcgatcgctccgcatctggttccggtgattcggggcgccactccggtgagttaacttggtcgtcgatccgtcgttttcttccggcagataaaccctaacccctaatttttctttttgtgcttgtcttgtacttgtcgattcgatgcagttcgctcccgccgccgccaccgccgcggcgatctctctgcatctggttccggtgattcggggcgccactccggtgagttaacttggtcgtcgatccgtcgttttcttccggcagataaaccctaacccctgaatttttttttgtgcttctcttgtacttctcgattcgatgcagttctcttccgccgtcgccgctgccgccgccgccgcctccaccccggcacggtcatcctccgccctcacccagacgctctctttcccgatccaagctaccagggtaatattactgctctaattgccatgtctatctgctacctccgtcccctaatccaaaaatataggctcccttatatttcttttttgggacgaatgaaacaaagggaatcgattctgtcacacgggtggatttgggtacagtaattgtaaaccaaaccctcttgctattctgatttgctactactgctctattgagttgagttgatactagtaattggattggatcattttgttattgttgcgtgtgcttgcctattttgttgaacaaaattcctggttattgctgctgcactattcctccgttaaatgcgcctaacttgttgtttcttgttcagtccgccgccacctccaccccaccatgggcttcctccgcactcgcccagccccgctatttctccacaagagctaccagggtaatattactgctctaattgccttgcctatctgctacctctgtccccaaatccaaatatgagggattttggctctgcattcgcattgccaaaatcccttgtatttcttttcggggacggatgaaatcgattctgcatttgcatccacgcttcctaactggatgagagaggagtgacctggagaagctacctgtgacgctggaagttttacccctgttttctgtccctagaagttttgcccctattttctgtccctagaaagtcctgaagttacctaaagttgcattttgatctctctgtggttgaagtcttgctgcgctgatcatctgtccttcttgccacacgggtggagtctgcttttagtatttgggtacagttcttttctgattaagattcagattttatccgcactcaccctgtcctgctatttctccacgcgagctaccagggtaatgttgctagtttaatattttatatcactattttggtgtgatttgctgaaaaaaagttgttttctgatttgctacaagaaactatttgataggattttctaaagtgatttatattgctatgacactaaaaatgattgtttgaactagcttttatctgacaacatcctttgatttgctgaaccctagtttaaagtgccaattagtgcaaagatatgtagtgttgagtgaaaagtttggtttggcttttgtaccttgtgaagtttttatgaaaaattctaagttatttgcacatgtgcatatgcatgtgttgacgctgttgtcttcgcatggttactcgcatcttcaaacaatttcttacaaaaatattatcaaaattatgtatgttatggccgttaggtgcttgcgtgattaattttgtatgatgcagatcatatattaaattttatatgtatgactgatatgtggatcgattttaattatggcctttatatattatgtagttagcaagcaagaaaatgatatttatctgaagcaaacagtttgttcttgcatggttgttttggcacatcaagaaaatatgccgtttgctagtttgacgaagataaaaataggaggatgggaggaagcttactggaagctcaatctcagaattgaccatttgaatgctgtgatgaggtactacattcggctcgaaatatataacttgtgaagtttctcgtgtggcttgtgaatttgttataggtttagacagtaacaaggaagtatgaagagaaactaaatgcgagatgatcattgtcggttgagacgagaaagtgggtggagaatttgctaacattgcattttttttttggatttgtatattccgacagggatgggcaaggtatgcaagtgcatcgggaggtgctcaaggtcgtgtccggtggtgtctgtatattttttattgtggtcactattcgtcatctgaaggagacgtttgcccgtcgccgtgctggactcccctctgtgatatctgatgggcacaagtgctagtggagagggcaaaagtgactaggagaagacaaggctacgaacggaggtgcagactaaaaggcggcgtgtattgcgagtgtgaagagggactgtgaaaacaagtgctgcgggagttgtatcgaacgaatttgagaagtaacggcattagatgggttggttaccagtgtagtatttttgttgccacggtgaaaagcaagtttggaggcccgctagagatgcatatgtttgtggcattgaaaaggtttctatggcgcccaacaaattcctttgcaacatgctcgtcgttcgcagaatccctcgtagacacgttgctgatcgagcggactagtgtatccgggcatttacctgttgaggtgttgtcgccgccgccgccgctgaagaaggcgatgcgttcgtcggcggcggcggcgccgcggctggcgaatatcaacgggcctctgaccttgaatctcagtgagcagttgcagggttcctgctcatagcgctggagcatcagtgaatactaccattgaacaccccggaccatttcatgtcatacctcttggtgagtccttattggcctgcaaatgaagaattgtttgaagaattcagtaatgcattttccacgattttagaggtatccttccctacactcaacaattctaatgtagacacgttctcacatctagcttgtgattccagactagtagatgggtccactatcagtagctcaggttttatctctcgaacacctgtttcttctataaagcttatagagcattttctgccatctcctggcaaaagaaacaaggggacaaacctaaacaaatgttttcttaatgctatagcattcaacagccaatggttgtataaattctactaacagatcgaatgtagcgtgctctttgtgagttctactttgacattttagttctgcctgttaatcatttgcccttgattcttctttatgacgaattatcctttttggttggagaacaatgttcttcaccctgcaattattaattggtagctacaaaatgattgctagtataagtgaatagaaagatagatctgtcttcaacatttgttcgtacgtcttacattggttgttcactgcacataaattgttttttttaatgaactgataatttcaagtttagggaatatgtagcagaatttgagtttgacaatgtttttcttgctgatcttgacaaggtggaagaagagggataatttgttgaagtttgacaatgtttttcttcctgacgaagcagtcgtggaagaagagacggacgaggccggggccattgccggggtcgcggaggatggcggcgcggacgacgttgcggacgaggtcctccgccctggggcaagtatagttgtagtatccgacctgcagctgcgcctccgacaaggacaacgacgcaatggagaagaacaggatcgcccacgctatgatcaccggcgagccgtgacgacgaacaccgcgtgctgcgctgcacatctttcactgctataccgtgtgtagctttgacgatcgcagtgaaactgaccgatgcgtcggtgttgatcgatgcagtgtgtaggagtagtagtgtagtggtgcagcaaattaaagcaggagctaggcgtgacggtgatttatatacgtggatcgatggtggatgtgcgtgccggggtgaagtgattagtgacagatggagaggggagcagagttgacctggaaggtactcgtacctcggtaaactggagacgtcacgttgattacatggctttcccacccgttgccgcgacctctatttagcaacgtgttttaacctttcgccgctgagccatcgtcgtggtagtaatatcacgttgtaaaactgtaactagaagcgtggcgtcgtaacgatttcgaacgaagagacgccgcgtcaaagatagtcgttgcgccactgagaggcgtgcaccgctcgatcgccacgacgaggctacacgagacatgcagcccgcgcttcgtccccagccgtcgtgtgcgtcgcgtcggcctcgtccctgtcgtcgttgataccggtcgggtgattgtgcatcgtaattcccaccctcggtcactaattttggattctgatacccttcgatcgtgtaacggctagcgcgcccgcagttccccatccaatccaagctcgcacgttgttcactagccaaacgtacgcgacgcatggcccaggggccagtgcgggtgccgcaaataacactctatgtgatttagtgaattccagcacaagcacacaattcttcctccaacacttgatacacgagtatttgggatacaaatgggagaaatggaatcaagactgagaattagcagtagattggagaagaagagatagccagggattgaagagaagagagatacagaggttgaagaagagagagcatcggaaggaagaactcaggtttcatctattttgttcgatccccccatctgttggatctgctccttttgtaacggcttgaatgattggcttatcgcagcggattgagcctagctagccatgggctcaatatgtataccgattcagcccagttacatgacaatccacgagtactaaatatgtatgggatttagtctatgcactaacagatgcaaaatcagggacaaaggtagtaacaattcataacaggtaaatatatggataaccacaaatacaaatactttatattatactggagtagtcttttttttccgagtacaaggttttctgtattttagaacgatgagatataacaagaaaacatatggctacgaccacatcgtctgcatgcatgtacgtaaccccctgcataagtggccgaattagctcttgctgtggttgatggcgccgcagggctgcagga

SEQ ID NO: 1450 - DNA, 44490 bp, Oryza sativa
  unsure (1)..(44490): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggacttagcagtttcaacgtgaaattgaattggcatgatcagtcagagccgatgctttactctgcacgtgctgctcgtcgcgattgctgctcgtcaaatcggagtcgatcagtcgactccttgtcggcgtttgatgcgaagccaaatctcgctaaacaattgacgacgatgatgaagacggccggcggcccggatgggcctatttggtatgggattggtccaaatctaaaatttagttctagagttatgtttggataaagccgtagagcaatttaaatccaactctatctttctttctagtttattttgtgaaattattttactcagtttcgtttttattttaggtggaggtgaaactgtttagttaggctctaactctagtagaggtggagctgaaattgtgccaaatagacccttagtatatccatctctaaagttctaataccatttattataaaaatagatgcacgactaatatatgacttttatgtgaaaaactcttaccagaaaagcctacatgcatagatcggcaatgattaatatagaggagttgggtacaaacgtatagaatacattgggttgtcgcatacttcttgtgaggtttacaagagatatataaagaaaaattctaagagtcttagtagaagaagatttagagacatattagaaaattaaccctgatagtcaagttttatatattagaaaactaatccaaatatgtttcatgccaaaatttgtagtagaagtatcatatatgtaacatatttaactatacctgcggtatagcactatagaacgtgtctttgccaggacacttcgattacttggtaatttgccaaaacattccatgatcattatttcaacattttactcatttgggcagataaaattttaaaaaggtgcttttacgccctttcgcaaattgaaaattttggaatttcagcgcctcacttcctaaaaggacatctttaattagaaaaaaaaatttaaatctgaaaaaaatcaaaatatatttttaactttttaagtattttagttttccatggaccccgtaaacattttctttatttttgcaatttggatgttttttaatttaaaaaatgtttaagtttaccaaaaaattattcaaatttcaattctttgtccgatattttttagaaaaattctatcaatcacctccaaaatgtttggagattttctgcaatttagtaaaagataaaaccaggctgaacatccaacttggcatgaggtaatttaaaacgtcatctctgtaattgtatctatctagtagttgagctgaaaaatgttaaaatattaaaattatggtcattttagaaaactaccatgaaagtgtctcgtagaaaatacattattgtataaaaataacaaatacatacatatctaataatatttcgtcgagcatgttatgccttttcgtacgaaatagtatatgtgccatggaaaaacacgtgagcatttgagtacttcagactttcactcgaagagaaaatgtatcaaatgttaattaattgtatatgtacgtacatcctaatttaaaaaagtacatgtcctatattgtatattcaaggtttcattttataagaagcaaaggctctaagaatctcccacgaataaaaaagaaggcgctaagaatcaaatttggacggccatatagttaattaattagcttgcagtttgccacaaccagtatatataagaatttaggtgttgtacatacgtaccttgatgatgtagatttgcaccgaactgaaaatgacgttagtacgcatgcattttctcctagagtgtaccggctgggcggctggcatttatatatactatgtaaaactccgcgtgttgctactgagttagcataataacaagtgaaaacaatgtgtaagatagctagctagacaatacaagcttacataaattgatgcatgtgatttatgataaattaaaattaaatagtgtatagaatgatgatttaaatgataaattaaatttaaatagtgtatagaatgatgatttaaatgtaaaagtaaaggtgatatggctttatgagagaagaaaaggagagagatattttggaccatagattatctaagactaaaaataattgatgtgatatggcttaatgagagaagagagaaataacattaactaagtgagaatgaactatatatagaatattataaaaaaggatgaagagataaattgaaataatatttgaattatgtgggatgatgatttaacatgcttacattttaaaaactctaaaattcaataaatcataaaattacaaataatatagcatgcttcataatgtttaaatgtaataattattattgaatgatgatgtagcatattgttagaggatgatgatgttgcatctttttatttcaactactcccacattcctttatatatattgtaaaattaactggggcactatggtgtccaggcaccaagatttaaattgagtacatatattcaatttaaatgagtatgaatttttttaaaaaaatgtttagatatgatggttgtaaggtggttttcagtcggttcatctgtaaccgtgatcaccatctaatagggcgctgccatgtgcaaagggaaagctgggggacggtaagtctggttcggctcccaccgcctctagccatcgacttcatccagtgaatgacaggtaggcctctatggtgactgaggttggtttggccctactttagatcggtttcaactgtcatgtgagccctccaatctttttactcacgtatgattgaccggaggttcattttatggcatgacatatgtatttttattcataaatgacctgcataaatatatttatcaaaactagtgaaaatggttagcaataaactcctaccatcaagttttgatataatattttatattctttatacaggagttgacggttaaagtttacacttaatgaccgtcaacaataagcgataccgtggcagtttcgcgtagccgcgtgctaacctcggtataccggtattgcactcctaccccgcgataccgatggaatatttcttccaaacaaatttcaaccggtatatttctttcaaaaaaaatcaatatcagtattcatgcaatttttgttcaaagcactactttcgctacagtacaatctctaaggaacagcccctacatcaagtgccactgtactattgtcgtatactatttctttcttttccaccgttgacgttttagaacggagggagtatgtatatatcgtctgtacattagatttgctattttggtactttcagtgtcctttttctgagtactagctgaataattttgtgttcgctattggagggtacactaagttgaaaaaagaatttaaaatagttttgtaagatgatttaaaatataagtatttatatgattattaacaaaactaaggcagagtgaaaaaaatatcttttagtggttaaattttaaattgtttatatatccctttcaagcatcggatgaaaatgtacagaacgatttttgtgcactggactgagtgtcccataaatacttatattgtggcataaatttttgaatactcaaaatattttgaaacaaaagaagtatatggaaagtgtgtaccattaatccaatctttcatatgactgtcaacgccgtaaatatatctgtaatattactctcagtacagttaattagcatatggccctgaaatttttcggccgaacccggcaattttatatttatatatacccttgccttgagcttaggcatcatgtagcctcgccgctcaagcatcgctaactcagttatagctgtctaacaaagcaaattagctttcgctgagctttgtgttgcttttggtctcctagataggtttgtgaagcatgaagctcacggtagcaattgtctgtgccatggcgaccgcgcttctcgccgccgccccgtcgtcggcggaggccggcgacggcgagctgaaggtgggctactacgacaacaaatgcagcggcatcgaggacatcgtcaggtcgcacgtcatcaaggctatctgtcgaaactagatttcggcaataataaaagggggtggctatcaagctaggaaagtgtatgggtttggaaacaaaggatttatacaggttcaggccttcttataaaagaagtaataccctactcctgtccggggatgaatccgccgagtgtattattgattgtatgattcgggaaaaaatcagcatatgcccctagaggcgcccggaccccccttatatatgggaaggagtccggattacaaaagataatctatattcctaacggaatatgaagatacagataaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcatagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcacacgcggcgcctaaataggcatgctagccgactgctttttagccacaataaaagaaatccgagtggtttacactctaaaaagttcacgaatgaacacacttgacaggcatccgaatataaaaactctaaagattacccatcaagtattataaagattatggtaataaataagtcaaatagcctaggccatgactatttaccatgaaaacaggcatataatacgccaaggaaatgactataataaaaacaagtcatccctagttaacccaaacagcttttgtagcctaaaaaagcttgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgtaaagctgcgccggcgaactagggttcacagctccggccaaatccacctccgaaaagtgcatcaaaatccttcccgtgatccaccgcctcaatccctcacctctcccaagccatccctcgaatcaaatcagcacatttgagtgaaaccgatggcggaagagagagaaagcttcgaaggccaatgggcgccatccgacgtgacggaggaaaatcttaaggagatggtggcgcacggcgttctccctgccaaggagatcatcgggtggcggccagcgcacggtgaggttttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcatccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggctggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactagcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaactgccagttgtgccatataatgcattcaatccgcctccacaggtatgcatcggaaaccctcaaaccgtgatcagaacataattttatcttcatgctgagttgactaactatggaagcatcttgttcaggaatatgcattgatgaagtcagatccaccagtcactcagcgccggtctcctcgccaacacaccgctcagggaggtggagggccaacgatcagaccagatccgcaacctcagacctccaaattgactggtcaaacaggtcctcgcaagagaaagctggtacttgatgatgatgaaggcgacgatgataaatctggggataagggctcgcctaataaacccccaaagcgcaccatgcccaggaaaaaactggctggccgtgcgatgccaaagatcagaacatcttccaggtattagatctctcggtatgatttccgcttcggcatgttttccaatgaagataatgctaaatactgaaagaacactctgcaggaaaccatctgatatagatccatctggaaaggaccccgatcctgccatgacagagcaaaatatacccaaggaccccgagccgactgctgaaaaccagccgaccgctgaaagccagccaactggcgcccatgcttcgggcgatagggccgatccgagtgacctgccgccgactagaaatcagtcggcaacaactgaaacggcaacaactcaagagcccccgactggaaaccagtcggacgcaggccctgatcaagagatccccgaagtagaagcgcagacgacgacttcgcaaggaccagaggctggtaacgactcgatagctgggtcttcaggtaaagaacaaagatcacctcacgctcagctaggtacatcttcaggttagttgtcttctcaaacaatggcgatttaaataacctcagtgtatccgtctaacgtcttggaaatacatcaggaccatcaggtgatgacggagaagaaatccctcgcataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgacccatcatgcagagaatccatcttcgcaatgaggccaagactacaactttggaaaagctggttcctcatttgggaactctagaagcagttagggaccagctgcatgaggccaaggagtgcgccaaaaagacagagaaagagttaagggaccgaatcgcccagctccaggatgcaaacttcgaactaagtggttcatcaaaaggtaatcatccagatctgtttcatcggtttaaactggcataacggtatcctcaaccatctgaatttcaaacagcgcaagctgccaggatggaacagatggtgaagcaaattgaagccctggagagagacaagacagaactagctgcgcaaagggactcagccttgaaggaagtcgaaggtaacgccagctaacaatctgagcttctctccttataatgcaacagatgctcatcataaatgtgttttgcagaacgcaagatcaaatctcaagctcagtttgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgataccattgatggatttgcagacgggacaagtgaagaggctgcccttgatcttatcagcaatgctcagagtgcggctgacaagattgcaagtgatgttgtagaacaattccgcaacaatgatcttcagccgagcgatgataactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccgagtaagcaaactgaattgataaaaaatcacactccattattatgatgatagcccccgactgacaacttcaaggagaaaacttgatgtttgacagtcaaaatagggaaatacaatgataaagttaagcgtagaagcgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttcacggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccattagctcgctccacctgtccattgctcattgggtgtgctactgaggcatagcaaatcttgattccaaaatcttcacaaaagtctttgaaaactccgccggtgaattgtgtgccattatcggtgatgatccgattgggtactccgaatctgtacacaatgttgatgaagaaatcgcgagcattatctgctgtaatcgtggcaacaggcttagcttcgatccacttggaaaatttgtcaatggccacaaagaggtgcgtgtaaccgccgactgcctttttaaacgggccgaccatgtcgagcccccaaaccgcaaacggccaagacagcgggatagtctgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtacgcgctgcagcatggtttccgcatatcccagaatgtatgtccttcaacaattgtctcccttcctctaaagatacgcagcgttgcagaattcctgaagggcttttcttgtataactcggcttcatgcataacataaagtttgctccgccttgaaatccgctcggcttcatctttatcttgagggagctcttgggaagttaaaaatcgtatgaggggctctcgccagtcagcttcaaccatagctatgtcatgagtgtccgcaacttgagtagcatctttgtgaggtactgtcggcgaataaaggtgttcgacgaaaacatcagatggcgctgcctcgcgcttggatccaaagttggcaagtctatcggcagcttcattgttgtgtcgaagaacatggctgagctcaagcccgtcgaacttatcctccagtttgcgtacctcttgtcgatatgccatcatgttgtcgtcaatgcaggaccactctttcataacttggttgacaaccagctgtgaatcacctcggacaattagacgctttatccctagggaaattgcaatccgtagcccatgaaggagcgcctcgtactcggcgacgttgtgagacgccgaaaaatgtatccaaagcacataacttagtctttctccagttggggaaatcagaaccactccagctccagtgcctgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaagcccacttagcaatccgcccatttgcttcgcggttgtgcagtacatcgccgagtggaaatgatgtgaccaccgttaccgagtgaccttgaaagtaatgagacagcttcctggtagtaattaaaataccatataacagcttctgaacctgagggtacctcgttttggagtcggttaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaagccttctgtgcttcgggtccccattggaaattatctgttttcttcagtagcttgaagaagggcatcccccgctcgccaagtcttgaaacgaatcggctgagcgccgccatgcatccagtcagcttctgaacgtctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacgtcatccacataggcttcaacgttgcggccgatctgcgttgagaagcatctttggatcatacgttgataagttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgagaagttcgcagccggcggttgagtcaactacctggtcaatgcgaggcaacccgaaaggatcttttgggaaagatttgttaaggtcagtgtaatcgacacacatgcgccattgccctgtctttttccgaaccaggactgggttagccagccagtcgggatgaaggacttctttgatgaagcctgctgctaacagcttggtcaattcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcggaaggatctaagggaatctttttagtctcggcttcggtttccccactttttgaaatcttggcagctggcacttctccttcgctcaccgtggttgcagccagtcggatttcctctcgggcagacgccatctcgcgggtttgggccatatcacaactctccttgtcacatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggtgtgtcgggctgaacagcattgatctcccgttcggtcagcttttgcttccttttagactcataagccatggggccgccgaaaatatgattgagctccttacggtggtcttgaaatccagccggggtgtcgccgtcgtccttcttccttgacgtgctttgttcctcgtcggagttcttccgagtagacttggtgtactgctccgcgaactgcttgtagatgaagcattctttggccacgtggttggagtttggatgatgcgggcattgggagttcatgatcttgtcgaaggtgttgacgcgcgaacgctgtcgagaagagtgagcggcggttgcaacaagttcctcaggcttgcgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgcaactccgtcaaggtcgtcgtcgcggcgatccggcgagtgatgatagcctcgagctgctcggcgctgcgtgattgtgtcgcgaagatcgatggggcggcgacgaggtggtgagcgaggccgttccactcggcgctccctatgaagttcgggaggcgagtgaacagaccgctcgtcgtggcccctgctcctgcgattggatcctgctccagtaatgctgaggcttggatgacggtagtcatgagatcggaagtgggggacccggctgccagtcggcgtgtggacgctttcggagttaactgggaccgtcgccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgttgacgtcgatcctcagcctccttcgcggtccgctcacggtcctgctgctcacgccgtagccgttcttgttcttgcgcttgatgctcctcctccagtcggcgacgttcttcgttctccctggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgccgagtggttggaggatgacgccgacttccctgaagctaggcgaaatcggtgttgaagccgacttccgcctaggcctacgggatgaaggcgctgtcgtggtgaagacggccgctaaatcgtcggggagcttcatcaggaccggtgggtaagccccatcatcctgatctggtatcgttggagaagatgcgatctcggccgagtggtttgaagccgactcggttgaggtggtcttgaaatagctttcagccgcgttcgggaatccaaacgggaccgaaagccggttctctcccgactggtctgattccgagtcgaggagagaaatcttgccgaagttgttggtgatgaagtcgaggctgccgaaccgaaacgtctgcccgggtgggaagacgaggtcgtcgatgccggagatggaacccattgcactgatcggcgaaaaagcttgacgctacccctacctggcgcgccaactgtcgaaactagatttcggcaataataaaagggggtggctatcaagctaggaaagtgtatgggtttggaaacaaaggatttatacaggttcaggccttcttataaaagaagtaataccctactcctgtccggggatgaatccgccgagtgtattattgattgtatgattcgggaaaaaatcagcatatgcccctagaggcgcccggaccccccttatatatgggaaggagtccggattacaaaagataatctatattcctaacggaatatgaagatacagataaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacactatcatacaggaccgcggcataggcggctccctcatccgtctcatcttccatgattgttttgtcagggtatattttgtttcttcctccgtttaataatgtaagtcattctatcatttctcacattcatattaatgttaatgaatctagatatatacatttcctatctagattcattaacatcaatatgaatatgggaaatgatagaatgacttacattgtgtaacggagtgagtacatatcggtacttcatctatttcatattataaattgtttcgggttttaaatggatttatgagtgaattcatttatattacctctatttctcattataagtcattctattttttttcctagtcaaactttcaatttatagaaaaatatagtaactttttcagcacaaagaaaatattatattatcaaaatgtattaaatgttaatcttaatgatattaatttggtgttgtaaatgttgctaaaatttttcataaacttaatcaaacttaaaaaggtttgaaaaaaaattaaaatgagttataatactctctccatcatattccaaatctaaaaaatttacttttgataggcatatttcaatccaaccacctattcttttaatgactttcttggatttcatgggggtggctaattggcgcgcgcccgcctgttggccccggcccggaagcccatcaggcttctttttttcttttttttcgcaagatttttttgcgatttttttgcctttttcttttatcttttttttcgcttttgtcttattacttttttaatctttagcacacatattttttcaaaaaatgttttgagttgaaaatttttaaatctttaacttgaaaattttaaattttgatttgaaagttatcaaatcttaagttgaaagttttcgaatctgagttgaaagtttttaatctcaagttgaaaacttttaaatctgagttgaaagttttcaaatcagagttgaaagttttcaagtcgaagttgaaagttttcaaatcagagttgaaagttttcaaatctgggttgaaaatttttcaaatttaagatgaaaagttgaaagttccaaaatttgactttaaaaaatttaaattttgagttaaaagtttttaaatctgggttgaaaattttcaaatctagattgaaagtttcaaattttgagtggaaagtttttaaatttgagatgaaagttttcaaatatggattgaaaacgtttcaaatttgaattgaaagtattcaaatatcagttaaaagtttaaaattttgagttcaaagtaataacacaaaaatagaaaataactaaaaaaacaaaacgtgaaaaaaaagggaaaaagatgtgggcctaacagaaaaaacacaaacgacgagtcctttctcaataaaaaaagtgcgcgctatttgcttaactcgcgcagcttttccggaatttaatgcgtgactctccattcttccacgcaatattggctatataggcatcgagaaatgtaaatatattaataaatcgcttgtttacgagaaataactagtagcatatttaaatggatgataagtaaaattacttatctttgatcggtgtattaagataaaatataactataaaaagtaatgaagggagtacgaaacagaggaccaaaacaacttatatagtgaaaaggagtagtagttttgaagcactaaggaggtactagtagctttgaagcacttgggactaatgagtggttgcacaatgcatgcatgcatgcatgagtattgcagggttgcgatggttccgtcctccttaacgcgtccgacgagaaccctcgtcctgagacggcagcgccggtgagcatcgggctggaaggattcgacatcctggaggagatcaaggccgatctcgagaggaggtgccccggcgtggtctcctgcgccgacatcctcatcttcgccgcccgcgacgccagcagcatcctcagcaacggccgcgtccgcttcgacgtccccgcgggccgcctcgacggcgtcgtctcctccgcctacgaggcccaggcggagctcccggatcccaccttcaccatccggcagctcatcgacaacttcgcccgcaagaacttcaccgtcgaggagctcgtcgtcctctccggcgcgcactccgtcggcgacggccactgctcctccttcaccgcccgcctcgccgcgccgcccgaccagatcaccccgtcctaccgcaacctgctcaactacaggtgctcccgcggcggcggcgccgaccctgcggtggtgaacaacgcccgcgacgaggacctcgccaccgtggcgaggttcatgccggcgttcgtcggcaagctgcggccggtcagcgccctggacaacacctactaccgcaacaacctcgacaaggtggtcaacttcaactcggactggcagctgctgacgcaggacgaggcgcgcggccacgtccgcgagtacgccgacaacgccgccctctgggaccacgacttcgccgcctcgctgctcaagctcagcaagctgcccatgccggtggggagcaagggggagatcaggaacaagtgcggcgccatcaaccacagcaagagctaattcggccacttatgcagggggttacgtacatgcatgcagacgatgtggtcgtagccatatgttttcttgttatatctcatcgttctaaaatacagaaaaccttgtactcgaaaaaaaaagactactccagtataatataaagtatttgtatttgtggttacccatatatttacctgttatgaattgttactacctttgtccctgattttgcatctgttagtgcatagactaaatcccatacatatttagtactcgtggattgtcatgtaactgggctgaatcggtatacatattgagcccatggctagctaggctcaatccgctgcgataagccaatcattcaagccgttacaaaaggagcagatccaacagatgggaggatcgaacaaaatagatgaaacctgagttcttccttccgatgctctctcttcttcaacctctgtatctctcttctcttcaatccctggctatctcttcttctccaatctactgctaattctcagtcttgattccatttctcccatttgtatccccaaatactcgtgtatcaagtgttggaggaagaattgtgtgcttgtgctggaattcactaaatcacatagagtgggttcgtaacaatatggtattaaagccaacaatccatgggttccaagccaggagatgagatggatgacatacgtggcagccgcgacttccatagactggatctaagaatttggggtggttgcacttgaggcgtctaagaacacacatgaacatctaagaacacaagaacacaacatgaatatctaagaacacacatgaacatcaagaacacaagatgaacacacataaacaaaccagcatctatagtatagttgtcggacttttttcaaaatcggcacttataaatacttaaaggtgccaatttttccctttagcgccccccgcgggcgctccggtgggtgggaaaagcataataggtgccggttttagttattccggcacctataatactgacttttatgtgtctttttgtagtactgatttgcagttgacatgattatcatcgaacacttatgggagaaaaaaataaatttgttctagccaaatcaatagagagtgcagatgagaacttttgaaaaatggggtccaaaaacatgttgaaacacatttgtttagatccatgcatgtacatggaaattttcggggttgctagtctattggtcgctcgctttgcacctgccaattgataggcccagtagttgacgtgatctgacacacggctgggatgaacgtaggttagctgcttcccaaccagtcaacaggacctcttaaacaaaagggaagtcaaataagaaaatgtttaattaatctagcctggttcggatgctagataacagtaatggagtgattaaatattgatgagaccactataatctcgattatatttgagctagcgaacatgcctgctatagttccctcaaaatcctaaagatatgtatggcgttagcgtcctttccagtggatacgcttaacacaagcttttgacgtgaaagttaattaatttactactgtacatggaaagaaattctacaaatacatcgctcttaggtaacagcatttgaattgaaataaagatacatgttgtcaaatcgaccaaataaactgacctccttcataggggcggaactagccaccgggcggctgcttgggctcgttagcgaaaactacacaaaattttaatattaatgagtaaatagatgatgaaatttctatagcaaatatcagttatattgaaatttgtctgggctcaaaaatctttctagctccgccatgcatccttccatcaaatactgtgcttcggttgacacatgcatgatgcatctggacggccaattaatttactctatatagctccagccgaatttaaattaagttcaccgtcacaacgccaggtatggatcgatgtcaacgcctacacgttttatcagttactagctgttttgctccccatgttgttagacaacaagaactggcaaataactattctgatgattgctctccaaatattcctcaaatctcttatttaatcaatctcctcattcaaaaggagtagctcaattatcaatgatcaatttgcacatccatttgtacctataaatacatcgaatgtttgcctgtcacatcatcaaacatcaaccaatcctttgaggtagcgatcactacacatatattcattcggtttcaggcgtttctttgctgtctcctagtgaacaaccttgtcagaattcagaatgttcagcagggggatgaagctaattctcatggtagccttccaggctatgagcctcatctccatatcaactgcaagtctgcagtacaatttctacggctcgtcgtgcccaaatgccgagcagacgatcagcaatgtcgtctacggcttgatcgatgctgacccttccatggccccggcgctgctgcgtttgcatttccatgattgctttgtcatggtaatgtaattgctaaccacaagttaatttagtttttcaactatgaattgatagcagttttaatttctcacaagatatattactgcaagcaaagcttagatattgatggttaattacttcattttgtccccaaaaaaaatgtaaacgaagtttttttttttttgttttttgatcatgcagggttgtgatgcgtccatccttcttgatcccacgaaggcaaacggctcgccggagaagacagcgatcccgctccgcgggtacgacgccgtgaacaagatcaaggcggccgtcgaggccgtctgccccggcaaggtctcctgcgccgacatcctcgccttcgccgcccgcgactcggtggccaagtccggcggcttcgtctacccggtccccgccggcagccgcgacggcaacgtgtcgtccgccttctccgtcttctccagcatcccgtcgccgttnnnnnnnnnnnnnnnnnnnnnnnnnnncttcgccgccaaggggctcaccgtcgacgacctggtggcgctctcgggtgcgcactccatcggcaccgcgcactgctccgggttcaagaaccggctgtacccgacggtggacgcgtccctggacgcgagctacgcggcggcgctgagggcggcgtgccctgacggcagcgccgccgacgacggcgtggtgaacaacagccccgtgtcgccggcgacgctgggcaaccagtacttcaagaacgcgctcgccgggcgggtgctgttcacgtcggacgcggcgctgctgaccggccagaacgacacggcggagaaggtcagggagaacgccggcgacctgaccgcgtggatggcgcggtttgcggcgtcgatggtgaagatgggcggcatcgaggtgctcaccggggcgcggggggaggtcaggaggttctgcaacgtcaccaacagctaaaaagctatactggctggctcgagtgaagaacgcacttgtgccattggtgtgcgtgccgtttttgcttagtggcaagtttgcaccttgtgctaattaaacgtttttgttctccaatctacaccatgcacacacaccattcatgttgcaattttttattgccaccttgttctataagaggaggaaaattaaccaccttaatttgttattcactctggttatagtattttggttgtatggctcatgtaaaagatttggggcttttttttttagaattacacagtgcaatgtagatactcacaacgcacacgcactcacatctatgaatacacgcacgcaaaccctacccctataagcatcttcgaaaactgggccggcaaatccttgagattgacgaagtcaccataggcacctcgttgtcgacggatatgtcgcctaccactaaaagcacaacgccgttatatcttagaaaatccgctcccatggggagtcgaacccaagacctcaggtgctactgaggctcttgtaaccactaagcgaaaacgccgttattattattatttttggagaatttgtgatttggatctgagatttgtgtgtgatgtgaatatgtgatgcatttgtgatgaattttgtagaagttgtgatgtaattttttttaagattttatgatgtatttggagatgatcgatttgaggatttggaggcaattcggggatgattgatttgggatttttgggatgggatggagtgaaatcaatatattaaaaacaacaatgaagaaaagaaaagaataaaggagcaactgaatctaacctctttagtcccggttggtaacaccaatcgggactaaagatagccgggactaaagatagcgatctttagtcccggattcgtagtcccggttaaaaaatcaggtctacaaaaggttacgaatcaggactaaaaagcacttctctactagtgtgcaaatgtgtgagcccccattgaccaagtgtaggagcaaaccctctaaaagtgtccagcctctctggccttgatcagtcaattgatcgacatcggtttgtcgtttcgcaaatggtagaaatgatgatgggtttttgatactgaattgagtctctgagcgaattctgatgagtaggaaaagcatcttcataatgaaggtcctaaatctcgtatgtgaattcctgttgataaagaaaatgatggttcacttggaactatacttgtgcaaaagaatcctattctttttttttggtgcccttatggtgtatatgttgtgatagtaaacaaagaaaggaggtgttttgttttcggaaatggtggaaaaggaacttttgctcatctcaagttccctttctagctggccattttgcggagggggaaaaaccaactttccctgtaaaacagtgtgctttgatccttctatgttattcgttttgttcgtgaaattctttcgaggttgctgacatttttgtgttttccacatggaacaaagatctgccaccaagaatacagcaggccaacatgcatctttctgggtgttcaagcaggattgtccttgttgacatcagaattgacgatggtattttcagcctcttctcttttcgatatttaatatgagatctgagcctgagaaatttcagccataaatgctgcatgttttgcacatgctttgttctgattgtaatatctggcaatttcagatttttgggatagcacttggattcaatcttctatttgaatatgatgatctcatcactgggatatgttttgcaaccgttgttcctaatctgctaccatatgctatatcacacctggtaaagaagaagattatctcatatagaaaacttcaaacctatattgtaatctgatttggagttaatatttgtcaattactttcatatacctattctagggaaagaagatggtggggacattaaatgcttgcattgcaggctttgcgcttctttgctacgttcttggtttattggtcagccaaccacaaattcctctgacaacgaatgtaattttccccaagctcagtggtgaaagtgcttattctctgatggctcttcttggtgcaaacgtaatggcacacaacttttacatccattcatcagttgttcaggtaaattatgatgcttctttgtgcccattacatagttagaattatatttgatttgatgcatttggggtgaggggggtttgggcatttggtggacaatggtcaatggcatgccacaattatttacaccacacaatgacacatgttgctagctttgctagtgtttcgaacagttcagaaattccaaactgatagcaagggtcactatattagactagttataccagtctaatatcggatgtagtggagaatgtttttgttctaatagatccagtggtttgtgggtacgctgtatccaactgaaaaagatatggtttgtcctatttcaattgtttgcgcagagttgaagtgatgttcattgacttaatttcaaaacaccaagatacatcttctagcgaattgcagcattatgttaggcatgctcatcgttagttagtgaaagaatttgttctcacttaatccagtttggagcttaactaacaattatggccaatgaaactatagtatttaataagctattgtgccacatgcggaatactatttctgattgacaagcacaaatctagaatgttccttgagtaaatgtttgttccctaaaactgtggcctatttctatttgttttcttttttactttcgcgtgtacatattttggttcactaatggtaaatgtctagtgttcatgaggtctttgccttaggtttgctagtatatgatatatatattacctaaagtgtataaaaatggatagcattagtgagtttgacagcaaaaccagctacatttcattgccctttgtgtcttatgcttttggttgtctttttttttcagcttgtatccatgtttgctaatcaaataatctcttttcagggtcagaaaagatctgcctttgccgttggtgccttatttcatgatcacttgttttcagtattatttatttttactggaatttttctggtgaatcatgttctaatgaactctgcagcagctgattccactaacacccttcttctcaccttccaagatgttgtagaactaatgaaccaggttagtactatagttcctactacttcaccctgtgatatgctaagctggtgctgaagaaatcttgtttcagtagcaatcctaaagtgatatacactacctaacatttatcattttgcagatatttgtaaaccctatggctccaactatatttctagtggttcttctcttctctagccacatcatctcgttgacatctgctattggtagccaagtgatttcgcagcatttgtttggcattaatcttcctctctctggacatcatctgatactgaaggcttttgccatagttcctgctctgtactgtgctaaggttgcaggtgctgaaggaatataccaattactgataatctgccagattatccaggccatgctccttccatcatcagtcgtgccactcttccgtgttgcctcatcaagattgataatgggtgcccacagagtgtctttgcatctggagatattaacatttcttgcatttctcctcatgctgttttcgaatatcatctttatggcagaaatgctgtttggtgacagtggttggctgaacactctgaaagggaatactggaagccctgtggtgtttccatctacggttctcatcacggtggcttgtgtctctgttgcattttcactctacatggctgttacaccactgaaatcaggaagccatgaagctgaattgcagcaggaatggtctgtgccttctcagaaagagctcttgaatactactcaagacagagaagagacttgtgcgggcaatgttacctatgaggaagatcagagatctgatgttgtcccttctcctaggattcagcctgtggattgtctgaaatcagctctggactacattgatagttcggacacagctatagaatctgatcatgattctcaacattccactgctcatacatctaccgctcctgaatcctgtcactctccatcattcattcctgaagagtcaaaatcagttgttgctgttgactggccagagcctctggagccaatttctaatgctattgtggctgaggaaagtacagtagagagtgtggactccaagagcacaggcgaaagggatattgaagtagaaccagctcttttgatggacaatgataaggaggctccaaatattctagagtctgacaacaagtcacttggaggcaataatccttcctgtgcatcggatgatggcccaccatctcttaccttcagcagggggaaaggctcagatgcaggcaatggcagcgggagtctctcgaggttatctggtttgggccgtgcagcaaggaggcaactagcagccatacttgatgagttctgggggcatctctttgattaccatgggaaactcactcaagaagctagctctaaaaggtttgacatcttgcttgggctagacgtaagaacacctagctcaactgtaagagcagacagtcaagctaatgaaatcccgaagagtcccatggtacgagacaatttacaagggtctgccttcttgggaagttcaagggatctgatgtctactaagaatgagatgtcgaatttggatctgacatatgggcttcagatgggcaataacattgggtcatcagcctggtctcagggcatgcagttaccaagtacccaactgcagagttcaagcaacagcttactcgatcaaggtgcaagattaaattcaaattttagcacgccatcatacgcagacaacaaccaattctaccaacctgcaacgattcatgggtatcagctcgcatcatacctaaaacagatgaatgctaatcgaaatccttactctagcatgccattggacccacagcgacttccaaaatcttctgcatcggctgtgccaacctatgtcgattctgtcatgcatgctcgtaaccagaacttgcttgcttcattgggagctactccttcacagatcgcagcaacatcccggataggtactatgatggcagaaagatcctattatgtcccttccactcttgacgggaatgaaaatgctggttcatcagcttactcaaagaagtaccacagctcaccagacatatctgcactgattgctgcaagcaggagtgctctgttgaatgaatcaaagttgggtggtggtaccattggatcccagtcgtaccttagcaggcttgcatcggaaagatctcagtatacaaactcggtggccaggcctgcagctcccttggcgtttgatgagctctctccacctaagctcccaggggatatcttctcaatgcaacaaagcccaaacccaagtgcaagatccctttgggctaagcaaccttttgagcagctgtttggtgtgtcgagtgcggagctcactaaaagcgagttcaaccctgcaggcagatcgggtggcatgaccaaggatgatttctcttacaaggagtctgaggcgaagcttcttcagtctcttagattctgcatctcgaagctcctgaagctagaaggatcagggtggctgttcaagcaaaatggtggcagcgacgaagatctgattgatcaagttgctgcggtagagaagctattgcaacaaggaaccagtgacaaccaactgctgcttggtgatactcagcaaccaccatgtgataaggcagacatccagtacatgcgcgtactgcctaactgcggagacgactgcatctggcgcgcctccctcgttgtcagcttcggtgtctggtgcatccgccgggtgctagacctgtctctggtggaaagcaggccagaactttggggcaagtatacctatgttctcaaccgtcttcaggtgagctatttcagtcctgaactagtctgaatttgagtgttgtttttcagtgcccaagacttgactgcaaacctgaaactgctcattttcaacgtacaagactaactctgtcaatcatttttttcgctcaaatgtaatgcagggcatcctggatcctgcattctccaagcctcggagtgctctcagcgcgtgtgcgtgccttcacagagatatccgggtgctcaacagcctgcgccacagtagcctggtagcaacaaactccattccaaggcaaatccgaggttccttcaccaccgcatctgtggtcctggagatgatcaaggatgtggagaccgcagtctcagggcgcaagggcaggagtggcaccgcagctggggatgtcgccttccccaaggggaaggagaacctggcctccgtgctgaagcgatacaagcggaggctctcgagcaagggacaacaataataaggcatctgggcagcgtgatcctgtcgcgttttagggggactttgaccattgttcttcaaggatggcagccagccatggtggcttgccctccctgagccctggattttttcgttgcacaacgtttgcagggacctgaggaattggccaacacttctggtcccttccatcatatttcgtttttttttgtttctttcttgtttttttttttttttttgcatgtgatgtgttgtataatggtaactgttcatgtgccagaagaacaaccaccaaaatgtacaacagatgtagtcagctgatgcaccattgtaaagtttagtctctgcattttaaccttttttttgggggtcattgacaaactgaatgaatgccctgtgtaatctctcttcagagaggatgccaagactgagaaaaagcttttgccagatttccagattccttgtgttcatctaatatctgtcatgtctctcacattttctccagcttatgatctttttgtctcgttggcatttgatagcgtgtgctggagatgtctaccgtatatgtggattactgtattaagcttctgggaccggtgtatatatataatttgtatggatagagataaagaaatactaactcgatatggattagttatatcctaatgtttctctaaacaccaggcgtagtggcactgtactgcaacctcacccaagaacatgtttttggggttcagacttgagagtatccattgctgaatttgcctcaccgcaagtttagtcttgcatttcacaaaattgcaaggatagctaacaattttatcacaaaaccataaactttgtggccgtgcaattggatatgctctctttgctcagaagcttttgaggatactgatcacctgttcagaaactgtgcctttggacttgatttgtaccgggaaacttgacaacccggccgacacagtattctcgattagatgttgggaaaacaagatagccaaaacaaatacggcacaaaaggcaaaggagacctctgggaatactaatcaggagagagaaacttaggtggtgtttgaatcttcctttaagatgaagattaagtgtttcacgtaaaacgaggtgataatattatgtgattaattaagttctaatcattacaaacttgaaaaatatattaatttgatattttagaacaacttttatatagaaagtgttcacatgaaactaccgtttagcagtttagaaaagcgtgccacgagtatccaaaagcttatcaattttgttggagaaaagaatagggttagtcttccaaggttcttttattcggcagagctcccgctgtcggttctttaaagaaaaactcgtagattaggccacccatcaaatataaatgtaatactccattacacaaatttaattttacataagggttcaaaattacattatagtttatttacactacgaattacatctgggtaaatttttagaaatttggaagcaaaaccgtgaacacgtcatcaaaaactggatgtgggctccacgagttcagaggatgttccgaacccgttttgatcgcccacggcccgccgccccgccgtggagccgatccccgccaccgccggcgagcagctgttccggacggcgtcctgctgctccctgcgccgcccccatcccctcggcctccgccgagctcgttcctgcgcggtgagcatccttgccgacgcaccagaaccctcttttttttctctctctctctcgttgtacccacacacctctactcgaatttgctctatcttctcttgtagatctgaaagctaggttttcttttttacttgtcttaacctttagttacataacaggttttttcccacatcaggtccacatcgatctataatagccaagagcccaagacctgcagggcttcccgggggtggtgcatcttctcaggcggaggggcctccttggattccttgaagtttatggcgccggcgaccaaactcatcaccgtgtgtgcaccggcaaatatgacgaacaggtccccctgtacatgtgcgcggtcaccttgagttggtcacccctgtcaaaacatagtaactttgtcaaaacctaacctaaacaaacatgtttttttcacaaaattcttcattcttacctcatgtctgattttaacaaatctagcctgtggtttgccttcagatgagcaatacgccatccatgcatacttcctgccgccctctcctgtttcctaatgcgctgctcaaggcgcctcatcataaccttttgcaccagaaaagcatcaaaatgttgcttgtcagcacaaaacaataaatccttctcaagtctcaacgagggggtaaaacttccagcatcacaggtagcttctccaggtcactcctctctcatccagttaggaatcgtggatgcaaatgcagaatcgatttcatccgtccccgaaaagaaatacaagggattttggcaatgcgaatgcagagccaaactccctcatatttggatttggggacagaggtagcagataggcaaggcaattagagcagtaattttaccctggtagctcttgtggagaaatagcggggctgggcgagtgcggaggaagcccatggtggggtggaggtggcggcggactgaacaagaaacaacaagttaggcgcatttaacggaggaatagtgcagtagcaataactaggaagcttgtgcaacaaaataagcaagcacacgcgacaacaaaatgatccaatccaattacttagaatcaactcaactcaatagtgcagtagtagcaaatcagaaaacaacttcaactcggactggcagctgctgacgcaggacgaggcgcgcggccacgtccgcgagtacgccgacaacgccgccctctgggaccacgacttcgccgcctcgctgctcaagctcagcaagctgcccatgccggtggggagcaagggggagatcaggaacaagtgcggcgccatcaaccacagcaagagctaattcggccacttatgcagggggttacgtacatgcatgcagacgatgtggtcgtagccatatgttttcttgttatatctcatcgttctaaaatacagaaaaccttgtactcgaaaaaaacatcatatagtactatcaaatcagtctagatttatactactagatagctagtgtctaatcgagtactaggagtatattttaaaacaagagtagtttgttattacttggtactagcacgtcagtgaatgtacgtgcacaagaaatcctcgtcgataatgaaaactagcatggtattggagaatccatctcttaaacccatcaagtcgaaatcctgaagcaccaaaatccccctacttgatacgcaactatcgacgtttgatgtcgcaattctggtatttgcatagtatggggatcgtcggtgctaggatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatttaactgttgtcgacatgtcggtctgaaggtctgactcgtagtcgacaacagggtagccttcctcctcgaatccgtgtccggcgagatcagagatagcgctttcgtctctcctgacggtatccggagacaccgtaggggaatagccatgcctatccctgaagtcgatatccggcggcttgtcttggcatatgttggcttgtatgttgtggcttctgttgttccgtatattgtggtggttgttgattgaggtggtcgtctgtgtcgatcgtggtgactgtgttgatcctgtcatggtgggtgtcccactgtcctcctaggggggcttgtatttatacctataggtgtcccattgtccaagtagaactagggaaaccaatatggatacaatccgagtagtccttgtcgtttccatgtaaaactctggttgtctttccttatccggaactccctccataactgaagttagtttctgtataagacatggtatgtggtgggtcctgccgagatttagtcaactactattaggtatgtggtatccataaccctgacagtagcccccgacttcaatgcaaatgaacgaattcatattctcaaccgcagaccctggagtaactgttgtcgtgctcacgttaccgttctcggtgagtttagagataacgttagactttctttatcagcctcgtgcgggcaccaaaagggtttgtctaagtcaatctctgatgtcaaccaaggaagtacagagcgtacgactaagtctcccgtcttgctgtaatcgagaatttggattgaagtcaagaaattctatctcggctggtacaccatctcttcattccgtattccttgtcgagatccagcaaccgttctcgagcgatcgagaaggcgtagagtctgcgacggagccttgtcaacatttgtcgtactcgccatagtcgatcttggtgtagaaccatagagacatagagtcttcgtcaatgtcgaatagaattttcctgaaatcaatactcagaaaagaatattagatagaaatagcccccgagcgaatgcccaaagggtgataatgttataatatgtatggtaaattgaaaatgaattaaatttaccgaccaatgttttgtgtatgagcgtcttctctcttaccgacttcgatcagtcagtttgtagagtcatacactctccctagcccccagccttgtcatcggagaatcgttctcggaggataaggctcttggacccttgacctgccttggttgaacaaacactgatcctagcccccagccgtgaagttggaaagctcagtttccgattacacggcttggttaatacgcacggcgagaactcttacacgaccagatcttacatggtcttttgtctctacaggatccgacaaggccttatcggctctgggcgtccccagccgaagttcccttaggttcctcggaggccttgtcaagacggcgtaatgggacagtaggataggtttcaacgctaggtgtcgtcgtggtaagggatctctgggtaaaacacttggcgatattgtataccagctatcaactttgttgaaatagaggtagtaggagagtcgttacaccgctggtcgagaaccaggcagtagtcataactcgaccacttaaagtggaaatagtgggagaaacgctacatcgctggtcgagaaccaggcagtagtcgtatctcgaccacttaaagtggaaatagtgggagaaacgctacatcgctggtcgaggaccaggcagtagttgtaactcgaccaattaaagtggaagtagtgggagagacgctacagcgctggtcgaggaccaggcagtagtcgtaactcgaccacttaaagtggaaatagtgggagaaacgctacatcgctggtcgaggaccaggcagtagtcgtaactcgaccacttaaagtggaagtagtgggagaaacgctacatcgctggtcgaggaccaggcagtagtcgtcactcaaccacttaaagtggaagtggtgggagaaacgctacatcgctggtcgaggaccaggcagtagtcgtcactcgaccacttaaagtggaagtggtgggagaaacgctacatcgctggtcgaggaccaggcagtagtcgtaactcgaccactagaagcaaatgtacgagagattactacgatcaactggttgagaaccggtgagtaggtgtccctcgatcatttggagtcgtggtacgaggaccactacgctgccggtcgaagaccagtcgtagctgttcctcaaccatctgaagtcatggtgcgaggaccgctacgatgccgtagtcatacctcgaccatctgaagttaaggtgcgaaagattgctacgtactggtgcgagaaccagcgtgcgagcagaattatctctcgaacaccaatggaagttgcggtgtgagagattgctacgtattggtgcgagaaccagtgagcgagcagaattacctctcgaacaccaatggaagttgcggtgtgagagattgctacgtactggtgcgataaccagtgagcgagcaaaattatctctcgaacaccaatggaagctgcggtgtgagagattgctacgtactggtgcgagaaccagtgagcgagcagaattatctctcgaacaccagtggaagtgctagagttggtttattgcaagtgtatctcatgtggccagcatgactcacgtacccaacttatagcatatccggatgtccgttcgcaatcatgtcgggtgatcaagccgacgacgttcgcaaggaattatccgttaacaaccttttctcaagtagtccagccatggccggtgctatgagataggtcgtcggtctttgttggtaggttgggtgcgataactccgcatttgtcgagaatgttctcgataatggagtatattcgaccataacctactcgagtgctcaattgttcctgaaaaatattttctagaaggcaagatatatagcagataatatcgagtatgtactcaaagaactgcatggatcttctagtattatcaggatacaataagcagatgtaaatatcagggcattatgtaaaccgtaaacaagcatgatttatacataagagaacggagtgagcccccagcgttagaccgtagttggtctatcgtcggaagtactcgcacaacggatgttgtataagaaacatgctctaggtaaacataataaattgctgatatgataatgttgtatcatctgaataggtacgataaattgcatataaaatattacgtacctttgtagatacatgccggatgtatctacgaaattagtagatcaatttgaaaaaccaatctaccaattaccttattgcgtactcgttcgacatcatatgatctgacatcttttggtacggcgcggagcttgaggcttgggtgatctcgatagaccaagttgtcgatgacgatgatggttctgatcttgtcggaagacatgttccggtcgggttagatctccacagccgaagtcgtcgagtagtttgctattggagaatccatctcttaaacccatctcgtcgaaatcctgaagcaccaaaatccctctacctggcgcgccactgtcgacgtttgatgtcgcaattctggtatttgcatagtatggggatcatcggtgctagaatatacgcgagactgaggtgaaagagacggagacaaggatttttatacaggttcgggcccctgagttgtcaggtaataaccctacatcctgttggccggagccggtattgcttttattcaccataatcacaccagtacaatatgtggggtagcctatctaactgttgtcgacatgtcggtctgaaggtctgactcgtagtcgacaacagggtagccttcctcctcgaatctgtgtccggcgagatcagagatagcgctttcgtctctcctgacggtatccggagacaccgtaggggaatagccatgctatccctgaagtcgatatccggcggcttgtcttagcatgtgttggcttgtatgttgtggcttctgttgttccgtatattgtggtggttgttgattgaggtggtcgtctgtgtcgatcgtggtgactgtgttgatcctgtcatggtgggtgtccccgtgtcctcctaggggggcttgtatttatacccataggtgtcccattgtccaagtagaagtagggaaaccaatatggatacaatccgagtagtccttgtcgtttccatgtaaaacttttgttgtctttccttatccggaactctctccataactgaagtcagttttcgtataagacatggtatgtggtgggtcctgccgagatttagtcaactactattaggtatgtggtatccataaccctgacaatagtatgttttctcattatattattcaaatatattaaaatgacaacataattttaaattttgcaataactttacaaaactactaatatgtaatattcatattgtattttatatacgtgttagttattaattatttttaatatcaaattttagttatttgtaaattatatatattgactcattttttaatattttttttaatattgactctatgctcttcttccaatattatttatttttatttcagaatttttattatttctaattgtatttctatgtggactctaaactaatttttaattttgaatttcagttacttctaaattgtattcctatattgactttaaactcttcttcaaatgtttttcttaattttgaattttagttatttgtaaaatgtatttttatacggactctaaactctacttttaattttattatgtttattccaaattttagttagttttaaattcctatatggactctatactctacttctaatattccttattttttaattccaaatttctatttttttcttaattgtatttatatatagactctatactctacttctaatattccttatttttaattccaaatttctattatttactaattgtatttctatatagactatactctacttctaatatttcttatttttaattctgaatttcagttatttcctaattgtatttctatatggactctatactctacttctaatattccttatttttaattctgaattgctgctattccctaattgtatttctatatgtactctatactctagttctaatattcttatttttaattccgaatttcagttattttctaattgtatttctatatggactctagtctcctcttctaatattccttattttttaattccgaatttcaactatttttaaattgtatttctatatggactctgccttttctttttctccgattaatgtgagaatttctaggccatgaaagcgaacgtggagacttccttttctattcctttaataatataatagaagatataagtaacaaaaaaaatacaatttgacatgaattatatcaaaacaattagtatttgtgatcaaacgggcatgcatgtggggtcagcccaccctagcccatggcttgatgggtacatcctgattattatgcactgctcgacaaggatatgccgtggcggctcacgtggtaaggccagaaccaagatatggccgaagaggagccaggacgtgcacgtgtgacccatgaaatatttttttcatgaaattgcacgttagtatattagaaaaaaaatagagttttagttatacagcgtaatcgaccaaactggtcgctgtcggttacaaggaaaaagattgcggaagggaaaagagtcaaaactagaagttgttgctcgtatctagcggcactactacgaaaaccatctttcgttgcggccattttgggttttcgctggtggtttttggtaccgtcacaaagcaaaggccagtgaagatcaagatcttcgctagcggttatcggccgccagtgataattgatttttgctggcggttgtgttatactggccgccagcgataaacgattttcgctggcggttgagttataccaaccgcctgtgaaaatagtggcccaggttaaaaaaaaatgacaaagcaacactgctccgttcgcctccgtcaacaccggttcaaattattcccaaatccactcctcgattcacaaattcacataaatttacacgaacaatttataataaaaaatttccattcacagtcaaaattttccattcacaatccacagaaatccacaaaaatgcacacaaatccacacaaatctacagaaatctgagcaccaccgcccgtgacctggcggcgtcggcttcacgctccccacggcgcagcgtcgatcgtgacgaggtcaaggccgacggtcgtgctccaccgcccgaggccccgcggccgtgcgccccgcgccgccgccggggcggatctgtccttcccggcggcagcctcctcccctcggacagatctaggagagggtagaggaggggatgggagggcccggcaccaccgcgtcataggtggtcatcatcgtcacagcttccgtcgtagtcgctgttgtccccgtgcacatccgcaccgcgcccctcccgcccgtcgtcggcgccgcgcccctcccagatctcggtcgtcgacaagaggtggaagctggaggagcagggaaggaggaggggagagaggtgggggaggaggaggagagggaggtggatgggtgggtggagaggaggagatagaggagagagaggcagtgggtgggtgaaaggaaaatatctcagcacgcgcgtgattttaaatgatgccaaatttttttagcgggctctgttttttcgctagcggaagtgtttagtaaccactagcgaaaaccgacgcgaaaacgtcggttttcgctggcggacatttaagagatccaccacgaaaaatagagtatgttttatggcggacgtcttaacgtggccaccagagaaaatcggttttcgctggcagtcctataccccccacccctcatgtttttgctggcgattttagcatataaccgccagtgaaaattatagtgtgacgccatgaaaaattgtttttctagtagtgcgggagggggtggcggaggagcctcctaatctcccaaaaggctcccaaacgagacaggaccagcgagagaccagagacgaacctcctagtgaatgtattggaaaaccatcgagaccggcgaaagagaaagaatcgaaaaccctagcgttccgctctttccaaagctgtaggaaaccaagaggaccagagagtcgaaggccttacgaagatgctaaggcaggcaagccctatctaccggccaccagacctgaagagaatcgctacggaggggccgagcaagcctaggcaagccaaagggagaccggatgtagtgccaaacttaacgagcgaacacacagtcgagcatgatgtggctcgctatttcatgcttctgagcgcaaaatgggcaggtcgagcgtctgtcaatgccgtgcttatgcagatgatctgccgcctagcaacgctgttggaacacgtgacccatgacatttgaaatcgaagttgggaaaaccaaaaataggaagaataagaagaataggaacaggaaaaaaaagaaagaaaataaaagatggcaaggaaaaataaggaagaaataggaagaacatgagaaaaattaggataatcattgtgaaaaaaatagatggccaacggattaggatccgctgacatgaagtcagagggacgtggtgactgatatgtgggcccaaccgctcgcgagcccacctgtcagtgaccacgtcaagggagatttcacgtcagaggatcttcttctgtggccgaccgggcggagcttgttcttggtccttgctgtgccaggtctggccatgcacgacatggccaaatgggacgtgtggaagaaatatgtgcatgcacatgatgaaacatgaatgtgtggaataaatactatgtcgttttgactgtttgttgacttttggacgagcttttcggcacctatatgaagttatgaacaatgaaacatgcagatctatagagatactagtgcatagcgtttattggatggtaattcgttgtcctaaaaataaaatggaactataccagtccaggcgaccaaacaacagtttttttacaagtgtttctgggcagtcgttcggcagtgtgacaacaatgacgaagagttgacagtcggcaatgtggcaattaacgagcaacaatctgaggcactccctccatcctaaagaaaatcaaatcatactaaaggggccgaatggcctgggccgcctatttgccaatcaaagtacacccaaggtccctcaacttgtcatcgagttacaaaatcatcccccaatcgcaaaaccaaatatatgacatccctcaacttataaaaaccattcactttaggtcattcggtggttttgaccctggttttatcctacatgagcagagtcagtgtgggacccacatgagcccacatgtcaggatgccacgtccgcaccctctctcttccccctcctctcccttcctcctctctctctctctcttactcttctcttctcttctctgggcaaaccggccagtggctgaggaggaggccgccagggcgaggcgcaagaggaggaggcgacggcggctgcgacgcgggagaaggtgagggtggcggacggtcgcgaatggcattgacggcgctgcgtcgcctccgccccgtgcgggcaggcgccgcggcattgggcacagaggcggagacagggccgggtgccgtggaggtggactcggcggacttggagccccggcctgctcttgcgccgcatcctccctctctccgtgtgctggttgtccctccctacctcctccctattcgcgtgcgctcgccgccggccggcgggcatgggagcaagcgagccgtccgtggcgtcggcagcaatggtggtgcgatgcatgaggatggggaggaccagcgtcatcgtcacgtcacgtcctcgtcggcgcgaagatgaaggagacggggaagaggaagaggtggtgcgcgtcctcctccttctcgtcgaactcgtcgcaatcgtcgttgtcattcgccgataccccgctccgcgctggcggcttcgcacgttgccactctgcccaccgtcgccccacttcgcctgcttgctctacccgccggcttcatgcggcgccgctccgcctattctgctcccctctggtcggctgctcccatgggagagagcggacagatacagagaagagaggggatgagagaggagaggatagaggaagagaggttgaaaggggaggggaagaagaggctgacgtgtggcggtgtgggacccacgtgggtagaagaaaatcgattgggattgagacagagagggggggggacctggagagacgcgcgtggtaaaggaataggttggttgtatgtacagaaagtggttggcatgctagctgtacggtggaagcaaaccattatggcttgccattgacttctttttaatttccttgagaaatagacaaaaatttaaccagatcctcctcagcaccgtagagggaaggtctcctcgccaccttgctaatgggctcgtggatctgggccgacgatggccggatccgtcatcctgcctcgtcacatggtgtcatcagggatgatggagacggcggcggtggagcgaagcagtcgtcaatgctagctacgaagaggtccatcatagataccggctacgaggtggagataaaatcagaaaaaaaaaagatgaacggattgtggatagcgcattacctggtcgtcgtagggagagaaccaccggtagcaactgcggcggtgctggcgatcaccgattagccagtcgcgacacaaggaagaggggcttgctgtggcaagagaaaagccgatccagatatttaggagaagacgataactatgcgtgatcactgttatgtggcggttttgcaatgactacttcctgaagattcgcttctctacgttctgtaacaatttaatgcgcatagagtaaaaaaataactcaagatgctgacatcgttagagtacaacaagaaactatctcactgttagtaaaaaaaattatttggactataggagtgggggcagggggcgcaggggtgggatcgagattggtcgttagtgagtaaaattttaactgcatgctataaacttggtgggggacagggttgggagcggcagtggtggggggttgagcagtgggtggggctgggggctgtatcacgtgccatttaatacgtagcaccttaaggtgccacatagtagttctatacacacacgcacacatacacacaaatttttacgtggaaaatccttacgggaaaaaaccacggacaccgactagcaatgatcgatatagagaagttgaatacaaacgcacgacacactgggttgtcgcacccttctcgtgtagcttacaagagacatgtaaaagagaaatctataagtcctagtaggaaaagacttacaatcataataagaaactaatcaagtgttttattataaaactaatccgaacatattgcatgctatttttttttttgaaaggaaagcggcaagagtattgccgaatatattagaaggagagaaaagtatggtttacacgattaatgcggaaaaacaacttagaatcatctcagaaccatagatcctggtttgagaagggaagagatacactcatgacggttggaattcaaaactgctttcttgaatatcttggatgatctggtgtgaagtcctttgcatgtccggttcttctcctctgaagatctttgcgttcctttgtagccaaatgtaccaccaagttttgacaatctgaacatattgcatgctgaaatttggatcacatatttaacaatctccatcttaagacgaattttccttgtagcataaaaatccgaaacgctcctgtccagacgcctgattgtagggaaaacaatcggattctcatgcgtctctcctcaaaccgtgtgatgttataatggatttttttactgttccaatgggtatttaatgatgtttcactaggtcattttgaaatgttacacgggatgtttttttgatgtttaaggaggtattttgtgatgtcctcggctgatgtttcactgtatcattttttaatgttgcacgtggtgttctttgaatgtttcaggaggtattttgtgatgtttcagctaatgtttcactaggtcattttgaagtgttgcacacatggtattattttgatgtttttctaggtattttgtgatgtttcactatgtcatttggaatgttgcatgtcgtgttctttggatgtttcagaaggcattttgtgatgttttagaacgtatttcactagctcattcggaatgttgcacgtgatgttatttgaatgtgttagaaggttttttgtgatgtttcacaagatacttcactagcttattcggaatgttgtacatggtgttctttggatgtttcagcatgtattttgtgatgtttcactgggtattttactagctcatttgaaattttacacgtggtattttttggacatttcagcagatgtttcactagatcatttaggatcttgcacgtattgttctttcaatatttcaatgtatattttgtattgttttagaggtcacaaatcaatgtcccacttataataaaaatgtttcaattagtaatataattacatatgttttatttctccaaaatataatcatgtgagatctctttgtaaagatttaattgcaacaaattcaatggtgcaattgaatcacaaattggataagtatttcataagaaaaaatggtttataatttgctaattaagagtatgggagaagagacaaggggatgggagaagtttgcatgtacctcacatgtggaagagaagaaatgactgcgtgcatgcatgtggaggtttcccagaagaaaagattgcatgcatgcttagggggcccaatttttttctccaaaaatcgggcacccgttccgtagtgtcctccataaaaatcttcaatctccaaacaacatcatgtagtaccctcgatagaaaagagatgaaccatacttcaaacttaccattggtgtgaacttagcatagacacgaaacatgatgcacaaacttcaaactcgctattggaataaaatcctgaatatgctgccataaatttatgtaaccctagtagaaatgcaaaactctagtgcacaagacaaagtacttggatctcccaataacctactggtatgttgggtatgatggtagcaaaatttgtcagaaaattggatcaccttgtgatctagacaggagtgaggctccctctcgtcgactcaaatattcttcttcttttttctgtgcttttcctcttaggtaaataccccacttcaaatatttacttatcataatgagaatatgtactcaatctagacgtggtagattatcttcaaactcgtcataagaattaatcctaaatctgctcgcagtactacatgaatgctcattggtgccggttcttgaaccaacacaccttcgttttttatttttcaggtgctaaaaagtcaaaaaaaatatttggtatttttattaggcacctatacaatcacactctcgttcccaaaagtcacataatttttgaatccatattcatacaaatgtgtcaagaaaaattcaaattcaagacatctcacttcacacaaagtcaccttgccatatcacctacaaacacttcttgtcttggaaacaaatgctattgttttgagaccactatcatttgaacttataatccatatttaacaccatagataagataaaatgaaaagtg

SEQ ID NO: 1451 - DNA, 227 bp, Oryza sativa
ccggagaagacagcgatcccgctccgcgggtacgacgccgtgaacaagatcaaggcggccgtcgaggccgtctgccccggcaaggtctcctgcgccgacatcctcgccttcgccgcccgcgactcggtggccaagtccggcggcttcgtctacccggtccccgccggcagccgcgacggcaacgtgtcgtccgccttctccgtcttctccagcatcccgtcgccgtt

SEQ ID NO: 1452 - DNA, 3117 bp, Oryza sativa
  unsure (1)..(3117): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacgaatcatcttgtctttcaactattgaaaattttacatgcattttgaactaacaaaattgttttgcctttaattagtagtaaaatgagcgtataggcattacacatgtgggtagcggatttggttagactttcccatgctttgtgaaattcctggctccttcactggtataatgcattactagataagggaaggctcctatatgctaagttctaattgatgttattgggtgttcctctcaacacctgggaacttagtggtcgtatcaacagatattctcgataacatctggtgcataacgtgtgctacaaatgaagaagaggcagaggtttttaaccctctcatgagtagcacgcccaaccaggttgatatggtaggacagagaggtagagctgaagtgactttcttggaagttgaattgagttgcaggtttgcttgaagtttcctcaaggctgtagtgctccaaagtgagtacaaaaattactgtgtgatggataccatgatgattgatgagcttatgataaaaaaaatatcgaaattttacagtgcatggtttattggttttgggtgcagaaatttggctgctattttattcgaatttctattgagcttgattgttttgactgaattaattggggtaccaactcaagtgataaaatcatcaatcttttattgcaggctattcatgccacctagtatttgtgttggtgtttccataattttttcaaacattagatggcatttaatttatttttccaagttaaaataatgcatgcaaatgcaattaggaatgcgagaaaaaaaaacagccaaaaccaactaaaagaacatatattcaaaggcaagcatccacagctcatcatactgttttgaggactttgtttcggtttcttacattaagagtgaatttaaactggatttgaaatgtaacatggaattggatggttttggtgatattccagctcaatctatttaatattaggatagtggaccatgttatgatgtactccataaaatattcacatttcattccattggtggttttgctacggaataacgaaaaaaatcattggtttaaatcttaattgaaaattctaccgttgactgagctaaccctatcttgaataaaataatatttcttctgaaaactgttgattttcgtttcgtacgacaagtttagctttatctatgatcaaattttcctagtccgatatgttttatagtgtatcccgcacatgaaggtcagtaaaggatgtttgctttttaaatgttgttggtatattttgatagctctagaagagttagaaaatctatttgtaattaattttattacttgtaatcatgacaataaaccttgatataacaaatatgagttttatattccctcttattttggttgcatttaatgcggttacttggttgaattatttgtgactgacgtttgatttatctcttcttgtatgtactattttgaaactcttttatgcaccggaatcataaaggaaagcttatataatatatttcaacactataagagtaatttaacatcaagagctaaaacttgggtaagttataatgctcaccttcattgagtgaaaccattgccgctataaagatagccaattttgcttcacgacattcaaagtttatataatttactggtgaacattgaaaaaaatatccacggttagaggagacgtcaaaactaataatttgatggaaaacatgcaatcaatattttattattttttcaccaaaaggatagagaaacccattataatgataaatttgtccctcgggccaacatatgttactatgattggtttggtcgaactagaccaaaccaaaccaggccatgagtatattttgcaacctttcccccttttttaaaaaaaataggttttcattttttaccctaaatatattgctaccatatatcatattccttcttcattctagagatagcttagaagcttctagcccgaggggcaatatcgtccttttgaaatatatctcgccgattggactggaaataacaaaataatggatgtggtgtcgacctttggcaaattaccagtttttgaaggtgttctcccaccttttgctatgtttaccaacaaacaagctatgtttaagtgacctgtgtcaatattttaccaaatgataatgacaatacctataactttcacttatacatgtaacttgatctatcacctatgtctgacagttgagaagatggttaggagatatgttccatagaataatatactgatccttctcttcatgggccaatcggcctagagtatatatgtgccatcatctacttaacaccgtcatcaaactcaagatgagagcagaggatctgaaacattgaatttgagcaagtgaagttaatgttatttctcaagtctatgcattaggatgctcatcagaataagcggttctcaagatctttataaaaaagcatcaacatctacaataacaaataaatgcactatcaagacataatattgtggattgaatgaaactaaattgatgtatatattgatgcacttatttataaactcagttaatgttagaaaacaaaatgcagatcacctagcatgatgaggtctactgcatcctcatcaatgcccccttttgtgactaagaagacgagaccattcaacatcccctttttatcttatgtgtgtctagacagatgtggttctcccttttgcatcaagttgtcccttgggctcttgaaccacaacctgtggttgtgaactttgatgaatggtggaaccgaatcaatggtatggtttgtgcaagtaccaggaagggtataaacaggttgatcatgcaaggagcttggtctatatgaacgattgcgtcttcaatggagtacctccaagattatcagccacttgtggagttggcagggactaaggg

SEQ ID NO: 1453 - DNA, 3156 bp, Oryza sativa
gccgccaccaccgcctccccgtccgcctgccgccgccgccgtgtgggaggggataccagacttgggaggtgacggcgacgaagcagagaaggcgcccaccctctcccctgcggctgtggcttgtgctcggggatggatgcggcgacgggcgacggcgacgcactgcggcaatggcgagcgacgggctcggcggggctgtcccccgctcgaatccggtgacgacggtcgtcctccgcccggatccagtggcggcgggcgtccctcgcctgacctcgcacggatccaccggcggcggtgggaggagagcagcgtgcggcaggccaccttgcagtcctctcctcctcttcctcctcccgcttcttcctgcccgctgccgtcatcgtggttgtcctccaccagcttgccgcgtggccgccgccgtctgccgatggacgtcgactctgacccggccgccaagggcaagcccacccagatggacctcgaggaccaggtacgccgcagccgctcgactcgtccccacgggaattcttccttcagttttttattgtgactgcctaagcttggagagcatctcaatttctgttgaaacacttcagggaagcatttagctctcagagcattcatgagacttccatctataatcctactaaacttctggctggttcgttagttctatgtgatctggatttggtttgtgtaacactagcatccattgatattctgaatttttcaggcttctatacatctacaggtttctgtaattgataggttaagggcccctttgaatcacagggtagaaaaaacattggaataggaaaaacacaggattctgacaggaattaaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatccacatgtaatgtgccattccataagaatttcataggatttgaaaagcttcaatcctttgaatcaaagggccaaataggaaaatttcctataggatttaaatcctatgaaattcctatataaattctttgattcaaaggggccctaacaagcttttctaatttatttattttttggtgattgctgcttttgctggatcaagcatcatgagtgaatagtcctgatagccgagttttttttttttttgcaacgcatgaagaaccatatgctctcattttaattttcatttgttcagtcatgaattgttattgcaatatattcagaaaagtgctcccatctgaatttcatttgttcagtgatatatttgtgtgtgcaatatttggaaaactgccaatagcatcatcatcaggttctctgatattttttataaataaaaactctagaagcttgattcaatagcagttcactgaaattttgtggttcaacagagcatatcaattgattttctctgaactgctctctacatatgatcctttcgatcatagtttttcgctgaatattttggttgaacaaagcagttgtagtcccctatgagcttctttctgctgtagatgtagttcatgttctgatttttttttttttgttgatgaacagatttctcaattttggtctacttgatttttcatctatagactacaggaatgctctgaatttgtggagttttctgcacctcagctgacgatcatgggggaggctgcaactccagagaggcaggaggatgttgtccaggtggcgggtcacgcctcgtcgacagcatagatcacacatgggcagaggaagctgtggatagcatgatgggtctgctagctgcaaggttcgttgggttgcagctgagctatgcatttttttagctccttttatttttctcaagcaattatctttgtggttcaacaaagcagatcgatacatgttttcctcaactgctcaatgcatatggtcccgttgattaggctcttgattttcttgtaaaaatgcgtacaacctgtcaatccattgaattttctgcaattttatggttcaacagagcatatggattcatttttctgaagcactcactgcatatagtcatgttgatcagggtcttgatttgttctacaattgtgtagaatctgtcgatccatcgaattcttttttatactgctcttgattttgtacagttcattgggtggagctttctcttggggggtgcttttgcctgccatggcaaggccagcaagatgggatgaggcttcagctggctagtgaggatggagatgaaatcagaaatttactacctgtgagctgaactcaggatttactgccttttgtagttaataatcagcgtcgtcggccctgatctacgttgctatattagtgctggcatcgatcggtattggcatatgtattagcgggtggtgttgatttgattttgtttattagttttgtgtttttctgccgatgtatcattgcgtgcattatcagattgttgatgtaacaccgacactggatcaaacaattcatgtttgtaaagaaattattaaattgtggttaggttaataatatgaatcataattttttaccttcatttgttttgtcactaaatactccagcggccttgtgcaatctgcaatatatttactcctgtatcaggactaacttattttactaagagaagtccaatgacgtgcaaatattaatttatttactaagagaagatttgcaaaccaattgggagtactaatgaagagctgagaacgatctgagagtaatttatttacttaaaggagtaaccaaattgggaagggctgaaaataacctaggagtaattcatttactaagagaagaaatcaatttggaagtgcggaagtgttagtaactcatttactcttagaccgaaagacacaataatattgttactaatgggccaatcaccaaaaaaggtgcgggaggaaggaaaaaaaaggtgcggggaatattttgatagtaacttgtttacttatcgaacaaaaacaactgatagtaattgatttactgaacgacagaatttgtcggagagagagggatgagggagtttgtgcaggatggatgtgggtggggtgatgcgggggtgggggggtggggggtg

SEQ ID NO: 1454 - DNA, 8085 bp, Oryza sativa
ccagatccgggtgggggacagccgccaccaccggatccgggcggggggcggtcatccaccgctgcgcgcatgcagccgagcccgccactcccggtcaccagctgccgcgcgcacgccgctgagccacgcggtgctgctggccacgcccgacgttgtgcgtgcggaccatgcctaggagtgagagtgagagagaggtgagagagtgagagaggatagagaggtgagagagtgagagaggatagaaaggataaggatgaggatgggtggacgagatgaaatttttaagtgttgaggagtgaaaagaggaggaaggatagatttgtaggcaggtctttattaagaggccagtacgtgaaaattgattttcgcgtgcgggcatcttaagggtccgcacgcgaaaatgggaggccaatttttgcgtgcggacatgaaaacgatccgtctgtaaactaaatagctcctcgtccaggaaaatcgtttctctactagtggcaatgagccaagcctagcctctaggtcgccaccactgcaattgccggattttgctatttgtttgatacctccaagagcatgtattgttgcctttgttctcttccttgagcttagttgggatagcttcactaagctgccgtatcggcccgttgaaagcccactcgatcctatcataatcttgtgatttgcattccaaaatatcagttattgcacttcaaagatttctagttagtgttttgggatgtatgtgcaaattggatctagaacaaagtgagatatgcaggtaggcacattgaactgttgggttttgagaaagtaaaaccatcattccaccactttcttatattcaccaccacaagaaacttcatcctgtaccttgcctggacagtagacactaaagctacaaatgttactagccatccgtcttcaccaatttccgtcactacttcaaaatataaattaacaatttgaaacataatggtcacaggataacattcaggagtttctttatttaaaaaaccatgacattcctgtcagacaataccgccacatagtttttaaagttcctcatagctccatctacgacattgtgcaaaaactcgctcgacgcaatgaagagcctctctacacatgtgccacacacactttaccaggcaatcaaaaagtatgtggtcactagtttctgggaatccacaaatgagagagctgacactttcatgaccttgctgacctctttttttttaaaaaaaaaaaagttaagttgagcacattatgtcttcattggtatagaaaattcactacaaggcactaatgaggcacttttgaaaataccactatagtattgtaaagacatttgaaaaatgcttctgtagtattagaaaaatatttctacaagatatttttgttgtagtaatattctacagacaccacgtggtgacatcttctgcttgaaatgttttctaagtggaattgagaatcccaaagagtaaagtctatcaccggtccctaaacttataccgttgtgtcatcctggtccctaaactcgcaaatcgaccgttcaggtcctcaaacttgttcaattgtgtcatcccagtccctaaactttcatatcactcatctaggtcctccaacttgtttagttgtgtcaccctggtccctaaacaggacggtctaaaaattttgtattaaaaaataattcataacttttttatgtgaactctaatgaagacaaactttatattaaaattgtagcccgcgacacgacctataaatttctagttgaaaagtttttgaattaaaactgtttagggtcccaaaatattgttgcatgtttatagattttgaaatttaaattttaaaattacattttgggacaaaaaatgacttaaaataaaaaaaaatcaactttataagttgtagatcgtgtcgagggctacaagtttgatataaagtttgtcttcattagtgtgaggacgacccaaagcctaggtggtgcaacgctccaaggcatgtcagcgcgaaatatctggatggatggggtctcaaataaagcccaaataaatacggtaaccatccaacctcatcgcagaccctaacatgtcttgaagagtgcactacataggctctaagccatcggatatgaaatagaagacacaaccgttggaatagccacaccagtcgtctacgtcatacgcccgtcaaccactcgatggtggcgaccaaaagcataccccaaagactcgatctcaacaaaggcatattccccggttatctcaaccatttcaaacccatcctcatgtgggactagtcgcctaggaatgcaacatagtctcacataaatcatctcaagcatgatatccaaataataagtggttctaagcaataagcataattagtcttaataaggttctaagtagtacttggcgacaagccataaatattggttcatgcggtaagcgtgctacccaaaagcacataggcaaaccgactaggttaaatccctagttagaaccatcctggaaatctgcaacatcacaagctgcatcaaactcctcatccaaacagtcattacctgcataggggtctgagcaaaaacaagtaaaagaaagcaagaaatcagtacattaatcaaattaatgtactagcaagtcggaaacaatcctagcatactacatgttggccatattcaaggataagctgtgtataggttaatttgcataaataccaattttagttcacaacattttccgcaacggaattttataacaatagtatagagtaagtaaaacttaaatgtaaatggataaataacacacatctacccctcaaggtagatcatcaccactcgccatcatctcatcaccattcaccgaactttacccaagttcacaaacaaaacattccaaccattttccaagttcacaagagtttatcaaaatcaccaactatactcatgacacttcaccatgccgctcatgaccgtgagcacggctaatcgattagttttagactctgcatagtttgtacaacttttaagcccacatgatatgaatcgctctagtttgtccgatacccgtcggtatcaccacactctacacattgagtgtgatctagaggtcataacgaaaccgttacattgtttattgtctagcattgcaccagcacgatgtgtgttttacccacgctactagcaaggtagcgccactaagtagcgggcccacgctttaacctagcgccgtaaggaacccagcccggaatccctcacgaggcacgacaccgttgtattggacagactacccgctcaaatcatcacataccacttgtcattaatcaatttcatcatatcaccaaccataggaagttccgataagttaccaaaacccggtaacccatacccttcggcctaccaagatgcaaggctaaactctaaacaacttaataggttgaggccagcccatacttagcacatgtgatttgtactgttttcattagttggtgacatagagtggggtccttaatcgacccgggcgaatgctccccctatcggtgtacaactaccaccatatgtacaccactcgccgcccaagtctaaaaacaagttatctccattttcagttcacaatactcacacatttaaatttctgtccagcaacatcaaaataaccattttcatatataacatttatcaaaacgagtaatttacaaggcggtaaccgaatataagcatataacggcaatataagcatagtataatcccaaagaacacaaaaattctattcaaaagcactctatggttacaaccagcaaggattcaatatttcaaggtggattatgcagcaatcaggtcatatcttaccattcccacatttatattttttttttaccaaaagtaatactagctaacatatgcatgtttgcaatagaatcatttagcccaataaaacataggatcaatgtggtcaaaggaggggcaaacttgccttcgtttgcaaactcctgaacctggtcgtcaacaaactcaccctcttctccttcgacgtattcttcctctatacaaaatatgcgtatacgataaatacaaaaatgcataaaaaccaaaatgcatgaaacttatgcagtgagtgtgtgctggtctcaggtggtctctggtgaaggaatttttattttgtcactttttatttacagagatatgcattttacaattaaaaaggtttaaaaagggctatgttttattaagcaacttttttgtacagaagtgaacaaaattcctttttacaaagttacagagcatgactttagaaagttaacagaagtggtttcacaatttttagagctatattcaatttgttatggatttaacaagttctaggcaacatttatggcaaaacaaaaataaaggaaaagtttgtatagaaagtacccagttttattttttaaaaaaaatatttcacagctttatggatctaataaaactggtttcacaatttttgaagttaaaatgaattttctacaaattttagaagttctgctcattctctgcttgaaaccaaaatagaaatcaattttcgaaattgaattccagcagggtccacaggtcagtgaaaggagatttgcagagaggccctcggaagttgggggaatcaacccgcactccttctaccacctggacagcaaactttcttaagagtccctattcttttgtttatttccatcaaggttctactaatatgattcatggcagttttcagattggaccctagtgtcgatcagattcaagaaatgaagtccccagctagctcacatcgggaacagcaatggctgagctcggtctacggctcacctgcggcgatcggtggatcgaatcggttcgagaacaaaagagaaaatgtagagaacgttcttgcgcatccgtgagtggtggtggtgagggaaatggtggtctgtagcccatggaacatgagctacagcggcggtgtgtcttggtatgcccatgtatgtgcatgcagaggcttggatagtgcaaaagggttagtgcatgtgctctcatatggtaccagggtgctcaccaagcagagaaacggaggcagagaggtccagggagcggtggagacggtggttgtatggccaacggcagcaaaactccggcgtcgacgtcgccggatcgactcaaggcgcgaactgcaacttcgagagtacaggggtgttacggatgagccacagagggtgcatgcgcgaggaatccggcggaaactcaccggagcttggtgttgcttcggtggtgaggaacggcggccggagcggcgtcagcggttcgggtggccggcggcgaggacggtgacgcccaccacgtgctcgacagattggcctagggcaaaacgggtacgggtgagctcggcgtgatgcgtaggtcatgttccataggagggaagagagagggactcactggggatgcacagcgacgatgactaagtcgccggagccggggaagatgaccgagctctgggcattctgggcgtggggtgtgttttcttggacttggaacgcgatgtggggagtgtgctgttgcttctggtgctttgtcttgggaaataagagcaggtacaatagcaggctataagccagctgcaaatatattttaagcagataaatgaggagagagaagggcagcgggccacagatttgtagtcagctgtagcacggactccaaaacgcagtgtgtgtatgacaggtgggaccatatattaatagtgtagtatgtaactattgtatgaataagctattagattggctatagataaattagagctagcagtgggctatactattgaacttgctctaaggaagagtggagtgggggagtgagagagagagaggtggctggtgctctcattgtgttccttgggcatccattgggcatgggggatggtggatgctgtgaggggagagtgggaggctgtcatgtgggtcccagggggtgtggggcccaccgtcagtgaaagaaattcgaaaatagccttggaggcaaagtcaaagagggttgcctgccaaggatctttggaggggattcaaggtggattttgtgcagcaagaagcctgggctagagatcctcttggtcgagggtgatgtggagagtaaatgtgctgaagtggattgggttagaagtctctggtttaggtttgatggagggatgaacatgggttgacagtgttggttagcagcagttgatagtgcagttgatagctgattggatttttggagggagggaagaaagggttagagagtgatccagggtgttccactccttagggtgttagaagaatgttagtagaagacctgaaaccaaacttcaaaaagagattttgaaataaattttacagagagagcaagtttgaatctgctaagcagtttttcaggattttggagagattaaagtagatcaacgagttagcaaaccttactgaaaaactctgaaaatttgtgggttgatttctgacatatcaaggtatttttgagaatttttgtagaatttttggatgcatataattaccagattaattatttttgtgactctaggcctatcattgcatatgatgatgagatgattaagatccaaaaacaattaaaatcactccacaaccacatgatgcatttaaattaaatttagttcttaggtttacaggcttgggtatgttacaattagagttcacatgaaaaagttatgaattatttttaaatataaagtcattagaccgtcatatttaacccagataatattcaaatccaagtttagagaccggggtgacacaactgaacaagttggaggacctaaacgagtgatctacaagttttgggaccgggatgacacagtcaaacaagtttaaggatctgaacagtcgatttgtgagtttagggaccgggaagacacagcggtacaagtttagggaccggtgatggactttactcaatggcaaaataacatgtgccatttactgagcacctatcacactaatattcatgctacttattatttttgtggatgctgagaaatgagttagtggggatgaactatatagtctatatagattcgaatttatgttggcatcatttattattttccatgatacatttccattgaaaaactagacaactgagacttattataataactcggggttatctatttgtaaccattaaccctgttagttcaacacatttaacagtaatttagctgcagtgtgatttattttttgtttcgctttatattttcatgtaactaaattgtcccatgaagataaggtggcttaacaaaatgcataggaatatgaacaccatttatgcttgtgttttagaattttgtactttcttgaacataaaattccattattacctgcaaaaaaataaaattccattattacagtatccaggtccatcaaataatattttggtttgcttacatgtattctacagacaccatgtgtccacaacttctgcttgaaatgtttccaatggtggactcagaatggtaaaagagcttgtgtcaattgctgagcacctactacactaaaagtggcacaagaactaagaattgactcagcactagtccaagctatccgtatggccaagggtgtaaacagtgcaagttcagctggtgaaaaatcagtttatcgttataaacaaaacaaagataagtctgataaaactttctctactgaatgggataagagggctggaatggcaatgcttctagtggacaaatatttgtgactattgcacctgatcattttggtccaattctcgaagaccatgacccaaaaaggaacctctgtgtttgagtggggaaccattggaagaatgtagatagtggggtgaccattttcctcataacactaggaccgccatccaatctacacatgcatggtgctcaattagtaaccttataatacaatgcagaaagtgaggtgcccattttcctcatgttgccaggtgccaggactaaggacagatctacacatgattctcaatcagttgccctatcaagcagattatttggattgataatatcatgtagagtggttcctatatactggaaggtt

SEQ ID NO: 1455 - DNA, 16162 bp, Oryza sativa
  unsure (1)..(16162): unsure at all n locations
tgatatctcccacctcaaatagacgtatatatatagagagatcattaagaaacaagtaagaagagaagtaacaaatacttcctccatcaaataaaaaaccaatccagattcattcctaaaagttgattctttttagtacaaagggtgtagctccctgaaaccgttcacgccatttatttcagaacttatgtcgcactttggtgcacgctgctacctctctagtctaccaccatcacttactgatgtgtggccgatatgatgatctggccatgcattgctctagggacattgcaaattcatctgattttgctagcgctgagagcagctttgtcactgccatccatgtgattagggttaatcagacattgtccatgttggagatcaaagccgtcaattgctgaggcttcttggtgatgccagtggttcagaatatagctaaagctcatgggacgatgggagcaccagagaggacagggacaacaacaatcctgcttgcttgctaacaagaacatcaatgggttcctctacatgctgcaatcggaacaacccatcactgccctttatatccggccgttatatatcctccactntagcaaaaactcgctcgacgcgatgaacaacctctctacacatatgtccatcacactataccaggcaatcaaaaaagtttatggtcactagtttcagggaatccacatatgagagctgacattttcatcaccttgctgacctctttttttttaaaaaaaaaagttgagttgagcacatgtatacactacaacaaaaaccttatatattgacacttttcaagatacaatttacaatttgcctttaacatttagagctatatagtctagagacactttaaaatttgcatcttccagcggcattgtatatttgtataggcaattaagaatttgctgttgggaatagtcccacattgcttatctagggggagttgaaccaacttaaaagtgaggggagcccctcatctcttgagctagcttttggggtgtagcaaggctttctcccagttgggccaacgtctcccggttttgggccaacaagtggtatcagagccaaacccacaatctctagtgcttgtgcactatcagggtggtgtaaacccaaagcccagtggaccgcgggtgtgaggcctgtatgtgcccgtgtgtggggtcggtcagtggaccgcgggtgtgaggcccgtatgtgcccgtgtgtgaggccggtcagggctaaggggcaccaatgtaacccgtatgtgcctgtgtgtgaggccggtcagggctaaggggcaccaacgtgtgacgggagagattgttgggaatagtcccacattacttatctagggggagttgaaccaacttaaaagtggggggagcccctcacctcttgagctagcttttggggtgtagcaagggtgtagcaaggctttctcccggttgggtcaatgtctcccggttttgggccaacatttgcctcaaatgtaaagtcattttcttgtgagattctaacatatgtagaggcactttttaggacattaatatgtgaaaaacatctagatataagcaacacacattaatatgtgcaaaacatctagatataagcaacacaaggcatatattaaacatgtagccacatgaggttgagatggttagtgcattgaagataagaatgaacttctcaagaggtttcgagttctaggatttaaagtagcaaggaatcataaagttttcacttattttttcacagtggtttgctatgtttgtcacacaatctaatgcccctagaaaatatctatactctctttgagaaaaaaagtttctataaaaaatgctgcaatacataaatgccagtttctataaaaaatgctgcaatacataaatgtcttcatttgtataacaaactcactagatggcactaatgaggcatttttgaaaataccaccatagtattgtaaagacatttgaaaaatgcttctgtagtatttgaaaaatgtttctacaagatatttttgcacaatctaatgcccctagaaaatgtctctactctcttagagaaaacaaagtttctataaaaaatgctgcaataaataaatgtcttcatttttatatcaaattgactagaagggactaatgaggcatttttgaaaataccactacatttgaaaaatgtttctgaagtattagaaaaatgtttctacaagatatttttgttgtagtaatattctgcagacaccatgtggtgacatcttctgcttgaaatgttttcaaagtggaattgagaatggcaaaataacatgcgccatttgctgatcacctatcacactaatattcatgctacttattatttttgtggatgctgagaaatgagttagtggggatatactatatagtctatatagattcaaatttatgttggcatcatttattgttttccatgatacatttccatggaaaaattagtcaactgatcatactcattataataacacggggttatctatttgtaactgtcgatgggggatacccgtagaccggataaatagagtggtggggtacgttggtacgaggatctacacgatacgacatcaaagcaaacaaaagacaaggattatacttcttcaggcccctcttgaggtaatagccctaatccagtttatatgagattgatatgaaaaatcacagagtacaaagggaatagatgaatccgatgataccggcaagatccttgtcgagattgatcgacgagatctcccgacggcttcggcttgaatccttcggcttcgtaaactgtggtggatgtattggctctaggattcgatgatcctaaacccctccgagggtgtgccctttataccgcgagttgccttagtctccaagtagaactcggagacaacgaaacatgcacgacacagaatagtcccaagcctttccgagtaggactctgatagtctctagcccgtaaggatatttttcataatatcttgtatatttccttctcgcttacggaaacatacctagaatatgagatacaccaatctagtatacttggttaatcgtaggataggaggtatggttatccataaccctgacagtaaccgttaacccagttagttcaacacatttaacactaatttagctgcagtgatttatttttgtttcgctttatattttcatgtacctacattgtcctatgaagataaggtggcttaatagaatgcatgggaatgtgaacaccatttatgcttgtgtttcagaattttgtactttcttgaacatgaaactccattattatagtatccatgtccatcaaataatattttggtttgcttagatgtatttgacaaataccataaggccacacactacaccagatcctcacacctttgacgacatatctgtgacggactttagcactcgtcagtgatgagggtcatctttgacggttcttataggatgtcgtcatcagtgaggcatccttctgcaacccgtcacaggtaactagtcacctgtgacggtcccgtaatgaaaaccgtcacctctgacggcttccacttctggcccgtcacaggtgactagttacctatgacgggttgcatgattataaaccgtcaaaggtgaggttaactcacctcaaacggtccggtcactaggcccgtcacaggtgtgggtggggacttgactaggtcagactaatatgtatatcttctctctccctcacactctctctctcccttatccacacattttctccaccgcgaaaaaaaatgccttgggcgacgccgctcttgcgacggcggcggaggacccgacgccctcgggcgaggcggcgctggacggcggctcagcaatacgtggcggcggcggtggtgcggaggcgaagcggcgaggtggtgcggcggcgcgtggcggcgacggctcagcggtgcgtggcagcggcggcggcggtgcggaggtgaagcggcgaggtggtgcggcggcgcgtggctgcgagcggcggcggcagtacccccatcctcctccccctctttctcccctcctctcccttctgatatttctcaaaccgggtttttcttgaagtggcagcggcgtggagttctcaacggcgcccggcggtgctgcggtccgccggctcgacgcagcggtgaggaggcgaggaggaggtgaacggcggcgccgcggcctccatccccgaccgccgggggccacctccatcccccaactgacgggtgccacctccgaccgcctggcgctagatccatcctccacaaggtcaggggacgcggatccggccaccggggcgtcgtctcctccgtccgccggctgcgtccccaactgacgagtgcagaactgcagattcccccgtcggctgcttccgggtgcagaaggcgaagagggcggcgtcgaggagcagtaatagggacgaggtcatccgcaaggaggaggagcaaggtcgcctccaggccgagctcaagaaggtctagcgcgccaaggagttcaagcccaccgtggtatgaagaagccctgcccggcaaaacccacaaccatttattcccttcgtttttgttgctcgtcaggtgattgacgaattgcttgcttgccatggctgttttatgtgtgatgaaatgttcgtgaagacttttctgtgtgatgaaatgttgtgtgtgatgaatgcgatggcaactacccagaagcactttttttttgtttttttttatcaaaatctacatcagtgacgggtgttgagctgtggttgtggctcttttttcctttttttttgggtgatttttctcatctgtgacgggtcacatgatacaacccgtcaaaggtgtctgtcacctctgacggagctacacccgtcaaaggtgagttaagtcatcagtgaccattgatctgtgacgagggggtctatccgtcacagaagagggtttgagcccgtcactgctagcttgttctgctgtagtgacaacttctgcttgaaatgtttccataggttgattcaaaatggtaaaagaactttccatcaattgctgagcacctactgcactaaaagtggcacaagaactaagaattggctgagcactagtccaagctatccgtatggccaaggctacaaacagtgctagctcagctggtgaaacatcagtttatcattagaaacaaaacaaagattagcctaataaaacattctctactgaaagggataagagggctggaatggcaatgcttccaatagacaaatatttgtgactattgcacctaatcattttcgtctaattctctcaaagtccatgacccaaaaggaacgtcggtgttcgagtagggaaccattgggtagaatgtagatagcagggtgactattttcctcataacactaggactgtcatccaatctacagatgcatggtgctcaaccttataatacaatgcagaaagtggggtgcccattttcctcatgttgccaggactgtggacagatctacgcatgattctcaatcagtttccctatcaagaggttatttggatgattaatatcatgtagagtggttcctatatactggaaggtttagtacatgcctgacattttgttcctgtggtcagtaaccttataagatataaacattttaagaagatagatacgaagaggatatacctgtagagggaaaaaaatgtgtgaaaaaatgatcatgtgtgtaccacacaaatagatattaacatttctatcttttcaaataaaaaagatattttgcttggtgatgtcccacaaaacacttctttaaaataaaaacgttgggaccgccgttcaatctacacatgcatggtgctcaattagtaaccctataatacaatgcagaaagtggggtgcccattttcctcatattgctaggactgtggacaaaactacagatgattctcaatcagttgccctgtcaagaggttatatggatgattaagaccatgtagagtggttcctatatatatatggaagttttggtacatacctaacattttgtttctgtggttagtaaccttataatatataaacatcataagcaaatagatatgaagaggatatatgtgtagaaggaaaaaattgtgtgaaaaaatgattatgtgtgtaccacacaaatagatattaacatttctatatttttaaatagaaaagatattttgcttggtgatgtcccacaacaaaacatttctttaaaataaaaacgtaatgaacaaaaaaatcatcttaactaattttgcatagctcatcagaaacaaaataaataagggttaattgcatacatgacattataaattttatggtttgctaatatgccattattattcatatatttggtaccatgtcatttcaatttcacaaatattagagatatgccactacataccacttcacagtattatctactttctccgtttcatattataagactttctagcattgcccacattcatatttgtgttaataaatctagacatatatgtgctagattcattaacatctatataaatgtgggtaatgctagagcagtggtggaggactcgccatacctcgccgcccgctcgtaccaacaccctctacctccaactccggcaagccgctgacggcagtcaggtgcagaggcgaggtgcggcgtcaggcgatgggcgaagacagggcactcgctgctgggccactctccactcaatcgtaggcccattgggctcgtttcgtgttaatgtgggcatatgtggatgattcactagacttaaccctagctcagaaattccccatctccgccgccgcggcggacgatgaggcgacgacggcgcggccgtttggaactgcgggaggcatccgcatccagctccccgcatgagatcaacaagcggcgactgggcgccagagctggtgtgcggtggcgcggctacgcggctaggacagcagacagcaggagcgatgtggtaggcgtaaggcaagcagcagcaggtaagctgaagcaagtggccttcctcccgattcaatcgtccctaatcaatccttgctctccttttttcagattctatgcatatctatcctctcccttgttccagtgattattgccatgctgaatattgatacaatgttgtgccgtacagtatagtgcgattaggtatgtgtccatgagttatacctcttttttttccgtcctccgctactgtgctattagaaaatgttatagtctgaaacggagggagtattttttaggaccaaattacccttttcttcttcctttctacttcccctctcttctctctttttagaatttgatgtggctagtggcatgcagccgtgagatcagttgcttgcttgcacccattttagctaggattcaggaatatacagcatgcattggcctatgtatgtgtataactgtgtagatgtagagacgtacagtgactgaaccacgccatgtatgagcgtaagtgtacaggctagttccgtatagttcgtacatgctgggcagcacctcggctccaacaatgtggcgggcgctcctgccgtccacgccaccgaccagcctgtgaacggaccaaccaccaccgacggcatcttcgaactttgccgagaccacgtcggatgcgccagtggagggcactgatgcagcgttgctcgcggaggtgttttgggagatcggcggtgccaagctgtagtcctcaccgtgcagtccaccactacaggatgcagccggctacataaacctcgtcggatggtcagagtttgttggttggatgacatgagagaggagaaagaaagggatgaagcagaagaagggtaatttggtcctaaaaagttagatataactgtgaaaggatatgtagtggtatatctccaatgctcgtcaaattgtaatgacatggtatcaaatagataaatattaatggcatatttccaaactataaaatttataatggcatgaatctaatgaacccaataaataaagacatgtttaagcaagattcttttgaaagtataaagggacaattatatctgtgcccccactttgaaagccaattgttgttttgcccctactttttagggtttgtatttttatcctcactttttgaatctcaagcagccgtctacaatcacttgtgacagccgtttggtggcggcagtgggcccgcagtgcgcgacagagcgaggcggccgagggcgtgcgccggcgcccactcccaggatggcagttgccgcgtcgagggcggtcgggcggccgcgtcgagggccggccggcgcccgctcctaggaggtccacaaccggcggccgcgactcttctacgcaaagccccgtgagatctccggccgccgccatggacgccgtcgactcagtcgtcgaccctctacgcgagttcgccaaggacagcgtctgccttgtcaagcgctaccacaagcctgaccgcaatttcaccgcaatttcagttgaacactttgtagtttgaagtttaactcaattttattccacaaccgtgttaagtcaattttatttgactgctatcgtttactcagtctttggtagtttttcttaactgcagaagtttgtcactttgtcaggtgctccatcaaatccaatattaactgatttttattttactgttgagaaaatttcaattgaatatacctctattcaatctagttccagaatcttcatggtttgtttgcttttggacatctatctatatgttgtgcacttttgtgcatatatagacttagtaatatgatctggactgtaatatgtggtaatttaccctctatgttgtggatatgtgatgtgtgcaattatgtttgtggacactcaatgtttgtggttgatgacttatatgtaccatggctaatttgtatgggacactttgtaatgcttgctttatatgtgacttgtgctagttgtgtcaaaattctatcgaaatgctgtccaaattttatttaaatttcggtcaaattttgtaattgtctagttttttgtgagtttttttgttaaaaatacaaaaacatcatagcagattctcacatttgaattattcacataagctgaagtcacaaagtaggggcaaaatcacacaaagctgaaaaaaatggggcaaaattgcaataacaaccaagggtataaatatccttttctctacaactaacactgttaaaaccggctgctagaagtgggggtacatggcttcttcagatttaaaaagtaagggtaaaactgcaaaccctaaaaatttggggtaaaacagcaattggcttcgaaaatgggggcactgatgcaattgccccaagtataaaaacacactagtaatcccatcttccacatcctaggtacccttgatcctcccacctcagatagacgtatatgtagatagagcattaagaaacaagtgataaaagaagtaacagctacttctataggatcgaataccaataactaagctaaccagaggagggtgaatggttggtatacccaaaaaccaaaacttttagtggaaataaaagttaccctcgaattcgtcggatcgcggtctaaccgaagtagatgcgccggtctgaccgcctgaatgttgttggtctgaccgagattgcatctccggtctgaccggcgagattagctatcgtcgcctgaagtcgccaccagtctgaccgccacgatgccgctggtctgactgatggtatttcgccggttagaccgccgaaaccgagcaaacacaaatcaaagaactcttgatgtatatgacaactttattacttctttttgtgtttacaaagtgcaacaacaacactcctcgaaaatttcgactaaactcgaaaccctaactcaactctcaattcaatgctctcaaaagcgatatcgggaggccacaccctccctctatttatacatgaggtatgcagtctaaagccacaaactaaactcatagaagaagtcctaatccacctaggaaacctttccgtacaagaaaccaactttacaaactccaatcataccaaatttggactccttccaaattcgactccgcatcacatactccttccatcgtatgccatatggaatcttcaccaaccacgtgcattgatctttagcctaagtatcccgcatgatatctgaccgtccggacgtcaccttatctccaagttgaattccgatccatcactggcaatactctccggaggcattaagacacctacacatgaatcaaacaaagaaaccatattctaagaccaagctatctccaatttgactcattgttagcaaataacagtattacatacgtatagtatctatctagaagccataaacatgaaacatccacggatatccaaacaaacaacccgaaaccgaaaccgacacagagtcggccggtcagaccacgggctggccggtctgaccgctcgcatagcatcggtctgaccggcctcaccagcccggtctgaccagacccgacaaaatagcaaaccctgttcatcacatgaaaatcaatcatatccaaaactacttcgccaataatctccaaatatcaaaaccaataaactcaaatgccaattgttcatcacagaataataatcaaacacgctttgattttacaacttcctccatcccatataaacgaacatctagggatgaatcttgacaagttcataactagaagttgattcttttcaagacagagggtgtagctccttgaaacctttcacgccattttagaatatatgtcgcactttggcagacgctcttacctcttcagtctaccaccatcacttgctgatgtgtggccaatatgatgatctgcccacattgctatgtggacattgcaattttatactctatatttgattttgttggcgctgagagcagccttgtcactgccatccatgtgattagggttaatcatgcattgtccatgctggagatcaaagccgtcaattaattcctgtagcttctttgtgatgtcagtgattcagactgtagctaaatctaaagaatcaaattaagacatatcgattaaaacatttcggtgaatcacgattaaaacatttgggtctcacacaaaacataccgattcaactgatgaaaactaacacattcagaaacaatcaaagacaaaaatataaaacatacaccggaaaaaagtccagtgcaacattatattgatccaacaccagaaacataaacatgaaagatctatggcctaaaacatagaaaatccgccaaatgtacacgtcgggatctaacttcttcctcacttgcgtctctggatcagactttttctatttatcacatctaattaattctacagaaacctcacagttactcaaataaaacgtgaatcacttacaacagttcactcggttactaaaacaatcaatttgagacataaagtttcaacttaatttcaagatcagtttcgcatgcagaagatctttccagtatatatcgccacatcaccctagtgtactgtgtgagaaccacaagaaatcaaccatgtcgtcttctttgccctgcctcgccgtcgccgtcgccgtcgccgtcgccgtcctatcgctgctagctctagctaattccaaccacctgccagctgcctccgtctccgccgccgccggcctcggccgctctgcgatcccgcgcggccacatcgcggccatgaagttcctgtacgcggtgaacgacgtgcggcatcaggccggggcgccgccgctggagtggagcggcgcggcggcgcggcactccaaggagcgcgccacctggctccgcggccccggcgggtgcgacctgcaggcgcagaagggcggggacccggcgccggcccacggcggcgccgtgacctacttcctcagcgacggtggtagccgggcctcgccggaggacgcggtccggctgtgggcggacgagcggcggtggtacgacgccggcgccagggcgtgcgccgccggcaagcagtgcggggactacgagatcatggtgcagccggcgtcgaagcagctcgggtgcgccgtcgccgtgtgcgcgtcacgcaagacgatcatggtctgcgagtactacggtgggcaggcattgatctgagcctatctatgctagtactacaatcatgtactaattaagctccatttttacaaaatactactaataagatagcatatgctgggcatattaattttcttcttcgcggcttgtcttgaatataatgttccgttggaatttgagaccctgtaaactccattttgacatgattatttcactttcggagtacaacgttcaataaagattactacaccccactattctcaaggatgactcaaatttatgcgtgcagtatcttgaataattaatatattaaaaatattacgatttaatatgtcaaaataacaatatatttgtaaatggcacttttatattaattagaaaaatataatggtagaacctatgcattcaagattgtgtcgatatcgaagacaagtaaaaaaagaacaaaaaataatatgacttaagagagtacttcactacttcagtctggaactaaatgccaaccctgtatataattgcacgaatattatatcataatagaatttgtttcgtagataatcggtttcactttatcttcgaaattaagataaaatttattatttgcacctttgatcaactatcaaattgctataaataattttggatgatttggttttattaattagagaagagaaaactgagaacttcaaaagataaaaaaatagacaatttgcatcttaaaccaatggtccaatggttaaaaatagttaatataatgagagcatcaattacatttagtagggtgaagacactaatataggagataagttagattagctctaatatgtttacatgcaagatttgtctcttatcaatattgtaaaagtaagttcataaagttctgttgcactatttttcttatgggtacaaactcttacatccgcactatagtgaaaaagcacgtattccctccgtcccactaactaaggcgcacacatattgtaagatttaactctttaaatatttgatcgataaatagtttattaatgaaattatatttgattaaaatagtatcattggattatcatttaaatttactttcatatgtttatgattttgttactattatagtatatgagaaatttaaaaatagtatcattggattatcatttaaatttactttcatatgtttatgattttgttactattatagtatatgagaaatttaaagtcaacgattagtcttgaaaactgtaccaagtttgaccacgtcgtagtgagtgggacaaagagagtaacaaagaaattaaacattaaatgtgtctttggtaccactacatattatgggagtggtaaataattactaccaagcataaggattttatggataatcccaccttattttttattatggcagagatctaaaacggaaaatgtttcaatccggttgtccgatctcgagaaaaaaatcggacgcctctcgctatgactttgatgcatgcagcctactcctttgtaggctttttgccagatcctctctttgcacacatgctacatatgcttccttactgagcattagtatgcatgaaggagagaggacatgaggttatttgcatgtacataacacccttttagcaaacttgaaaatgatttttcttctagattacttatccaatctatgatccgattacaccaatgtattcgttacaattaaatctttacaacaagatttcacatgactatattataagaaaaaatatacatatgttttaaccaattaaatttaatgtttcacatatgagaatcagatgtttcagctgaaattatattatgttgtacatatttaattagtgtcgcactgtatatatcttttcttagtgtatcacatggtgctatttctatgtttcagtaaatagtttattatgtttcactggtttatttgtaaatgttgcatatgtgttggttgagtgtttaaataagtattcactagttaattaaaaatgttgtacacggtatcatccatacatttcagcaaatattaaaaatgttgcaaatattatataattggattatactatcatatttgttgtaattaaattttacaacaagatctcacatgactaaatcctgatgaattttaaatttagcttaattttatgttgcagttaatctttttctgaatgttgcacactgatttatttggatgttcctataaatatttttccgatgtttgtttagtttattttgcaaatgttgcatgtcatattatgagtatgttttagcaagggttgctttatgtttcaatagttacaactcgatgtttcatgtacatgtgctataaaaatatttcaataaaatcaagtatttgtaaatctatagtatgtaccgtactatttactattttcttttgtgtttcatttgttaagattcaatgtttcatgtagtaatttctagtgttgcgatgatattaaatattatatctctttgaaacataatttgaaacataattaaagacgagttgaaacatttgacctcaagtgctgaaacatttttttataaccgatgaaacatcttttttgcaattattttttatcaaaataaaatcatgttggatcttattgtaaagatctaattgtaacgaatataacagtgtaatcgaattatagattggacaaataattgagaagaaaaaatcatttaaagttttctaacaaagttagtttgtgctattatttaatgggagagatgagagagagtagttaattcaccatgtacagaaataataaagtaagaatgaaatagtgcatagctacatgcatgtagcagagccatgtgagtagcgtacaccagcccatagtagcatccgatttttgtattccatcagacgtccgatcgctagtactctcactctaaagtatagatgttggatttttttagatgatctcacttatttctccatcttcgcatgcacgtatacgtattatggtgtctctctaacatgctaatgtcacttgacacgggcagcccacttattgtcgagttggacaataaacattgaggaacctagctggtgattagaaagtattttaaacataaaccaaaacatcatatttggcattcacatgtatattttttatcattacattttctaatcatgtaattaatatgaaatacgaaaattgttggaaacataactacgtgaaaacattattaatttttcatgacaaatctactgatattatttttatataccaaatcttatcattttttatatagtagtgatctctaaaatgttacgttcaattgtccgtacgcatcctaaaattaacagcatccattgtgaacagagttgatagacttcagttgattttgaaacgtaaagtgtcacagagatataggtaaaacttaattatatgacatagtaccgatcaatccttttgcttgtaagttgtaaccgcatgcgaacgttttattatctactagtatctcagaactcacttgcagttactcgcgtagtagttaacacgaatcactggaagcaccgtcactcggttactaaaaaatactccttccgtttcaaaatatttgacaccgttaactttgtagtacgtgtttgaccattcatcttattcaaaaaatttaagtaattatttattcttttcatatcatttgattcattattaaatatacttttatgtacacatatatttttacatatttcataaattttttaataagacgaatggtcaaacttgtattaaaaagtcaacagtgtcaaacattttgaaacggaatgagtatacatttgtgtaacgaaagaacaataaatttttttaacagcagatgtaggagttctacctgatatattaaaataacaataaatttgagacataaatttcgagggtttcatacaaatctttagttactatataaacaaatcttcatcatacaaaagaaaaagcacaattaaccatgtcgtcttcctcctcctgcctcgccatcctgtcgctgctggcgctagcctcccacctgccggacgccgcctccgcgcctcgcggcatcgggccgctcagccccgccgcggccgcgaagctcgtgtccgccgtcaatgacgcgcggcggcaggccggggcgccgccggtgg

SEQ ID NO: 1456 - DNA, 2772 bp, Oryza sativa
ataaaaaccggaagtaaaaaacatctctagtcccgatttaaaagttgaggggtactttttaatctttagtttcggttggtattaccaactgcgactaaagatcttttttagtcccggttcaataagtcgtggggttcaagacagaccccaattatttttactcccggttggtataaacaaccgggactaaaaatagatctttagtcccggttgtttatactaaccgggagtaaagagtaccccgaaccgcatgccagatattatccgcgtgccaccaaaataattgtttataccaattatttttactcccggttgatataaacaactgggactaaaaatagatctttagtcccggttgtttataccaaccgggagtaaaaagtacaccgcgccaccaactcacatattatccgcgcactcctctcgatcttctcccctctcattactcctccatccctccctctcccatttcccctcccgttcctccccttcccctctttgagcggcggcccggcgagcggtagcgacggccgggcgggagcagcggcgcccggcgggagcggcggtggccagccgtctgggtgcggcaggcgggcgggcgggctggcgcggcaggcggccaggcgggcgggtgcagcggctggctagccaagctcacgcagaggccgtgaggacagtggccgggagtccggtggcgccctcctctctgctaccgatttttttttaatctgtgattcattggatttgatctgtgatgtatgtgatattggatctgatctgggagttgtgatgtatttcttttaggatttgtgatgtattttttgtttgagattttgtgatgtgatgtattgtgatctgtgatgcatttctttccaatatgtgatgtatttctttccagatctgtgatgctactttgattgatatggggatgatttgggaatatgatcgggaatatttagggagcagatcgatttgagaaaaaagaattaaccgagactgctcctaccatctttagtcccggttagtgaaacaattaaccaggactgctcctatcatctatagtcccggttggtaactaaaaatggatttttagtcccggtatccatctttagtcccagattcgtagtcccggttatataaccgggactatagggggttcccaaccgggagtaaagcccctttctctaccagtgagatagtcgaaattgacgttatgtagcaacaactagaaattatatttgcgagctgtgtcatgcaaatttcgataagaacaaaaagggcggctgcagacaacgtcctgaatacacacaatcgtttcatgacaaagaacatcctaattgttatcgaatggacaaccgcgtcatattgaaagacgtggttctctcaacagtagtgttgaaagtaaagacaattatattgcttagtaaaaattttttgatcccccattacatggccatagcaggctatttatagtcctattacagacttcccctttaggatttagattttacaggggaatttacatggttactcttatgataaggaccacactagaggtacaaagtgtcctttacatgtacgggcccttactgggctaggatggcacggcccaacagtttatcgaaactccccaaaggcgcaacggcccgctaggccttcttccggtggggttggatatacgacgaagcccatgtcttcacgcctaggctttcgcccgtacggccttccgacgaagttcatgcttggtggagcccgcgtgttttttaagccatggctttcgccatgtagtttttgcccatatggctaccctctcgatcttcgctgctcgcctccggctcgagtctgttgcccaggttcttggtttcggtaggctcggccgaaggctctcatagtgtacctccaacactaataaacaaaaaatcattctacaataatacaatggatttgctaaatggtatttgatagaaaattaggatatattttctacaaaatccttcactaccaaaatcacgttaagatttgagctcgaactcttcctccagctttgaagaactcttcttctctagtgtcagcaacaccccaactccgatagagaaccaggtgttatcatatcaagatgaatctcaaatcgatctagaccgtccaaaagcctattgttagtattaaccttaaataatcgtttgggctggctacaacagtgcatcggtcagcaagtaacacacccttgttgatgctgctacaaatcaattgttctgtgtagatttgggctgactagctggctgcgcacatagcactaccgatcagcctcattatagtcctagaataagtttattttaggccccttaacttcatagggagttcaattttcatcctcgaaccgaaataccatatacaataggtacctcaactattaaaacctgtgtaatataggtcctatggtaacatagcgagtgattttgtccgagtggcaagttgacccgagtcagcgttggctcccacgtctcagggcctctatgcggccggtggcgcgcgtgacgtttccctgcgcctccacggtatccaccgtctcccacccacaggccacagttgccgttggctcagccccacaaagggacaccgtgaatccgtgatagtggcgctagataacaccccgggtgacgcggcgtgtgtggcatcctcgatgcccactggcttgtgcagctcaccgccaccacagccatcgccacgcgggcaccgtcccgcttccagctcggcaaggccaatgcggagcac

SEQ ID NO: 1457 - DNA, 3610 bp, Oryza sativa
tggatcccccatattttttggctttaattttgttaatttgcagtctttgaatcgtaggaataaaaaaacaaaggaataggaaaaacacagaattctgacaggaatacaattgtaaaacagaggattgcaaaacataggaaaaacacaagaatggccgtttgattggaccataggaaaaacgcaagaatcagatgagagagatagactcagaggaaatgttccaagaggttagacctcttgctaactttcctccaaaatgtgcataggaatacccattccttaggaatttcaaaggattggataggatccaatcctttgtttcaaaggccttcataggattttttttttccataggattgaaatcctccaaaattcctacatttttcctacaaatcaaagaggccctaaatagtactctctccatttcacaatgtaagtcattctagcatttcacatattcatattgatggtaatgaatctagacatatatatctatctagattcattatcatcaatatgaatgtagaaaatgctagaataacttacattgtgaaacggaggaagtagtaaaacaatgcccaaaacgctgcagaaggtgaaccgatccattttccatcgtattcccgtccaggcgtccgcgtcgtcgtgtgtagtcgaaatcccgacgccgcagcctcttcatctcctctccccagtctcctccggcatccgcttctatttcatcgctgatgatcggctgatcgccacgcccgtttttagttttactataaaaaatttactaggctactagagccccattttaatattttgcacgaggacccgattaggccaggatgcccctggactgggaaaagggggagcggtagcgaccgaggtgtcctttgtcagaaccggccgcccaaccctcatccttatcacgagcgatcgcctttgccctagtcgttgtcttggacggaggtgatgacgaaggagttcactcgcttgccgatcggccccaaatgaggtgggacgatgactgaagcgaggcatcccgacactggggggatttgggcagcaatcggcgctgcggtgaagacgaccaagctgacgtgctacgttgccgaagtaggcggcagagcagagcagtcggcgctggatcctctccttgtcgttccaagggagtcctccttctactagacatcacgtgcgccgcaggtccgtcaccgtcgttccccggtaggtggcatgggcccacactagagccgatcttctcttcactggcttagggcctgtttggtacagctccaactcctaaatttagctccaggagttgagtctggagtggagttgtggagctgcctaaacccagactgccactactctagttcattttgtgagagagctccacccagctccactcccagttttggtggagttgaaactgtttggctgagctccaactccaggaggggtggagctggagttggagctgtgccaaataggcccttactgctctctgcttcgtgagataggactgagggagggagagagagaggtgaagagattctgacatgtgggttcatgctgactcagtgctgctgactcatgtcaaattgccacgtcggataaaaccatccgttataattccatattacaccggttttaataattgagggattcgttctatctgctattttggtttgagggtgagaatcgaactcgttgagttaaggtacctaaaatgaacttattcctagccacgtaaatctcaaagtccaaaagttgctaaatgatactgtactaccgtccgattctgcctcagcaggccgcattgatacccatttcacggaaaatgggccgggcctaaccagcccagtctaaactttgacgacggggtccgtctatgccgcacatatccccccaacattgaaaattccaatccgccgccgccgtcgccgccgccggtcgcctccatcgctgcaaacccctcctcctcctccgccgccgccgccggcggccataaccaaaccgctcctccgagatgtcctcctcgcaatctctcctcctcctcgcggcccctctctccccacccacccttccccgcctcgttccccctcctcccacctccgctcgccgcctcccccgcctggccgccaacctctcccgcccgccacccctcgcgatctcctctcctggctgtgatggcggtggtggtggcggaggaggaggaggaggaggtgggtggtggaggcaaggggggagtggccctcctgaccccggcgacgggtggtggcggtggctccagtcgctccaccccgagctcctcctcctcttcgtgctcctccactcgggcgccttcgccgccatcccggccgcgctcgccgaggccatcggcggtagcggcggcagggagggagcgagcgtctgggaggtgaggggcggtgcgcgcacgctgctcgtgccggacccgaccgggacctcctacgtcgtcgcgggagacgggaggcggaagcaggcggagggggaggatgcggagaaggccggtgccggccgtgccgagctggctgcgctgcggcgccagctggagctgtcgtggcggcggtgcgccacggtcgccgttcagctgctgctcccggatgggtaccctgacagcgtgagcagcgactacctgcagtactcgctgtggcgcggcgtgcagggcatcgccagccagatcagtggcgtgctctcgacgcaggtacggttgtggcgcctgagccgcgtccatctgtgtgcaattcaccggctattagttgaaatgtgccattttcgattggtgaatttgtgtatttatcctgtctaggcattgttgtatgcggttggattggggaaaggcgctatacctaccgcggcagcggtgaattgggtgctgaaggatgggttggggtacctgagcaagatattgctatcgaaattcggccggcatttcgatgttaacccaaaggggtggcgattgttcgccgatcttctggagaacacggcttatgggctggagattttaactccggtctttcctcacctgtttgttccaattggggctgccgctggagctggtcgatcagcagctgctttgatacaggtcagaactgttgattttgatatggattgtcattgttgctgtaccccttcacctgtgcagaccatatttacccatttcatgctggaaaatgcaaaccatatgcgcaaggtcatattgtttcatgtgaaatctgctgcagcatgtcattttcttcgtattatgttccacctacagatttggtcagcattgttcagattacacttagtatggaaacatgtgtcatccaaatttgtagttaggtatcatattttggcattaatcatacactgaattgaacgtgcaatatcattctggtagtccagtttttttgggatattttccaatatattatctcctcctgacagatctgtactgcttgttcggctttcttgattcttcccctgtttttgccttgtctcctgaatcttgctcactacataaagaacataataactgaagatatcctgcttctaatcatgtcctgcatacctcttcactgaaattctactggatgcaataggagggggatccact

SEQ ID NO: 1458 - DNA, 2991 bp, Oryza sativa
ttctactggatgcaatggataaatcagtaaattggcatggataggtggcagatggtatgaccgaattatgggtgatttgaaatgttgcttactcttgtggaatgctttgaaattattactctattctgcaaatttgagcctgactgcctatgaattgatttttatggtgcttcccaacaatattttgtacttgccaattcattatttttctttgaaccactattagtgcaatgattcaattctgtaggctgccaccaggagttgtttctatgctggatttgctgtgcaaaggaactttgctgaggtaaaatcaatctatcctcattcatgaaaacaaatcgtttagcatgtagatgtcattgttagaataatttttgtttctcatgtatgagccttgcaatctatatccaatcctacgggtaagctgcagttatatcagatattgctgatactatttttacgcaagaaaatatataccattgcgaacctttaatgttctgaaaagatgccactgtactttttattttgctcacactggaccaaattactcctacctcctggtcttgttctctgccttttgctatgacagcattgtgtggactatagcattggtagcaagtttgtctttgttgctgaattgatgacttccgctcctggattgcatgcatgcaccacctttgtttgctgctctccattttttttcttcgtttgatgtccttttcacagttcactatattgcctgcaccaggaatcctcattctttcctattgggtatatacattacaattataaaccccacaggcagcggttcggtacataggtataattgcatcgcccttgtgaccatgtcaattttttttttttgggttaagtttcaattttgacccttttttctcatcgaagtggcactttggacaaggttttacaaattttatcattggaccagtggcccaaccgtccgcgagaaaaaatgggagtggcatcgtttagtggtgatggtgtggcatcaatgaggaagccgtgaagcaggtgatggcaggggcagcatcacgacaccaaggtgcaccctgttgaggtccagttgaggatgctacacctgaaatcagggagtgcctgtttgcttcagtgatgctggtggtggttgcctaatgtgagatattgagcatgtgtgctaagagcctaagagttgttaaggagccaatctagttttcacacgaggacaagcatgttagcatcaactgcaaggtgcttaatgtgtaaggaactaaggacgatgtggatgcaaggcacacttgcacatggaccagtcatctaaagtgcaactgtttggtaacaaaacctggttcgaacttcgaagtgataaaacttttcaaaactttgtccaaatgccctagattttttactctgtgcccgtgttgtattcttatgagggattctttttttttttttagaaattgaacttttaaattcttaaatttagtcaattcaacctacgcatcccactttgcattctgacccaagtagttaaataccaattggatcttacatttcaggtcattgcaaagggtgaggcacaaggaatggtcagcaaattcctggggataatgctagggatagcattagctaatcgcattggctcttctgtatcattagctcttatttcatttgctggagttactgcagttcacatgtattgcaacctcaagtcttatcaatcgattcagctgaggacactgaatccttatcgtgcaagtaatgttttatccactgctgcttatcccgttcagtagttcctttataaccttcatatgatcacaactcacaatttttatatgaataatgttgtttaattgatgttcaaacacaaataaactggtggatggatcaatatattaacaatacatacaaataccaaaactgcactgtagctgattgaactcagcaaaacatcacacgattttttttttaaaaaaatcacgttttgtcactattcttttgggtaaatatcgatatctcccttgcaatgatagcctgcaaaattgtccattgtaagtgcatggcagttgtcactgaacatgtgtatgtttttctagaattgatggttgaaatcatattttgaattgtaatttttttgaatggatgattgaaaactcgtgaggtcttgatggtcagctttgcacagtatacattgtaatataaaatggactactctgtagattaaattggcagtcaattaggaatcaatccaacagcactgaaagaagggtatttgcattagcaaagtcatgccagatatctggttttaactttactgatccaacgatcagattaatgatgttgtggctccgcgtgagatgagacagcaaggagagggattttgctggagctaatctgtgaaaaatcttggtcacttgtgttttccagattatttagtgtcttggtttgctgtggatgagagatggcattgactacagctaggcttagcctctgtttgcagtttgttgtgttgtgataaatgtgtgtcttttctaagtcatctagaaatgtaaatatataatcattgtagattattttattaatcattttaaggttaagacaattatgcaactttcattcccacaaaacttccaactttttagtaggtattaatattaccgtttgtaacttagattatcagaattcacctcaatggcatacggagccttagtgaggattaattgcataagtggcctctcgcaaggcagcaattgtgtcataaaatcatccagttttagtgggattattctgtctttccttggttttcattactaatcgataagattaactaatttatctgccgccctcctgtctcacaggtttggtgttcagtgagtatctattgagtggacaagttccttcagtcaaagaggttaacgacgaggaaccccttttcctgaatctatctattggtacttcacgtaaagtaagtcaagcatttttctaacatcaaat

SEQ ID NO: 1459 - DNA, 4439 bp, Oryza sativa
ttgtcggcggttgcagttgggttctaaacttagtgaaataattgagaacaaggaagatgcatgcgcattgtttgatctctacaaaaacgaacaataccttcttacagaatacaagggaaaattttgtgtgagtttatcttgaaccaagcagtttcaagatgccattctgctatcatacaaagttactgacattttaccctttgatttacaggtcatccttaaagagggatcttctcctgaagatatgctcaaatctttattccatgttaactatctctattggttggagaaatatctgggcatcaaaccaagtgatgttgcctcagcgtgtagacctggtggaaggcttgaagcatcactcgattatactcaaagagaatttagccatgtcaaacttgatggttcaaatggtggctgggtgatggatggtctgattgctagaccgctacccgtaagaatacgcataggagatgctccttcataaaacttctcaacttgttttgctcacatcgacgccgctagaatgtgtacagtgggttcattctttgggcaatttctgagaccttgtcatcatatcacaaataatttggacgctttctccagtgaaggaaaacaggccagcgcgtcgggagtcatggggtgatttggcatcttattaacaagcgtctgtgaacatatagtcttcaattgtttggacacatgatctaaccataagagtttacaatcaagttctcataagattggagctggttatgtctttttttttttcatttgaatgtagggtgtttagtttgtcgacattcatgtcatgtagtggttgctcaggaaaccaacagcacttcttggacagtaatagagaattagagataaagactaaccagagctatgcttgaggcaagtacttctgattatagttggctactcctacctgttgcaaataataagtgcaattttcataacaacaatgtatttctttcttttcattattgacttcttgagttttagctcttaaaaggatttggtctccttgatcctgcgctgaaggcatggagtgcaggcaggtaataataatcatacggagagaaagcataacgtggtttcatgatgctggatgctgcctcactctgtccatctgttgacattttagattcaatgaggcggaacgaacagttttttttttttaaaaaaagaaaatatttctaacttatgttgatggatactccctccctatatcccaaaatataagggtttttaatagatgagatatatcatgttcagatttgtagtagtagaatgtatctcatttattgaaattccttatatttttgtacggagggagtatatggatattcaatactaagattatctggataggatatgcaatgtagagattatatgcttgtgatatgcaattttggctggaataaatggaactagtcaggttggattatggggtgtcatccggtgcagaccttcaggaccatttttcctttacctgtttgacaaacaatatgcttggtgagttgagggcatcaggctggttacaaagtcgtgtatagctcgaaataaagtcgtttttggaacggagagagatagtataaaagtagtgtaaagataacatcaaggccccatttataacattgaaatttcctagaaattttacggaggatatgatcattccccacatgtataggataattcctcacttccagtcagggactaaatttggacattagtgtatcccttataatcttatttcaaaataatgaactaaactgaattgaaacaaacaactccatatatcatcaaagaaagaaaggagagaaaaagttaccaaccgaaaatgcccaacaatgatatgctcaggcgatggccacacaaaacgaccaagaacataaaacctatcggtgaaattcagctccagatcacgattcctgtcagcaattgggatagtgctaatgtcaagggacgtctctgcagttctgaataactgctaatcctctcctcatccttttcagaccgcatttacttatcagaactcaacttaatggttgcaaattagagcaagtagtttaatagtatggttggttgctacttaaaaagtccgcatcgccatcggcacagccacgtaaaaaggagatatgtacaatagctggctagtggctattgttatacctttatacaaatatcaaaattatattttaatcaaatatgcgacttcattactcaacaaaccttcatcttgttggtcacccataggttaggcattagggcacccgtaatgattatctataggctctctacaagagatccatgtcagcatatttttctacttggaagagattaaatgaagagggtgagtaaagctatctactaacctagagataacctatagagaaaaacgaggcaatgcattagagagctatagatatccatatagacatactattagacatactattgaggtggtttactctattgctgagatgtacatgttttatagagagcatcttactttaccaagtgggtgctcttagtagatcccatggcacggataggagagcttgtgctagcgctggccaaacaagcgcctacgtttctctctcttaacacaccctctctttcacctcaacataataaaaacttgtttattattatagctgatgtaaactgatataaaccaacggtataatgcatatgggtttacatgtaaacatatgccaaatgccatgatttttttttgttgagccaattgtcattgtgttacaaactatcgtgaatttttaaatacattgcgggtttagaattgttctgactgaattgtagtcaagaatcacatatgaatacatcagcacccttgctagcatggattttagattggcaattgggtgaggtttctccagaacaacatagtaaattggaacggattaagtgaacatatgaagatttaatagttctacaaatgctgcatgagtcttctctctcatagctatgtaatataagtatcatttttccgtctcagcattctgcattaaaacttaaaaccataaaaaaatacaatttactgaacaaaaataaatcgtaaccctacacgagttagtcaccaccaccacaaagcccttcaaatctcctgcaataacctagccaaagccacagacaagacttcaactctgcaagctttgtaaagtaacagctgagaacaggggcgggcctaggattttcaacttgggtatttgaaactggaagagaaatttttttcaacataaagtctaatagctgtataatatataacggtataagcatgattttttaaagttatagattcatataattgatcataaattgaatgtgttaagcatattaaagtacaatactaaagttttaattgacaaaacatattaaatttatagagcatagaaaatgaaaaaatgataagaaatcttacaatttagataagaactttccatttcttgatattttgaaaatgagtaatgatgtctatatccttaacttggaagaatagatcactttcaacgaatgtaatcaaacaatcattcaaatattcttatcccatcttgcttcttaacttgtttttgagttctcttatttgcaacagctgtttctaaaaaagcctttaaattaaccgtgggagcatttttcctattcacgtttcaaacctataaaacaacaatatggtcttccaatttaagtactaactatgctaactctgctgaatatgtgcactgatgcaatttataagtactaactctgctacaaagcttcacaaaatcagtgaatcacaagtttcaaagtttgattgttcaatcatgaaccatccctgaatgactggattcaaatcctaaataaaaaatgttcaacagtgaaccattcctagattcaaagatatcctaaatcctaaatcaaatgaaccatcttggattcaactatgaactaaatactaaaatcctaatccaaccaaattaccaaaatgtttctaaccttccaccgtcgtgtgggtctggctgtctaagtctaaggcggttcagggactggaggtggactggtggagggtggaggtacgggcggcagagtgcgggcaccggctggcccaccacctgggagccacagggcaggggcggcggcgtgtgggcaatggcgccttcgtggcggccggcctaggggcacggacgcgtggcgtgagattagcagccgctgctgcgtcgcagctggctgggcgctgccgccgttgaggaagggggtgggtgggaggtgatgtgccatcgtgtcggggtcggggagggggccagggtgccatgccaaggaggagattgggaaggagagctggagaggtaagggttacatccattttgggttgatttgtgttattgggccaatgggccgagtagaggagggaggtgggatggtgctaagttaggctt

SEQ ID NO: 1460 - DNA, 4405 bp, Oryza sativa
tacatatgaaatatatattacatatatgaaattttttaatctaaaatcttggatattcagctgaatacccatgaatcatggtaggcccacccctggctgagaacacctctgtggcacatcgacatagcctatcacacacttacagaggagtaaattggtaggtgtgtgataggtgcagaagcaaacaaactagcgatggacatgtatcatttatgagtttgctctatatttttactttttaaaaattgtttgcttcatggtttaacacaatatttgtttgaacactggtacatatttgtatttttagaacagttacgcttaaatattggaagatggatttgttgtttttgcttctataagcgtgtgtggtttttactacatggtaagatcctacaattcacctaccatcacgtcttggtggtggtgtacgtgcgtagtagtagtatgtgtttgtgttggtgtaatcaaaacaaattttatacttacatagaaaagttatttaattcctcaaattgaaacttacacttaatcacagaaaagtaatgcacgtataagtacttaacgaaaaaaatagcatatgtaattattgagcaaatggcatggaactattagtctgtcgatagatagatagggtgcaccatttactgcttgggatgaccagagttagttcgaacttccctatcaactttcaaagcattgttgtcccacatgtgtccaactgtccatgtccctgtaaaaaatcaactattgtggagtaaacaagtgggatatacatatactgtgttcataatttttttttgaaacactgttcataatttgattaaacatagaaaggagcatctggtgcatttatttatagctgcttcatcctgtcacaaatacgtgttttttccatttaagacgatcacttctaatggtattatcattatgtgaatttttaacgatgtgaccagaaattaataaagtgagggggtgaaatatgttttatttagtcaaaactatgtatacactgtttcaatattgtttgtgcttgcatgtttacctatgaaaaaaaataaaactacgtacaagctatttcaattattatttaaatatcttattgtttatgtgacatccttataaacataaaaatgacatctcttacttaaaaatggaaagtcaatgctccctccatcaacatttatttgtattcgtggcgtttaaaattcctacacaaatgtaaacatttttcttgactactccaccttccaagttccaacgaaccatcattaattaatttatcttccaactacatgcttaagctcctaatcttgtccaatcaggaattgatacgcgctgagttcatgaaagtattttcctatcacgcataatatgtccttacatatattataaatgctagctatacaaggacaaattgacccttttcaaaaacttatttcgaaactaacccctgccaaaaacttcaaccaaaattaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccacgttctcctcgtccaatctcccccaaaaacctctctaatcgaaggtgatttgtgcggcattgagtttgggatcggaagagaaggtaaacccctctataaaccctaagttccccaaagttttattggatattttgcattgttttagttgtagacgtggtttgataatagttggctaaggatggattattagatggataatatgggtggggatgaagtgtggaggtggcatattttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcacatactgttcgacgaccggtacgtcccgtacctacggcgggcgaagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcgtcagggaattactaacgagtcttcgtattcatttgttaatttttttgcaattactaatgattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgccgttgctcgcggactgggacgaggcgggtaccttcagctgggggtcggctgccctagcctggtcgcttcaatgtgttttatttttgttgctgcaggtggtgtggatgccatatcaggcacaggaagtgcttgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccttcggaagaataagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatatggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacaccctcgacgtgcctcgtcctcgcactagaggtaggaggaggtaagtgcatggttcaatggatggatggatagatggatggacttgatgcatggttcgatggatgtatggactggatgtatggactcgactggatgtatagacgaggatcgatgggatgtttttatttcttatatgtatggacttcatatatggatgtattgatggattctatggatgtatggaatgatgttgggattgatggatggatgtatgttttgtatggttctctggatatattactgcctgtaaatttctgtgatttgatgtttgcctgtgtt

SEQ ID NO: 1461 - DNA, 6754 bp, Oryza sativa
ttaatttatcttccaactacatgcttaagctcctaatcttgtccaatcaggaattgatacgcgctgagttcatgaaagtattttcctatcacgcataatatgtccttacatatattataaatgctagctatacaaggacaaattgacccttttcaaaaacttatttcgaaactaacccctgccaaaaacttcaaccaaaattaggccgtcagctcagcaccaagcgcattggcgctgaggttggccgtgtcagcgccaacgggactggcgctgacattgtgcttaaatgattatcgatgcttaaataaaagttatacggttttacgatggagtgatgtgagcggtgggtggagggaccaatctccatcttagtagagatcatgtgttccttttatttggtgcctatatagtaaagcttccacttcgaaacaaaagatgattataaatttgaaaaattgatttttgaagaatattatagattcttttacttgttttcttagcaaacgctaagttcattaaaacttagagtaaaagacatggccaatttaagaccgctgtgtcactaatgtaatcgatcaacttgtaaatcatatatctagatctgtaattttagtttaatatacgactcgaggttgaaatcacctttaataggtcaagccttttctatttacccctgttcaaaacctactgtagaaacaaatatgcatttaatccattcgcttcaagttcatcctcaacccaaagttttcctctctcttctcctcttttgaattaggaaggggaaagcggcaatggctagggtggcacaaagtgcgacgagagtagggtgtactagagagaggaaggtggcacaactgttgtggtgtggtatcttcttcacgaagatgaggtccgtactggactcatgagatcaccctctcctactcttttttgatccgagaaccttcgactatcaataatcaccactgctctaatcattactccctacttcagggaggcggggaaccgaattggtggaatcgatttaggcatacaaaaggggctaaatacaaatttgttgccacggttatttatggtgtggactgaatgcaaaatgtttttctccgttgacaaccacggcagtacctttgattaaaggtagtttggaccacagttggtacattgaacaagatcgtggaccttgacttgcgatttataagttgatgaacctaagtgacaccgcagtccaagtcaccagtgtattttggtataataaatgcatttatattactactaaccttacacctactttctccgtcccaaaaagaatcaacatttctcaaaaagaatcaagctagaacaatgttgattctttttgggacagagggagtatataattagaaattaaaatatgtggcttataaaaatcgtagatgagcaggagcggtgtgttgagattggtagctgaaaggcctcttcttcatgacttccggcaccaaaactattaaacgccggcgaaaaactcaaagaccgcacgccatgtggggcctgctgaggcggagcagctcctccgggttctcgtcgtcgtccaccgccgaggaggtcaccgccggcatcgacggctcgggcctcgtcgccctcatcaccggtaagcctcaactgtactctcatcccctgattcttggttgattgactcctctgaaacatggctttgctcgtagaatttctgtttttttggtttggtagctaagtaattcatcagcttgcaaagtggtccttaactaatcaatctattagtgtatttctccaagtgattcatctattagagcatgcaaagtggtccttaactaatcaatctattggagcatgctaactaattcatctattagtgaatatattgtgtattgctccaggtcgtccttaactaatcaatcgagccacttcctccgttccaaaataaatttatttctagcttgtgataattgctacttctattatcttacctgctcttgctctataaattaaagaaattccattcattcgatatttgttacctattgcgaggtgatcgtaccttaattaggttacttgtggtggaactagcccactcgggttcatgtcctaaacttgatatgcatgctcagatttacggctatctgttcttcagtggtaagcgacgtatccatcgataacgggattcccgtggtgacttcgtcaatctcaagatatgatgaccaagtctcccagagatgctcataaagatagtgtgtgagttttcaagggtaaatgtatgtgttgtaagcgccttcgtttataccgtgtttttttagaaaatatattatcttctgtttcaccaatatttattttctattaatcagagacacttggttttatttgctcttcatgcatgctgattttgggactgatacagtataaagaaatcttagccgttactttttatttcctttatctattaacaaatatattttcacatcctaatttaataaaatacataacaaaaggaaaacgttagtacccatagaatattttccaaaatttaaccatcagagaattttaatagtggttgcaaggaattctaatgcacagaatgaatgtgcaaaacaaatattatactttacaaaagagataaatgaatgacttaaaaatcgttgattccaaataggagacataaaattaaaatatgattcagattataaatactagaattttgatatccattcaaatggattttttttctagtcaatcttagcattaatattctagtgtcgaatttgaattatgcggatttgaaaattctcattcaagattttcacaattcgttttgaacttctaaaagtatctattttgaagatttaaagctatatatgtctttacataatcatcctaatttgaaaaaaaagcaaaaaaaatatttaaatcaaagtttcgttataaaccaaagctttgttgttcaaaatataatttgggcactgaaatttttctagagattgattatgaagatttaagagtatcgctttgcataatcatctgaattttgataaaaatcaaacaactattccggaactatatacaattaaaagtaatttattttaacttttgttataaaccgaaccttccatgttcaatttttccgctatggaaatttttattcaatttggaacatgatttttgtatttttatagtattagaaacctgaatgtcaaattagttaaggaaaatttggactacaataattgcctttggtagaatttaaatagtaaaaaaatatatgatattttaccatccatgatgtaaatgcaacattaatccctttggtcaatgggtgatggatgatgcacagtaatttaatgcgccataaaaaaaatcctaatcaaattgtattgcagacctgaattactgttggcatcattgctgatggatatgtttcttgcaggtgcctccagtgggattggggctgaaacatgccgagtcctggtgatgcggggtgtgtatgttgttatgggggttaggaatttatctgccggtgcacgcgtgagggatgagatattgaaacaagttccgtctgcaaagatggagattcttaatcttgaccttagctcgatgtcatccgtgaggagatttgcagagattttcaaagctttgaaccttcctttgaacattttgatgtaagcaaatctatgtttggatgtacttcctccgtttcataatataagtcattctaccattgcccacattcatatagatgttaatgaatctaaacatatatatgtgcctaaattcattaacaactatatgaatgtggataatgctagaaagttttatattatgaaacggagggaatagtactaaattggctacattggcatgttttggtagaaagaaacattgcgcattttacagaactataattgcaacaacataatctgcaatgtagggattttggtgccgaacaaactggattgagcaatcgatctggctattgagagtttgagatattgaataatattaaaatactctgtaagcaagattaattgtcaatattgatgtttagctaggttgagcattaggacagtataactggaaggtaaaagtgactttgaaacctccactaaaaaactctattccatctctactgaatatgttttatctttatctttttacatattgccctatctttgactaaacaattttattctgctctgtttaaagaaataatgcaggggtttgttttgtgcccttcaagctttcagaggatgacattgagctgcattttgcaacgaatcacatcggtatgatccacttttacagtccttaaactccaaactgaaacttttgatcgcaagaaggttttgctaaaacatgaaactaaatttatactgtagaatattagagtttcagtttatttcaatccatggacttgcatgtttaccaaaacagtacatactttacataatttcacttgtacctcatcatatttgcctatttggctggactactcatcttacacccatttttggttacttatgtggaaaacatctgcttttgttgtatgattgcattcttgagttaataatgccatgcagggcattttctactgactgatcttttaatcgagaagatgaaagttacagctatagaaagtggcaaagaaggaagggttgtgatagttgcttctgtcagctacagtctctcttatccaggggggatttgttttgataagatcaatgatgaatctgggtattactttgcgacacaacacattttgcctcttttttacatgttatttaccttctagataaaacatgagaaaacaaatttgtacaagaacatcacattcaactatatatttttattctctcttgctaggtataacagattccttgcttacggccagtccaagcttgccaacatattgcattctaatttattatctagccacttgaaggttctcacttttctctttattttcctttactttgggaacacctgttgattcacactaactctagttaatttttttttgttccacacatcgtttgcctgttctgtaatcttataaaaaaatggtagtactatgttaaactattctgttgttaacaaaatcatgcggctctttagctgaattaataatacgaagttatcataaaaataaacctcctagtggtaaaacaccaacagaggatggaagtcaattgccctgttatttgtgtttatggagctgttctaagtacatgatatcagtgatcgcattactatttctaaaagcttcacagatttccttgatgataaatatttctctgctgaaaggaacaagatgcaaaagtaatagtgaactctcttcatcctggagctgtcgccaccaacattttgcaccactggtgtcccctatatggtaagaatatatctcacgagtgcaagttattactggaaaaataaagcaagttcaatactcatgaatgattggtcgaatctcacctcgtagaatgtttagtttgatgtatcgtgcctaactagcaactaatctaggtcttatagcttcatgacattttccttctacatattggtttcaagggctggaattttactactcccaaactcttccattagattgctaacccctgaactattttttggctaatttggttcactttaatcctcaatagcatctcccttatttgtttttctttacgcaagtcttattgtaagttaaaattttttaagccatacatgacaccattaacaaagtttttaaaaaatatgacaatttgcttaaaatttaagacttcgatgtttaagtcaacttactgcttccaatctctgtaaacagcagtgattaaaaatttcagaaaaaaatggagaggtaggttatacttcatctatcaacactaccatttttttggcgcaaaatacgatttacatagagagaaaaaagagaaataccgtatggtgcactgtttctactagttcagggttaactgctccaatgaaatagtttgagagaatgaaatgcattttttttctactgcagatagaaagttatattcttcctcttccttcttttttattatttcaggtgctatccgtgctattggtaaatattttgttaaaggtgttgaacaagtaagttttagaacattctttgttcctttcacaagataaaagtaacagagttctgttttatgttatatgcattatatgtattttatatgcaatctaagtccatgtgtttacttgataggtaacacatatttttttgccaacatttttattgcactacataaatgattttacaaacgacaaaccaattaacatgatccgaaccctgcaatcgcagcaccacacttcctcttgttatcaatcctgtcgaaaacccgattgacctcgccgagaaggctaatccctgcatacgaatcgaagaacataagcaagaacaaggtagattgcaacttaatatgtagatgaatgattaagattttaaagttggggtttcacaaaccaaactagcggcgaaacttcaatggcagaaataatttaagcaaaatccaactctaaactatgacaactattgaacaaatatgactgaagatgtcctagggttagtcttagggcacacacccccttgggcttagcccacaacttatagaaggaatctctgtaaatatgattagagacgtcataaggggtgtgcgccctaggactatccctaggacgtctctaacctaagtcgggcctcttgacagcatcaacttcaaac

SEQ ID NO: 1462 - DNA, 4635 bp, Oryza sativa
atgtcctcatcacctaccaccacacccaccatcgccgagctcgctagcgcctgatccgccgtagccaagatccttgatgccggatccgccgctcctgtacgcggccaccgccattgattccgtcgtcacgatcacttgaagcttgacacacctccaccacccgaagcaaccattgtcatcatcgatccgcagcccgaagcaaccatcgccgctgctagaaaccagctgtgccttcgcccagtggtggatccatagtgtaagcattggtgtcagcggacaccaatgacttcttactaatctctttgctaatgcactctagaaacaagaattactctcttatatatatatattgacaccaccatatttcagtaatgatcccaatgactctattttctggatccgcccctgccttcgcctctcgtcgctgccactcggaggataggagtgggatgagggagaagggagagtagacaggacttagagaattgaggagactcagacaccactttttgtagagttggtgttatattaaacttatgaagtggcaaaatctccttgaaaaatttactaattcataacctttttctgttaattgctcaaaaccactcatactcatacattcaatgcttatccttgtttgtttttgcagggtgcagccacagtgtgctatgtggcattgcatcctcaggttgctggagtcactggcaaatacttttctgactgcaatatcactgaactgaaatctcatgcgctcgacatggacctcgccaaaagattgtgggatttcagtctcagccaaatccgttgatagaaattgttgtcgcaatagctatgtaaagtctactatgggaaataaaccaaaactagttagaaaaaataaagtatctccaaagataaattgtgaatggagcactggctgtacagaaatgataaatgtaaagctgaaataattgctggaagagaacagatacaggaaaataagttcctgaccaactttggtttccaggaaaaaattaggtttaaactcattctcaacattaggtttttatgggacgaagggagcacatactaataggtaatatttgctacaggaaatcatgacaatctataaacgtggtaattagcccatggatatcatgccattttttttaatgtattcgatctgacaacgcgtgagagggcccacaattgtacatgatgaggcagaattgcccttggcatatccggcaatgttcttcctcagcttgatacaacacgagcacagtgagcgcgggcctcaacgtgttgaccgtgaaacgacaacgaggatggcggcaggactacatatcccacaacgtgactcatctacaggttacggaggatggcaacaacaaggagaatgataacgattagaacacgtttgcgtttgaggagagagaaagagggtttgcagtctccaatgctggccttggtggcaagatggtgcttctggagcgggctgacgatggcggatgggcaaatgactttagcggtggctcggtgaaattggaggggagaactagcttgagaggctgattgtttcttcgggaaggaggaggaagagaaaagaaatggattaatgacctcaccgattaaaatagatggtatctaagaatacactaaaataatcagcgtggtgtacacgagtaaattatcgtatttatagagtgtcttctctaaaactcatcgtatgatgtcctaaggttaaaatcacgaagtcacaatatttttggcaaaatttaccatactaataaaagggttaatgcacagaaggggcagtatgtgtgtttagtagcaaaagttggattgctataaaatttgctacataatggaaccctattggaccgtcttgatatgctaccatctcttataagtcgttttgattttattttacgtcgaactattgtaggtttgactaaatttatagaaaagtttagcaatattttcaacacaacctatcaacatatatttaatgataaatttaataaaactaacttacattataagttttgttattttttccgtaaatttggttaaacttctaacttttttaaaaaaatcaaagtgacttattatatgaaacggagggagcaaatgagtttacaaattgaccaatagccattcgtcaacttctatggagttgaaccatttaaaattgaaacgtcttacaaaacaggagtattatacgtttgattggaagctgaaacgttctatttaagcaagttgagtgtcttaatttaagccaccggccggaagctgttcccacttcccacggcagcacaagacaatgtggggcctactgaggcggcgaagcccctccgggttctcgccgtcgtccaccgcggaggaggtcaccgccgccgtcgacggttccggcctcgtcgccgtcgtaaccggcaagtgaactgtactctcatctctcctccagcagctggtcgtttcttggttcggttcatacttcatagcgtcccctggttctcggttgactcctgtttcttctgaacattccctgctcgaatccaagaatcgttggtctgaactgaaattgctcgaggaatttagtgattctcttcgatttgaggggaaattggcaaagtttactgttcggtgtataaaaatcttgcatattgcagtagataaatctggggggaaattatgaaagatgatttatatgctaaatgtatttatagttttaccaaccattaatcaatttttccccaatatttactcttcaggctgatgcaagcagtaggagtaaatcttgcatattgctccaattcctgcttcgttaatcgaattttgtactgaaggcctgaaatgctggtggaatagttgctgattggagatgtttcttgcaggtgcctccagtgggattggtgctgaaacatgccgagttctcgcgatgcggggactgcatgttgtgatgggggtaaggaactcatctgccggtgcgcgtgtgagggatgagatagtgagacagcttccggctgcaaagattgagatgctggatcttgacctcagcttgatgtcttctgtgaggagatttgcggagaatttcaatgctctgaatcttcctctgaacatcctggtgtaagcagatctaatgtttatgtatattggaaatatttggtagaacaaaacattatgcttcctcgcaaaaagaaaaaaaaaacattatgctgttttacagaattattgtagcagcaaaaccttctgcaacatagagaatttgggtgctaaataaactggaatgagcatttgagctggctattgggattcagacactcaaagcatgcttaatagacagtatttatgtattactgggttatgtcattagtacagtcattttctggaagataaaacagtccatcagacctctactaaaaaacttttattccatctatgttgaagtgttctttttttacattgcctttttttggcgaggaatacgtcatccattttatgtttgagaaaatagttttagtcttctctgtttaaagtaataatgcagggattgcgtttgtaccatttaagctatcagaggagggcattgagctgcatttttcaacaaatcaccttggtaggccccctcttacagtcccttaaactgcatactaaaacttttttattttaagtaggttttgccaaaattcatagaatattattgttttattttctatttgttactaagacagatgtactttacacatttgtgtgtggtcatatttcacttgactgatcttgtaaccatgtttggttacaaacgtgcaaaatttctgttattattgtgtaactgcatcgtgcaattaatcatgcaatgcagggcattttctactgaccgatcttttacttgagaagatgaaagttacagctatagaaagtgggatagaaggaagggttgtgatagttgcttctaacagctacaagcacccttatcgagaggggattcgttttgataagatcaatgatgaatctgggtattactttctgacccaacgtatactcctttttacatttgtttaccttttcaatcgatcaaaggtaagaaaacagatctgcacaaaaacatcatattcgaaattaattatttttattctctcccgctaggtataacaaaatcttcgcttacggccaatccaagcttgccaacatactgcattccaatttactatctagcaatctgaaggttccacttttcttcttgttttcctttaagctcgtatttggaacaactggtggttcacactaactcttgtttatttaattgtacacactgtttgtcctcaaaattacacaattttgtaatcttgtaaaatggaaaagaaattgtagtaggctatttttcttgaaattactaactgtaatatgttagacatgctgttaactaaatcatgtagatctttggctgagacagtaatatgaagttatcacaaaatagatctcataatagcaaagctatgcagaggatggatgtcaaagccctgttatttttgttatggagctgttctgtgaatagatgatatcaatgatcgcattactatttcaaaaagtttcacatattttcttgatgatgaatgtttgtctgtaaaaggagcaagatgcaaaagtaacagtcaa

SEQ ID NO: 1463 - DNA, 4196 bp, Oryza sativa
ttgaatgaataatgaactgggaaacaatgcacagtgattgttcttccttgttttttaatttcaggtatgctatctacacttggtaaatttttcgttaaaggtgttgaacaagtaagttttggatcattttttttctgttcctttcacaagactaaagtgacagagttgtatttactatttttactgtatattcaatttaagtattttattgcgtatgcaatttatgtcaatttcattacatatgttcttgtgacagttatattcactattttattgcatattcaatttgtattttattgtgtatgcaatttatgtctatttcattacatatgttttctgaaacattttattcaacagaaacacacaaaataattctaaaactttaatcctagtactagtggtaagtgtacattctaaaactttttgactgctcctaaataattggatgtatcatggaataattaacctaataaatatataaatatggaaaaatgtatttattgcttatatcattcaacatcttcctgcatcctgataaaacaggagctgcaacattaccatgactctaccagggactatctttcggagagctaatgttattaaatccatgaactaactggctccaggacaaagtctccttgaaattttactaattcagtaattcataacatgtttaattgtgcaaaccatccaattaccaacaaacaattgtgcaaactatccaaacacataatcactgcttagcattgtttgtttttgcagggtgcagccacagtgtgctatgtggcattgcatcctcaggttgctggagtcactggcaaatactttgttgactgcaatgtcactgaattaaaatctcatgcgctcgacatgggcctcgccaaaagattgtgggatttcagtctcaacctaatccattagtagaaactgttgcaagtggtgtgtaaagcctattttttggaaacgaactgaatcaagttagggcactgaagtgtgtgaagaacatgataaaagtatttctacaaaaattgcgaatggaggacatgttgttaatagatgtgaaatttatccagttgttcggtaggtgtgatatcaaactgctggaagacagcccgaaccagccacatttgtaaagcttgaataaattgattggatgtacttcttcatatgtttgtacttcttcacagcgtttgtggtaatacatcgcagtgaatactggcacaggccctgtgtacattccatcccaaaactttatgccaacatcgaacgtttgaacatctgcataaaatattaaatataggctaaaaaataactaattgcacagattgcgactaatttgcgagacgaatctttaagtataatttctccatgatttgacaatatggtgctacagtaaatatttgctaatgacggattaattaggtttaataaatttgtctcgcggtttactgacggattatttaattagtttttttattagtgccgaacaccccatgtgataccctatataatatctgatgtgacactttaaaactatacacccctgaatctaaacaccccaatatataattacctcacattcacgaatggttgaatgctatgttgagaaatcaacatcgtcatacatttcaatatggagggagtaactcctacacgtgcatgatttcaatgttcaaagaccgttttcctggactccgatgaaagtttagtagtgtaaaacattaattttttttcctttttaagtatatattatatgccaaaatattttagtttagtttttctgattaaatcatttcttagtttttccatgttttgatctttgaagatttcccacataaacacatctgtttatggcattttgtacttttttcgaaccggcagtttctctcttaaagtgtctttttaaagcatataatgaacctttatgacctctgatttaagaacagtgttccaaaccagtatggctttttgatgtagaaaccaatgtattttagttaacatccatccagcccaagattacatgatctgcatgcttggtttaggtggcgtttggatacagtactaaattttaagccactgccatatcggatgtttgaacactaattgaaagtattaaacgtagcctaataataaaactaattgcataaataaaagctaattcatgagataaattttttaagcctaattaatccataattagcacatgtttactatagcatcacataggctaatcattgattaattaggctcaatagattcgtctcacgaattagtccagggttatgaaatgagttttatcattagtctacgtttaatacttctaattagtgtacaaacatctgatgtgacagggactaaaatttagtcccggatccaaacaacaccttaatacacattccgttttcactaaaatcttggcaaacataatttttagagaaaaggctcactgcccaactttatagaaggcataacagatgtctgaatacacggcttgacagccagagcaagttcaccggcgcatccggttttacaatcctagcacaagcgcagagcaaggacgagccagcctactcctgcaaactagacctaagccaagcaaaaggatgaaagggtgtgtttagttctaaagttttttcctaaacttccaactttccatcacatcaaacctttcgtatatatacaatttttcagtcacatcgtctctaatttcaaccaaattttaaactttgggccaatctaaacacagccaaagaaagaaacagattctagtaagctggatgctagtaagctggcgcaggcgcgcagctaaaaattagaaatgcagctgtagtaggatgcagctggcggcatcaagcacccggtttggctcgttggcacgaggattttgcgatttcctgggacttctcattcttatcacattttatagcataaaatgggcaaatgaaaaatgaacttgtaatctgtaccagtatttcaggaaaaatacatgcatggtggtatgtatatattgggagtagtggctgtgctgtagctagactgctcaggtattgtagtatgataaatgatgaagttgtgggaccagaattgtaattaaggtatacaatgtacattattcacatgtacatatttatgtaattttgtttgattttttttttggttatcaaggagttactgggcaacaaaagactatctaatattagtttctgactagaaccattcttaatttatcatttgaaaaaaaaaccattcttaatttatagaaatagaatattcatgatcagtaatcaaatttctagctagtctaatttgtagttgctagaaaatgtgctatacccacctggtacattctaaagaaccataaaattactcgttcaaaattgatatgatgtgttctttgctgacatgttaatctctagctaggaagtgaaagaaataagaaaatttgccatgaaggctacttgggatcacggcttagggttccataaaaagaaaggtatgatctaactgatcatggctttacccagaaaagtaacaatgactaaacgttaatctaaagaaaacccaagaacctgaagaggtccctagctatttaaggaggtgaagaggtgggaggacagcaaaggaacccttaaggtcgtacatcagcaagttaggatgcagcctacttgggctccatttggcctggggacctaaactaagttataagcccaaagacccatgataggtggcgcaacattttattattttaattgttggtgactcacaaggaagtttgagataaaatcagatctgctcgaaagaggactccacactactacggaaatcatctttcgtggcggccattttaggttttccttggcggagcaaaggcgagagaaaatattgatcttcgctagcggttatcggccgctagcgataatcgattttcgctagcggttgtattataccggccgtcagcgataatcgatttttgttggttgttgtgttataccggccaccagagataatctattttgagaaaaaaaaacctatgtagcttcccttcagccgccagcaaaaataaatatgcccacatgttgctacctgcattcccaaatccacatccccaaatctcaaatccataacaattcaaatccacatcagatccaacctcaaaagaacactacatcaatttctcacttcattttccacaaaca

SEQ ID NO: 1464 - DNA, 1953 bp, Oryza sativa
ccccctcccgccacctgtggcccggcccgtcgttgtggtcgccgtggtcatcgtcaccagtcgccgatggtccttgtcaccagtcgccgtcaccagtgggggcgcaaggaagggagagaggtcggggaggaggacaaagagatgaggtgggtgggtggtctggcagtgggaagaaatgtggtgggtgggtgggtagtggaagtgggatgaaatcggttttaaatgtggtgggtgaaggaatctagcgcgcattgttttaaatgccatcaaaattttttagcgagacagtgtttttcgctggcgggtctttttagcagccgccagcgaaaacgccgattttcgtaagaggtccgcctcgaaaaatataatattttttatggcggatctcttaatgtggccgctagcgagaactgattttcgctggcagcccgtgacctcccaccccccgattttttacgctggcgggtttttctcgtagccgccataaaaaatatttttcaaacgccataaaaaatcatttttctagtagtgccaagagttttccatgaagtactcatgggcctagaacggagcacgcatgcatatttgacaaccatttgaagcacctgataactcaaatgcctaaaattaattaatttatattccaaaagctttgtgaaatttatatgaaatcaaagatagccttgctgcactactactacgtggaatcaaagtgataagccagctgtaaggtgagagatcaaacaaagagatggaagttgcttgcattgcttatattgatacagcagtcggtagaactgctccatatatcgatgaaggattttcttgagctgattgtttgcttacgaaatatattaaaaactatagtaattattttgaactcatcgaaccgttgatttcttgataaaaaaatgattgcatagaaataggaaagagaataggaggggaggggcagcaaaagagaggagaggtgtgtgtacggaaataggcgaggtgtacagatcaatctaatctaagtatctaacgctggaaataggtggctttggttgttttcttattgagataaatctaatagtgcaaaataatgggtccaccaatttaaataaaaattaacggttggatgttttgcttttttctagaatttctaggattttctctattttattagaatgccatgtggcggtatgagagcgtttgtagaaagtttcatggacttatataatagatatgaatgtgagaaatgctagaatgacttacattgtgaaacggatggagtagaaaacaagtggtcctcacttaaaagaggaattccataacactcaagattcggtcggtgatacactattgtggaaactagttaagtgatgaccacttgttttctatcaaaactagttccacattttttagaaaaatacatttcactacaatcagaacccatatagtcattgattgatacgaccaaccctattatccatttgttttctacaccgtccaagagacattggacaagttcctaagcattttataaaatagtacgcagcccaattatcattcaaagctttaaagttgctattgaattgattcgtcagccattatatgaaagtatgatgctccagagaacacattaataagtgatcccacaggttactcatcgatatctacagactatccacgaactaccagagcataataccatctttgctttgttcaaaaatatctgaacgcactgatagaagtttcataatctttcagtgtccgcgaatgatttactcccctacaggttaattattactattgattcaatacaatctcccttgatttgtacctatgctgaatattcagcagtaatgatcttggttcttgctactgtaacggattgttatatatatattccccatatatgaactaggccgactactttctgctcccatgtgctactaacttgattgtggt

SEQ ID NO: 1465 - DNA, 7396 bp, Oryza sativa
catccttagggggccatgtcttttgaacctggtcttagagttgcttgtactcgtgatctcatcagagtttagctttctcttttgaccactcttcttgttgttgggcttgtgcttatgcataaccatcacatggttggagtttttcttaatgctttcctcggcagtctttagcatcccatgcaattctgccaaggtcctgtcaggttgttcatgttgaaattcattatgaacggctcaaagctgggagggagcgactggagaatcaaatcagtagccaactctcatctaaggggaaagcccagcttatccagactctcggtgtaaccaatcattttgatcacacgtgggctcactggattaccttctgcaagcctgcacgcaaattatcgtatgagcatgttacatagtcccgtgattatcgtatgagcatccaatgcctcatattgcctttgaagctcaggggacatagtagcaagtatgagacaacttatatcaagataatcattgcatcgcttttcatgctccctacgttgagcagcaggagcattgttgggcaagttagctggaaaaggctctgtaagcacaaactctttctgctcttgcctaagaacaattctcaggttgcgataccaatccatgaagtttgttccaatcaacttctctttctcaagaatagaccgcaagttaaaattggatggtgcaggagctgccatgatctacaatagaaatatatgtatacaaaatcagcaccatgtttgcatttaacctttcattaaacaatttaacaaaagatactcccactatgtattgtgaaacaaaattccctctagtaacatagtgagtcaagatcctcattttattagtgtctagtgagctttggcatcgcagctagacaactatcaaaataggtaagcaacaccttactaatcacatcattgtgactcttctgctgttggggtgacatcttcatatccaacccaacctatgccccaaggtccaaaactgttttgattaccttgtcaagtaaaccaataatctctgcatatagatgtccgacatctatcctattttatcatgataaaagtgacactttgctatggcaaactcatcacttatgatcacaaccgtaataggtgcaattattagaagagcataaattacacttaatttttctgagggaatctatcctaccatgtcatatcaaatatataacagtaataaagtaagatagatataaaaaccccaagcgaaatctaaggggcaacgcacacggcagtcccagtggtacatagatctcatctacgattcgccatgtgaaaaccttaacggcgtaatcaaattatgccgaaaccgagtcaatctcattggctcgtttttctcattggcgtgcggttccagtggacatcagactatccgatgaacacaatcgcgctcagccttggtgagtactaaacattccagtgaagtcaccaacacacataccgattgatctcatcaacccatgtggctatcggttcatctcatgttccgatcacctaagaactcatatacaacataatagatctcatctactacacccgcatatcaattatatgcaatgatctagatcataaactatacaaggcggctctgataccactgttgggatacgcgtaggctacgatagcatcaaaattttctatcgcgtaaactaggaaccatgcaagtattagatcatagatcgttaccactcgacgcgctgcgcaacggaagaagacgctgagaagtcgaaggaactctcacgaagtagcgcgcgtcgatgtagaggaagttgtcgatcataccggctcgaccttctcctcctcgtgcgttctcctcgccgtactcccacgccgatcaacatcgcaaaccagcggcgcctctaccggtatccacacgtacaaggacggaacaccacgcgcagatgtgctagcacccgcgcgcggctagggttttgctcggggagggaagtgacggctaaggtttctcacgtgatgcaatgcctccgccagtcacacccctcacgaatatataggatccatcactcgggcctccaaggcccataggactcctattcggatccctatccgaattaagctcatattggatctccatccaatccccttatttcggcccattaagcgtgcgaccctgtaggttcatatatactcggctgtaacccgaaaactccttttcggtccaggcatcaacagcggcccctagcagaacgtattgacccaccgaacatacataaagatcatatcggctgaacctctagtgtatacttgtatggacccatttgcctcacgatatggattaagctcaaggctagatatgtgccatcctctaatagctcaatcattcactcgaacctgttgatagattatatgacttgtgattgactcctcaatcacctttggcatggccatgcacttccataatctacaacatcgaggggcccagagatatctctccataggaggggcaaatcccatcttaattattcatatcccactacatgtttcatagcatacccgaaaactactttcataactacccaattacggagtagcgtttagcagtccctaagtaagctactacacatgttgggaaccatgataatctcaggtctaaggattcaacaccaacactaaatgagattactgatgatacaacacatatggctcttgcagtgtctcatgttgggtctatccaacaacatgttcactaacatgtgtccacattattaatttggtatctatataccatgatccatgagacatgatcatcaattaatacatgtgctgatcatctaatcatatttgttacacatatgatatttgatcagggatcctttagaaatagtaacacataatataaagagtctcatgaaagaatcacatattcattaaccaataatgagtttatctattttaagaaacaatgtcggataaatatgtaaacatagtgtgtgatacaatcatctttatgattgcctctagggcatatcactaacactacgctggctctacaacgtatattgattcatatgtaatgaaagcataaagacaatttcatttggttccaggagtctttttgaaacctagttccaggagtcttgatggctcataattatatgcatagtaccctttgatttacactagttgcaaacctgcaaccctcggctataaaatacgacagctaattgatcctgtgcttcacttccaggtgctatcagagtacctcaccttcatttcatttcctgcagcaacatctttgtagcggtagtgcatacaagacaggcagtacatggtttgtatagcattttaccgcgtaaatcaaatggtaattaaattgggcacgagagacctcagggaaggaaggaacacaggatatgatggagtgcttagttttcactcgaatgccacatttctactctaatatggcacagcagatttcattcatgccacaaaactactgcagttcttggcatgatcaaattcctgtgattattgcctgattgtactggcgtagcagagagagagagaaattgaacatgtctttttatttgaaaccttttggctaaagatgccatgttttctataagagtttataaaatcctgggtgataaagttctagcatgcaacctctgctaaagattcaccttaaactaactaggtggagtaatttgcatgttggctgcattcgcctgcgatttgttgtagctaatgagatcttccagttggatgtagcataggaagaaagagtcataactaatgctgaaaaggagcttagaacatatctaaagacaatagtggtggtgttgtatctactttaaacaagattaagattagacataaggcaaggctaacttggaccaaagaaggtgatgtcaattgactgttctttcacttaaaagcagatgccagaggagagaaagaattatacatagatgttacaaaccccatcaagggatgtaaccactcaagacaagaaagaacttcatcgttttttcacacaactcctaggggttccgacgatctcggtgcctgaactggtcggcgataaacctaccaaatgtatagctctactataagaccaggaggatacagcacaaggtgaattaaaggagactatcttctccatgccatctgaaaaattaagcccctgatccggatggttacattggggcctttttcaaacaagcttgggacatcattaaagtctgcaactatatatgcccgagcattatcgacctataactttgattcacagttttgttcgaattgtgacagagctacttgccagtcatttcgccccaatattgaacgaattgatctcgtataaccaaagtgcttttattcgtaaaagataaattcatgataattttctttatgtgcggaatttactgtatggcttttatgctcactactagagaaataactattaacgatagaaaatgtggtccataaaagtataaatatggtccaactttggttctataattaaagtatagtaaaaacgggtattgtttggctaaggctctatttgttttaccctaacattattgtaatctatattattgagtcagattactataaactggattataataagctatagtagatttgtttgtttctctagattatagtagattaagggtagtgaatctttaaccacccgataatctaaaaaagaaaacacgtttataggagattaacatattatactaatatggcttataaattataataatctatcgtaataatctacttgtttgttacagattattaccaataatccaaattataatattcctaagctaaaacaaacagggcctaagtcaactagtcgggataacttactagtctgttggtgtcctatcatcggaaaagaatgttttagaaggcaccaatctctacctatactaattggacactttctacgagctctcacgttaattaaaaaaatctgaccgtcaattcaaaggaggttaacatcgtgaccgtagatcaaattgatctatctccgcaaatcaggccgagaataacctcagatcagatcaacctatccgcatatctggccataaccagaaagagcgtggcaccactgacgcgttgacccggcgggcgggatgcaatgcaagcgtgttcacacggcgatccatcgatcgatctggggaagcacgcgctccagcggcggcggtcatgcatggcaatccatcgtgtatgcagcggcctcaacacgtcatcctccagccctctagccaatttcgtttcctggtgagatcatccgcttgtggttgtggatccgtacgctgctgcaatctagcctgtggatgggttttactgacggctgctaatgcatggcgtgcatgcctttttgcagttcatgccctgctcgcagaagtggaggagatcaacttttacagtggtcatcgagcaccagccaccaggtactttaatatatctaacgaactctttcacgtctatctgcttcacatttatcgtcctgcatgcatgcatacgactatatacacaaattgacaaatccttctcatacatgtatcattgaattcgtcaacaaaaagctggcgaaggtaaggcgcccccagtcaaataaccaagattggtttctaaattggttgttttgttgttcgtccaaaactcatctgcgtatgcttgcacctaataaaagtaagatctatatatcatcggcacatacagttattatagttattatgcttacacacattcttaatccatagtttttgttttaaaacaatgaatcataagtgttttgtttttccacctattaaatgagttgttttatagataatttcgacagccaaacccccataatttacttaaagaagattgaacattaatatatcataatttgttagcagataaacatatattgatccacattttttcttaaaacaaactagcatataatgattaactttccgtgccctgtctctgtaaacccgtatgcactgtatgtactctacaatatgcatattattgatttatgccattcaattttgatccctgaattatttttttcatcacaagtaatacctatatcgctaataaatatttcccattctttgtccaaatacatttctttgaatgattacatgattatgttcacggatatatataatttaccagcctattccatagttgtttttatttatcaaagttaaagtgtaacacaatggtaagtcttatggttattcacattgagaaggaatcaaggaaagtcaagagaagagcaattagactttaggagtcataatctaatcatgtaatcaacaatgtatgcatagataaaagtgattccaggtcctttttagagattaaagataaatgaaaaagactgtgatggccatcattaaataaggtatagttggatttaagattgggtgaaaattaaataagtgatccgatggggaaaataacaatataaaattccttatatttgtggataaattatgagccccaaaatccgttatgttggtggatagagagagtacttattagcctcgatgtcatacttatgaagaggctattagtataaatactttttcacgtacagatagtgttcatatttacatgtcttcccacttattttatttgttgcatgacaccatgatatatgccaataaagaaattctgggtccattaataagagatggttaagtgcacttaataagaagatgcttcattaacttcatgttgacctcaccctttttcttatccagatatcatattctcttagcatctctcatagctaggactgattgaagaaacacaacaaagtcgtggaatgagaaatatcaatgacattatgctccaaatcatgtaagtttaattaatatcatttaatccacataagtataaagtattggcagcagtttatctgaaatttcagcatgtgcatagttgaaacaatgcaaatcacactatatttggagtgacgagaaggggaaattggaaaataatttttaattcactagaaagtgtattgtttcatctaattactgacaggaataaacatatgtagagcatactatcatgatcgctaaatattaaattacaataaataaaatataattagtaatatttaatttttagttcatttggatgtttagcatcttctttgtcaaaagattcatcatcatgaaaatgtacaacacgttgttgtataattattatttttaatatttatactaaaatattttatttcaattatatttattaattaacacattactacagaaggttacaacttagatgcgattcttaccttttgattacaatatcaaaataatacaccattcaaaatacttaaattttaagattaagaataa

SEQ ID NO: 1466 - DNA, 527 bp, Oryza sativa
cattatggctggcgctgaggtcccagcccgcaagcgaaccagcaggctgctggtctgggccttgggggttgcggccaagtcccacctcagcgccaggtgggctggcgctgagtgtcccacggtcagcgccattatggctggcgctgaggtcccagcccgcaagccatccagaaggcttgctggtctgggccttgggggttgcggccaagtcccacctcagcgccagtccggttggcgctgagtgtcccacggtcagcgccattatggctggcgctgaggtcccagcccgcaagcgaaccagcaggcttgctggtctgggccttgggggttgcggccaagtcccacctcagcgccagtccggttggcgctgaggtagctgccacgtcagctggggatcggcccggccgccacggtggcacaatgtcagcgccagtcccgttggcgctgacacagccaacgtcagcgccaatgtgtttggcgctgaggcgacggcctatttttggttgaagtttttggcagtggttagt

SEQ ID NO: 1467 - DNA, 17687 bp, Oryza sativa
  unsure (1)..(17687): unsure at all n locations
cccaatctcgatgaggatgttttcatgacacaacctaagggatttgttgatccacaatcagctaaaaagatatgcaaattgcagaaatccatttatgggttgaagcaagcatctcggagttggaatattcgttttgacgaagtagtcaaggcgttgggctttgtcaaaaacgaagaagagccttgtgtatacaagaagattaataggagcgcactggtgtttctaatcctatatgtagatgacatattattgattgggaatgatattcctatgcttaaatccgttaagacatcgttgaaaaatagtttttcaatgaaggacttaggggaagcaacatatattctgggcataaggatctatagagatagatcaaagaggctaattggattaagccagagtacatacattaacaagatgttgaagaggttcaacatgcaagattctaagaaaggtttcttatcgatgtcacatggcattaatcttggcaagaatcagtgtcctcaaacgattgatgagcaaaacaagaagagtgtgattccatatgcctcggcaatcggatccattatgtatgctatgctatgtacacgtccagatgtttcatatgcacttagtgcaacaagccgataccaattagatccaggtgagtcactggatagctgtaaagaatatccttaaatacttgagaagaactaaggatatgtctctagtctatggaggacaggaagagctcgttgtaaatagttacactgacgcaagcttccaaaccaacaaagatgattttagattgcagtctagatttgtgttctacctgaatggaggcgttgtgagttggaagagttccaagcaagatacagtggctaattctacaacagaagccgaatacattgccgcttctgaagcagcaaaggaggctgtttggataaagaaatttgtttctcaactaggtgtgatgacaagtgcttctagacctatggacctctattgcgataatagtggtgccattgcgcaagccaaggagcctagatcgcatcaaaagtccaaacacattttacggcggtatcacctcattcgcgagatagtgggtagaggagatgtgaagatatgaaaaattcatacggatttgaatgttgcagatccgttgacaaagccactccctcagcctaagcatgaggcacacactagggcaatgggtataagatacgttcatgattggctctagtgcaagtgggagactgttagtgatatgccctagaggcaatcatagagatgattgtattacacactatgtttacatatttatccgactttgttccttgaaatagataaactcattattggttaatgaatatgtgattctttcatgagactctttatattatgtgttgctatttctaaaggatccctgatcaaatatcatatgtggaacaaatatgtttagatgatcagcacatgtattaattgatgatcatgtctcatggatcatggtatagagataacaaattaatgatgtggacacatgttagtgaacatgttgttggatagacccaacataagacactgcaatagccatatgtattgtgtcatcagtgatcttatttagtgttggtgttgaatccttagacctgagattgtgatggttcccaacatgtgtagtagcttacttagggactgctaaacgctactccgtaattgggtagttataaaagtagttttcgagtatgctatgaaacatgtagtgggatatgaataatcaagatgggatttgcccctcctatggagagatatccctgggcccctcgatgttgtagattatggaagtgcttggccatgccaaaggtgattgaggagtcaatcgcaagttatataatctatcaacaggttcgagtgaatgattgagcaattagaggatggcacatatctagccttgagcttaatcgatatcgtgaggcaaataggtccatataagtatatactagaggttcagccgatatgatctttatgtatgcccggtgggtcaatacgttttgctaggggccgctgttgacgcgtggaccgaaaaggagttttcgggttaaagccgagtatatatgaacctacagggtcgcacgcttaatgggtcggaataaggggattggatagagatccaatatgagcttaattcggatagggatcggaatagaagtcctacgggccttggaggcccgagtgatgaattctatatattcatgaggggtgtgaccggcggaggcattgcatcacgtgagaaaccctagccgtcacttccctccccgagcaaaatcctagccgcgcgcgggtgctagtacatctgcacgtggtgttccgtccttttacgtgtggataccggtagaggcgccgctggtttgtggtgctgatcggcgtgggagtacggcgaggtgaacgcacgaggaggagaaggtcgagccggtgcgatcgactacttcctctgcatcgacgcgcgctacttcgcgagagttccttcgacttctcagcgttttcttccgctgcgcagcgcatcgagtggtaacgatctatgatctaatacttgcatggttcttggtttacgcgatagaaaattttgatttatgctatcgtagcctacccgtatcccaacatgtaggtcatgtgatcgatctggatgcatggtttaaaataccagatattttcactgaaattttggcaagctgatcaccggcagctgacgttcatgttaacagccaacctgttctcttggtgctgctgggagatccattcttctcctgatctaaacatccattggacaaaacaattgacttgcaccgcatagaacatacacgttgtgtacttgtgtaccatgagagcattctcctatttgcaattagtgctgaaactacaattggcattgcgagacgtgtttgcaactagtgctagaactacaacagaatatgatacactatttgccaatgtctcccaagcccattggccattgcaagtattaaattttttgataaaaaaaactaccggaacggctacaaaggaattctaaatatccatgaaactatgccttatttcagtgatatagaggtggaaaacaatacaagcctaataagaggacacacctatggttgtgaatataatgtccatgaaggaggagtttctttgtttgtttttattgaatcgaagagatcaacaataaacagcagcctaccacgatcccttgaagactcaatgtagcaatcacaagtgccgcaaccacagttcagaaagggaagaaggagatggaagcagtcttgtataaaatatccgtacaggagatgaaagagaagacgctgttgataaccttgaacaagctagctagcgtagactgtttcactgcaaaaagggaataataaagggaataataaagtcagtgtagactgtttctctaagaactaactgacagtaatttaaaattggcaaattttgctacataacatcgtgacatcatgattttagttgtaggataccgcgcgaagcgacttatgagggaatacactctcaaagttggatttttgctggtggacaccgcacctattaaaataataattttgtttaaataagacgagagaaatcacgtgaaagttctgaaatgccattggacccacatgtcagatctgcactctcttatctctctatcccctccttccacactgccatggccagcgcccttcattcccatcggcttctctgactggaatgtcggacgccctccactctgttgtcgcgctgctggccccattgtcctcaacctctgtcagaataggtgtcgaacataccagtcttatttggttacagttggactcggagttgtgataggtgttagggggtagagttatagtcggactctgtaacccggcatctctcttatgtagagaggggggcaccacaatgtaaccatggcgactacaatatagcgtagacatgcagggagatgatggcggtgtggccatggacttgtagctgctaggtgctatgttggttggggaggagcgttcataatcagagccctagggatgtaggcttcggctgaatctcgttaacaaatatcatgtgttcctatgtcgtcttctggcgtgtcttaggtgataaatgtctaaagcgatcgggaaggttagtcgtcgttccactatatcgactaacttttataataacctcgtccaatctccgctagctgcatcagcggcggccaccacctccgtgtggcatcgctcacctcttcccccaccttctcctcttggatccaccgccttccccgcggacctcgttgacaccggcttcgctaccggtggcttttcctgcgactgcgccgccagccggctcttccccatgaaccccactacctggtgacccctctgcctccgtcgacctcaccggcctgtctcctgtgtcgcctcactggtgggcccgggctcaccgacccactgctccctgctggccaagaacactgctccgtgctcaccgcttcccgttcacccacggctggcctctgcatctccttcccctgttgccgccgtccacggccggccgccatcaagcttgccacgcctcacctcacctgttcctgctgcgagcagagaaagaaggggaaaacaatgatagaggcttacatgtgggccccatgtgcttgagaaagggatagagattgagagattacagatctaacatgtgggcccaagagcttttcagaactttcacatgacctttttttctcctctttaactgaaaattataattttaatgggtacacgtgtccaccagaaaacatctaacttttgatagtgtctcccaccaaaagtcacttccacaatatcctataactaaaaacacgaagtcaccgatatcctgtagcaaaatttgactttagatcacttcaaccgtaatagtccacaatgataattattaagctaattgaactcttttggcttacatatggttgtagcttttcatttacatatccttgtacttgttgtatagcagtaccttacaggaatcaaacaactttgaccgcttgttcttggaacgaaagatctcgactagtcagctggatggcttcttccatcatcagtgcagcaggggggctcaaccagccggttaggctcataggtatgagggttttgctatttcctgagacctctcattattatcacattttctctagcataaaatggacgaatgaaaaaataacgtataatctctggtattgtggtatgtatatcaagggaaaatacatgcatggtggcatgtatatataggaaatggcagtgctgtagttagacctaaagcttcgatatttatatctatacttatactaatcgaacactttctatgagctcccacgttaatccgaaagatctggctagaagaacaacataaccttaatttctcgcttcctcttctactcgatcagacaaatttccagtattggaaatagaccagctaagaaagttcaccaggagatgggaggcatcagaatcaaaagtacagcattacagaaatggggcacaattcttctaactacagtaatgagacacaaaagtattcacattactagtagctttgtggagcgttgcacatcccctttgttatgctgtcaagagtatggcagtgttgcagacacgctaatcggcgggatgtatcataggcgccagaagatgaatcaggcgtctacaagtggtgaagataaagttgtgtaagagtttgtttggctaaagataaatcaggcttgagataatttggagtttgttagaggtaagttattgtcagagtaatcttggtcgtgacaagttaactgcatgtttaaattagtctttgcactattttttgtaatagcatattagctttggattcctagttgcatgcgctggctgaatgtagtttttcagtcagagtttgttattcagtttctctgttttttcggagtagatgagatcgagctgggatcggatcgtgggatggcacggtcagtcgttgatccggcaaggtcgcacatgtaacagactccatcgtggaggtgaatacaaggaaaaaaacccagaaaagctgcagtcagttcgcaccaccaaaaactctgtttttcgtttcagttcttcagttactgttcacgtctggaaaatattcagagattgtaggttagccattgatcgagagctgagctaggggtttttgctgacatttggtatcagagcggtaccgtcacgatccggcgacgatgtcatacacaccgcctggacgccgtggtggcggtggcagcggtggaagtggcagcggccgcggcggcgcaagtggcagcagtggggggnnnnnnnnnnnnnnnnnnnnnnnnnnncttgtgcctcaggggagagatgcagggcacaccacccgcctcccagtgctgtcaaggacgaactatccggattgggcgctcctgatgcgcgtcaacctgcaggagcaggggctgtggaaggcgattgatcccggctacgtggagtttcgtgaagatcgggcagctctctcggcgatacttcaggccgtgccgcgcgagatgttgcgcgggctggcgaagcacgacacggcgaaggcggcgtgtgatgccattaaaaccatgaggatcggtgtcgaccgcgtgcgtgaggcgaatgagcagggattccgccgtcagttcgaggcgatgcgcttcaaggatggggagacgcctgaggaatttgcgattcggctcactgccatcgtcgcggacattcgtgacatgggtggagtcatggaggacgaacacatcaacaagaagctgctgtgtgttgtccccaagaagtataagccagtagcgatctccctcgagcagcttcttgacgtgaaaacgatggctcttgaggaactcgtcgggcggctgtcgacgatcgacagctacagcgatgacgaagaaaaagaagcaagaagcaagttgtatctcacggaggaacaatggcaggcacggagcaagcagaaggagtaggatgcatctggtggtggtggaaagggtcgcagcagctctggcgcaccgaatcgccaaggcaaacctgctggtacaccaaagggaaaagaggcagcttccggggagagcggcggccgtgacatctcaaaggtgaagtgctttaactgtgaagaatatggccattttgctaggcaatgtcgaaaaccgcgacgtcaacgccgcggcgaggcaaacttgatgcagacagaggaggagccaactctgctcatggcacatgtgaccgggctatcgctcgccggcgaagcagcgtttggtcgaacacctagggtgcaagaagtgcacctcaccgaaagaaaggtggtcctggatgatgatgatgggcatgaacaagagaacacaggataatggttcctagataccggggccacaaatcacatgacgggggcgcgctcagccttcgccgagctcgacactggagtcgtcggcactgtcaaattcggcgatggctcggtgatagacatccaggggcgcagaagcatggtgcttaagtgcaagaacggatatcaccggtcacttgacgcggtgtacttcattccgaagctgcgcaagaacatcgtgagcgtcgggcgactcgacgcgcgcggctacgatgcactcatatggggcggtgtgttcacgctccgtgatcccgaaggcttgctgctcaccaaggtataccgtgataatagctatctgtatgtgctaaaactgaacattgcaagccctgtttgtttggcggcgagtggcggcgagacggcttggcggtggcatgctcgttttgggcacttgaatttccaggcgctacagaggctggcacaggcgaacatggtttgccggttaccacacattgatcacatggatcagctgtgtgatggctgtctagccggcaagcaacgtcatcctccatttcctgaggaggccacgttcagggcgcaggaggcgctcgaactggtacatggagatctgtgcgggacaatctcgccggcgacaccgggcgggagaaagtattttttgctcctagtggacgacatgagtcggtacatgtgggtccgacttctctccggcaagcacgaggcggtggcggcgatcaaacagtttcaagccggcgttgagcttgagtctgggcgaaagctgcaggctctaaggacggaccgcggggaggaatttacctccgttgagtttacagactactgtgctgatcgtggaatgaggcgagagctcactgctccctattccccacagcagaatggagtcgtggaacgacggaaccagacggtcatggcggcggcgcgctgcatgctcaaatcagccggatgccggcgcgtttttgggggggaggctgttacggcggcggtatatgtcttgaaccggtcaccaacaaaggcgctagacggagtgaccccctatgaagcctggcatggacggtgtccatcggtcgaacacctgagggtgtttggttgtgttggtcatgtcaaatcagtgaggccaaacttgaggaagctcgacgaccgaggtacgagaatggtttttattggttatgaacagggttcaaaagcataccggatgtatgatccggtggcgcgacgtgtttgtgtgtcgcgtgatgttgtgttcgatgaggcggccacctgggcatggcatgatcctgaggcggagggaattggagaggaggaattcacggtggatttctttgtgtcccatggaacccgttgttgctaatcaaggtggacaagctggaacgactgttcaaggaggcgcatcgccggcgtcgactattgtttcgccctcgccatctggagcagcagttagggtggaattttgcacgccgccaagctcagttacgccaggaacagaagaaggtcctgtcaggtatcgccgtgtgcaagatattctatccacaactgagcctgttttggatttcgactacagtgatcagtgtttgcttgccacgaagaaccagcaagttttgttgaagcagagcagcatgaatgctggagaaaggcaatggaggaggaattaagatcaattgaagaaaaccagacatggtctctagctgatttgccagcaggcacacaaagccattgggcttaaatgggtctaccaagttgaagaaagatccaactggtgcagtagtgaagcacaaggcgaggttagttgccaaaggatatgtgcagcagcaaggaattgattttgaggaagttttcgctcctgtggctagaatggaaactgtgaggctcttgattgcattggcggcaagtgaaggctagcagattcatcacatggatgtcaaatcagctttcctaaatggtgagttaagaggaagaagtttatgttgtgcagccacttggttttgttcagaagggaaaagaaggccaggtactgaagctcaaaaaatcattgtatgggctaaagcaggctccacgagcctgaaatgctaaattgcacaacactttaatctctctgaatttcctaaaatctgaaactgaaagtgcagtgtatgtgaggggaaatgggtgctccaagttgattgtaggagtgtacgtggatgatctgattatcagtggggctcaaccaagtgagattgaagtattcaaactggagatgaaaaagaaattttgcatgagtgatctaggactgctgagttactatctggggatggaagttgtccaaaaggaaactggagtgtttctgtcacagactgcttatgcagcaaaaatccttgaaaagacaggaatggaaggctgcaactcgactcaaagtcccatggatgctaggttaaagctcaggaaggagagtgatggaaaggctgttgatcctactatgtacaaaagcactgtgggaagccttaggtatttggtgaatactaggcctgatcttgcttattctgttggttatgtgagtaggttcatggaaaaacctaccattgaacactgggcagcagttaagcatgtactgaggtacatttcaggatactggttgttggtttgcaagaaaaggaactgaaggactcagtttgattgggttcagtgacagtgatatggctggggatttggatgatagaaagagcactactggagtgttatacatgttggggaaaagcttgatcagctggcaatctcaaaaacaaaaggtagtggctctgtcatcgtgtgaagctgagtatattgcagctactacggctgcttgtcaaggcatttggcttactagattgttggctgaactgattggagaagaacctagccaaactgtaatgaaggttgataataagtcagcaattaatctatgcaagaatccggtgctccatgaacgaagtaaacacattgacacccgatatcattttattagggagtgtgtggaaaagaagcaaattgctgtggagtatgttcggtccgaagatcaacttgcagatattttgagaaagcctgttggaagagttcgatttttggaggttcgcaagaagatgggtttggaaccagcacaccaagattaggggggaaaatgtcagagtaatcttggtcgtgacaagttaactgcatgtttaaattagtctttgcactattttttgtaatagcatattagctttggattcctagttgcatgcgctggctgaatgtagtttttcagtcagagtttgttattcagtttctctgttttttcagagtagatgagatcgagctgggatcggatcgtgggatggcacggtcagttggcacggtcagtcgttgatccggcaaggttgcgcatgtaacagactccctcatggaggtgaataaaaggaaagaaaaaaacccagaaaagctgcagtcagttcgcaccaccaaaaactctgtttttcgtttcagttcttcagttactgttcacgtctggaaaatattcggagattgtaggttagccactgatcgagagctgagctaggggtttttgctgacagttactttatggcttgtctatttaagagatggtcagagccgtttgtaatcaagtaatctattcatcaatataattaaggacgctcagagcctctgcctgagggcgagtacaccattgccatcttcaacagctcaatcgtatagccacatcaggcaaagttcaagcgaccatgtaaacaaggtgcctgctgcttgaaatggaggaatatgttatgctataaattttgttatgtttgtgcttattaagctacttgtccattgtttccggtatggtggagaaaacaaatgaagaataagttcatgtttgtagtgaagtgaattttgcctcaaaattgtggatccagtcttggtaggaaacaagtggtcatcacttccaggaattcatcaacgctcaaaattctgtccatactcacaagtgcggcaattgaaagtgatctaattataagtcacataattggagcttcagcttggctcgacaatatgggccaaagcccaacttttatttaaatatcttgctccatagcctctattgaattgcttcgtcagtcattatatgcaattttaagtatgacgctctaaggtcacattaataagtgatcccaccgaccacttgttgatatccacagattatccacagactattggtgataataactcaaacaaaatatgaaaacattgattgaatcttcacaatatttctgtgtccctgtacagtcctatactgtcttgatttattctccggcctctatggtttaatcattactgtcttgattcaccctcctactgcacgttgctatatattcctcatacaagattagtttccaattgtacatgctacaacatcttgttggtagtagacctccataactcatgctattttctgttttgtgttttccattttctttgaaagtgatacgaatgagagtagttgggaaataaggtattgcaattcttggttcttcatctaccataattccctcagttccaaattgtttttttaccatgcttgccatcatttggacaagcctgttcaagtccaagcacattcaccgctatatatttgatttcctgaccagtttagctttcacgaatttggttgtgcaacctctcaaattaacttaccaacttcatctgcccttaatggcctcatgtcgatcgctctacattcaatggaattgaagattttgcctgtgccatgggcagatctacagtagaagggccggtgttaggcgacaccgatgattttcggcaaaacttataacgaaactgtttacctatatgttataagaatttgagctaagcataattaacatactataataccaatagacacgttatgacatcaactaatcgattttttagatccgccactggtctgtgctagttggcaccctctgttgtcagcaacacaccagtgaactaaaatacaaattttgttgttgcatcttgcaaaattccgtgcaaagcaatgattattaactataattcttgtgaaggcttcacaccggacatctcgagatgagttatttatttgtttcatataagtgaaattcaagttgttggtacatttgtaatttgcacctgcacagcccaaactacatatgaataattgatgggcttaaatagaattgttttgggtttaaattttgtaggatcgtatcacaagaactaagccaaccagaggggagggtgaatggttggtatgcccaaaaacccaatatttttgcggaataaaatgttaccctcaaattcgacggatcgcggtctgaccgaagtagatgcgccggtttgaccgcctgaaacacgtcggtctgaccgaggttgtaacaccggtcgaaccgccgagaccaatcaccaactccattcgccgttgcctgtctgaccgcaggtctgccgccgatctgaccgccggtgtgtggccggttagaccgccgaacccgataaaacacaaatcaaaaaactcttaaagtggatgacaactttattgcttctttctgtgtttacaaagtacatcaacagcactacttacaaaaatctcgactaaactcgaaaccctcactaaactagcaactcaattgctgtcaaaagcgataccgagaaccctcacgctacgtctctatttatacatgaggtaggcagcctaaagccacgaaccaaactcatactagaaatcctaatccccttagctaggaaaccttctcgtacaagaaacaaactttacataaccaatcatatcaaatttggactccttccaaattagactccacatcccatacgcaaacaatacctccatcgtatgccatatggaatcttcaccaaccacatgtattgaactctagcctaagtatcccgtgtgatatctgaccatcatggacatcgccttaccaccaagtcaactcccggtccatcaccgcaaatactctcccgaggcatcaagtcacctacacatgaaacaaacaaagaaaccatattccgagaccaagctatccctaacttaactcattagtagcaaacaactgtattacatacgcataatatccatctagaagccataaatatgaaacaatcacggatatccaaataaacaacccgaaaccgaaactgacacagcgtcggcaggtcagaccgtgggctggccggtctaaccgctcacatagctctggtctgaccggcagcatcggcccggtctgaccggtcccgacaaacaacaagtccctgtcaatcacctgtgaaatctaatcatctccaaaaccacttcgatcacaaataaattccaaatatcaaaaccaataatctctgatgccaattgtttatcacagaataataatcaaaaacacctttgattttacaaatttcaattttgttgtgaatgaaaaggctgcggttgtaatgtcagctacctttcacaggattgtacagaatacatcccaactagaattgcccttgaaagaattttgttaaaccaaatgatcagccttttttctcgcacaattacgagaaagagtaactttatgttggtctctccttgtactgccagtattatcataagtagaagtgatctcaaacattcatttatgagttctattgctagcacagaaaactattcttctaccagtagttgagatagtaattagtatagataaacatgatttattagattagaaaagatgtatggttgagattactgaaaattatcaaacctgcggatttgctccaatatcagatcatacagaaatgatggagattactgtgtctgacaaatggacatcaatgttaatttgcatgtattacttgaaatcagcgtaaaccaagagcatcaccaagagatgttcaaaaatctatccccaaattttattttggagaaccctaaatggaatttgaggggtgaaaatatttgtctttccaacagatgcctaaaacttaaaaatgggccatgtaacgaataaatctattttttcaatcctaccgacgttccctcgcacttgccctcagatccagggatagggaatgaggaggacacccaacttgtggagagcgagatatatggagatggggtttccaattttttggcatataggggaaatgctggaactacttttttccataggaattaaaaaatctgagattggtagcagtattcggtagctgttgggcatgctctaactggagtcatctaaagccatattcggtagagaaatatgcatatttgcaatgtctaaaattacatgccacaatagatacgcctgggatgagtattttggatggagcaacacaagaagtggaagaaaataaacaagatcagagatatcaaaacattagcctcagtagatatgcctggggttagtatctaaaataaaaaaaagaataatataaaatttatagaaaacatagaaaaacccaacattagccatacatgtaagtattataacagatggttgcagtcatctaactttggaggaatcctccaagctagaaatcaacatatttgattaattctattcattgttacatctcttcataagagccatatatagacatttcatacatggcttctagatctttcaccagagtaaacaagacttttccgttgcgatgtttaggcttagtacggcggtcttcattctgttcgaaatgcttgcctttcttccggaatgggtggcttgaaataaggaatcgatgatggcccatgtacacaacctgcctacaatgtttcatatacgtattttcagttttatccatacagtgggtgcaagccttataccccttgtttgactgttcggataagttgctaggtgcaggccaatcgttaatgctaacaaacaccttctttcttccccggcagtttcagatgttcatccaatggtcttaggtacacatcaatgtcgttaccaggttgctcttggcattaaataataatcggcatcatgatgtacttctgcttcatgcatagccaagggggaggttgtagatacacatggtaacaggccaagcgctatggccgctgctcatctctccaaatagatacatgccattggtacttaaacctaaccttacgtttcgttcatcctctccgaagtattgaaatgttcattcgatgtttcatcactgcaacccatcaacggggtgtctctcagcatcccgtcttgttgacgttcttctgcgtgcccgcgcatcattctggcatgcgctttgttcttgaacaagcgcctgagccgtggtattatagggaaataccacatcaccttaggaggaactctcttcttcgaaggctggatcatctcctctaatcttgtatcgtagtgctttacaaaccaggcattcttctaggttctcgtattcctcacggagatagaggatacaatcatttggacatgcgtgtatcttctgtacttccagtcctagagggcagactacctcttagcttcgaatgttatttagggcaatctgtttccctccggaataatgttctttacgagtttcaataactcgccaaatgccttgtaactcacaccatttttgacttttcattgcaagaattctagcgtggtgcccaacgttttgtgcccctgttcataaccaggacataatgacgttttgtggtctgctaacatacgctccaatttctggaccaccttttcactttcacagtcctcctttacattgtgcaacatatgaccaagatcatccacactatcgttatcttcaaaagccccgttcgcctcgccctttgtatttttttgaaatccaccttattgaggcgcacagtccgaaatgttctcttcttctagttcaccttattccattgcaacccctagctttccatgtgaggtccaacaattatagctaggcatgaaccccgactgaaacaagtgggcatgaaatgttcttgatgtagaatactccttctggttttttcactttttgcgtggacaacacataaaacccttatgcttgttaatattggccacactcaaaaaataatacacgccttctataaactctttcgaccatcggtccacagtgtacacacattgccgatccacttacctgaaatgcacaaaaatcgtaaaaataaaatccacgaaagtcaaactaattaaataatcatacaataattatatataaataatcgtacaataattatacaatactcccacatattattcatgttttaactatttttaaagttctaagcatatctttaatacattgtactttttctaactattttattaaattaacttagttttctattcttttatcttaattttctacatttttcctttgttatctcttttacaacattttatccacatgtttatattttaaaagtagcctaattttccctaaacaaattttctctctcatcattttccatcaacctttttagacacaataatatataaaaaacatagctataaatgtaggcaaaatttgctataggacatccaaatagcatgtaattagctggtagacatcgcaagaacgcgaatttgttgttgggcaaaaaaaaaactggaaattagctgatggacactcgttgcgttattttattatttttggaggaattggagagagaaacactctttaaagataaatttgcccttggtaacttgctctctggtaaggaaaggagcgacgccagcacgctgagcagcatgagctcctggacgcccttggcagcgagaacactgagcatggcgacagcacgacgatgcgggtgccagcacgacgatgggtgcccttagcagcgcccagatgcggcgacagcacgggacagcacgacgatgtgggtgccgtccggtcctcgccgtcatcgtcatcgttggggaggaggtcggtgtcatcgaggatgagcagcgtagaggcctgatgcggcagcggcgctagcacggggacaacacggcggtgcgggcgccgtccaccgtcgtcgtcgtcatcgtcgtcggggagtatagatggccaaaaggcccggcccagacacggccaggcacggcccaccagccatcgggcctgcacggcccgattggcacttcgtgcagggccgtgccggcccatgggctgcgcctcccgcccaggcacggcccaccagctgtcgggccgtgccgggccggcctgaaggcgcgggtggcccatcgttccttttttaaataagtctagttttcgtccctccactttgggctgtgacatatatatagtgaaaataagtctatttttcgtccctcctctttgggctg

SEQ ID NO: 1468 - DNA, 6070 bp, Oryza sativa
  unsure (1)..(6070): unsure at all n locations
cgactgtggcataaaatatgtctatttttactccctattgtttatgtgttgggcttggcatgcggcccatcgtgccatgccggcccggccgtgccgtgccggcccaacgtgccggcagagaggcccaggcacggcccggtagtcgggccgggccggcacgggcccgacccttgacgggccgtgccgtgcttgggccgggccaaaacgctgtgccgtgggctgggccgtcgggcctcgggcgttttggccatctatatcgtcgaggacgagtggcgtggaggcccagatgcggctgtggcgccagcatggggacagcatggcggtgcgggcgccgttcgccatcgtctttgtcgtcgttggagaggaggtaggcgtcgccgacgagcgacgtggaggcccagatgcggcactggcacggcggtgcgggcgctgtccttgaaggggaggtggagacgattcgactacatcgcgttctcggtctcggcaaccgcggcgactggaataggagcgccttggggtactacaggcatgaggaagtagtagcggcggcgtagtcgacgaccagtttcggcgatggcggtgatggattgaagccgcgcaggggcaaaatcgtactctcacatcattttctctttccaattcccccggaaataataagatatggctgcgagtgtccatcagctaattaccattttttgtgatgcccgacaccaaattcgtgtttttgcgatgtccaccagctaaatacacgttttttaatgtatagtagcgaatttttccataaatgtaatatgctaagcatacatcattcgagagttgctaaccttctagatccctctgatttgtatattatcaccaaaacacttacacaaaaaattttggcagcacctcccttcctcctacaaatctttgcagcaattgctcgggttggaagaggaagaagaatgttataaatgtttttatctttagccccggttggtgctaccaaccgaactaaagaactaaagatctaaagtcatgatttttagccccggttgactaaagatgccatggcccctgacagccccttaacataaagtgatctaggactaaatatcatctttaatttcaataggtgttaccaatcggaagtaaatattatatggtccggttgcactttataaccgggactacaaatgatctttaatccatatcagttctacagtagtggagcggtgcaagatctacggtcaggccgatttacatcgatttgatggtaacttttaattctgctaaaagttttggtttttgggtattttaaccattcacctctctatagttggtatagatcgatcctccacttagctttgatgacgggacacaaggccggcatgatgacagcaacagatctggccatgtcctcttcacagcgcctcttccacaatgttgcctgtgggcatgacacatcaagcggtggcctggtggaggcactgacaatgagtgaggaccgagagtggaaggacggccacgtctaggtcgataaacggctgggattttcttttccacatcactgattgttcaaaagagttcaaccgttacaactatgtacatcagtaacgggtcggcacccagcatggatgtggggagaaagctacaaattgtatgctgctacgcatttgtcgcatgcagggccacgtctgtagcatgcatgtagtgaggagcaaggctagttgtgtctgacccggcggttcgaccggtgaaccgacgatcagaacgggtcaaccaccggtcttgtttttttactatgtgtcacacgcatagaggagcaaggctggttaccaaggtgcactgattcatcattactttctctctccatttttaatcaaactctaaacaaagttttcttctaaaatatatatccaatctataatttaattataccattttatttgtcatacttaaatctttataacaagatctcacataaatatatttttataaaagtatatatgtgtgttctagaaaaatcaaacttttgttgcagcatttacaaaaaaaaattgcttcatcacttgtgcagatgttttatagagatgcaacatataaaaagttttgactgcaacaataattgttattacatgaaatattatgtcccaactagtgaaacactaaaaaattcatacaatacaatacatttgcaaatatttgattttgaaacatcgaattgtaattgctgagacatataaaaagataacgtgcaacattgcaaatgaaatagtgaaacatcaatagatacttgttggaacattgcatatttcactaaagatatgtgcaacatttaaaaagtaaaaaaaaattgtcggaatagagccttcttaaatgttgttatgtagttgtaacgaatccaacaatataatctaaataagtgaaaggggtgtcttctcgcaaaattatgtatccacgtcatcaagaaaacttgaaccgtccgatgttatcaccagccaatatgaaccgtcggatggctcaaatggcaaaagaccatgaagatccttcatgaaacttcaataaaacctagattcttccacaccacaatatgtctagaactgaacctttttggttcctccacccttcctctcccatccatggttcctccatgactcctctcgcatggcctacttcgccgtcctctcccatcgccgcaccgccgccgccgtcgcgtcgcatcccctcaccaccacacctgcctccttggctcctccactgtccatgtctccgtcatcgctgcctccctgtccaggccacgctgcatccctcatcagatccagccgcaacaaactcaatggcaccaaatccggccagcctcgtgggaggcagagtggtgcgtgccggtcggaagtcagcggccgtggcgggcgacagggtgacagtcaacggggcgtcagccgcaacggatccgagcacaccggtggtggatctggccctccggagcgcggatctagccagcgactgtccactgcgacgacagctggttgaggcgggcgatgcaacggctgtggccggcaggcgaaggtggccgacgccggaggagcgcggtggaagcccgcggcctcagcggatgacggaggcatgcttagaacttgtgcggcgacggcggcactggctggcgcggctacggctaggcggtgcagccagcaacgacggagcacggtgcgtcacgagcgaggaggtgaggccgacaacggtggaggctgccacagtggcggcgttgcgctactgtgcgcgaggaagaaggaggcgtcggtcacgcgaaagaggtgtcggcagcgcgaggacgaaggtcatcgtggccttagcaccggcgggggcgcggcacgaccggtggtggctgaccaactcatcggcggcagtggcgcctatcctcccctcttgcatcattgatgctcgcccaccggacggcggtggcgcgagggatgcgaccggagggatgaggccggaggggggcgactgccgcaggcagatctggctgcccgcggctcgggcacgttgcggcgagttcggcggctgcacggcgtcgctaggcgggctccggtggggttgcactctggcagcgagccccctgctcgacaggggccggtggcggatttcatggttcgtgggcggtgatgtgaggatgtggagttggcaggacgacggtttgtgctggcgtgaagcaggaatggggcttgtcttgatggcgcttcgagggtggccatgagcccatctttgccgttaactacaattaaggtatgactgcttgcgagacgttatagactgtcctatggccgtcgatttgggggtgttttgtgtgggtgatgtgaagacgctgacgaaagccttgtcgtgcctttggccagtttaacaacgacgacgcccgtgggtgccgttttccttcttggaggcattgtctgggcgtttcttttatatcccccacaaatctctaggtgaaaaccttgttccggctttcggacgagcggcagcagtgttacacgtcatgtcctccttgggggcgtcgcttcagagaagttcctatgaatcgacgactgttgatggtcttttgggtttaaaagctttcatatcttggggtttggcgaggcccttcgccttcttgggtcgctttgttcttgcggtgggcaacacgctcttcggctgtttctgcttatgaagtcggagctgctcgctgatggatgcagcgacgcttggcaacgatgacatgttgcagtctcttccagggagttggtgctagccgtgtgaatgaagtggctctttggtggcttggctgatgtccattgtaagatgtcggagatgcttttcgctttggcaactttcgcttcattatcgctgcagttgtgaagccggcgctgctggatcgcttgggtggttagctcggcaatgataacacctcttctgtgaagtcgaagctgttgtgttgcttttgtgttagattggcagcaacatcctgcggttaggctccgccgtttttgttagttgtgtagctaggtccctttctcttctctgtgcagtgggtttcagccggtttcccataattaaccgtgcagctgtatggttttcgggtccggttttccttataaactgggtcaattctcttcttctttaatacaaagacaccccacgggggattaaaaaaaaatctggccaggctgacagcgtctggtctcccccgcgaacatcagtgcgctcccaatcaccaaatgttcagcgatgctgcgagccctatgaaattgataccatccatcggcacatcctcctctccctctccagccatgccgctggcttgcagctcccctgcgcccaccgccgctccacttcccctccccatgtctaccactatatcttcctctgtgcactcgcacagcaatgctgagcgacaaattatcttcattgccatgctccagcgcaagcctgcattctattctcacccttgcagttgatttctgttcatatagaaaggtaaggggatactttcagtgaattttagttgtagagttgaatatgctgaactgcataattgaatccatttttttatccagactatacattgttgatgttgtaattgtcatccagtttaagatcttctagaagtaccaaattccactacatagctatgataacatgtactgcactaatgttaatgcaaaatggattattcaccgcagtttcagatcaaacttgcaattttgtatttcgcagttttcaaaaatctttattattttgatccctgaagagttaattactgattttttttttgagctagggcatgaagcccccatttcttttactagaaatgagatcaagtcagactaccagagtactaaacagaaaacagaaaaataaaaactaaaacatctgagggaggacatccgacccttatgcaaaagaaaaaaacaaagaccatagctagattgtctattacagagctatctttgctcattccatccacacaaaatactcagtaaacatttcctctcctgagttatgacctaatccttcgaacacctcctctccagccgagcttcgagttgtagacttcatttaccacttgttttagcaacctggcccccagttgaagatttcttcgacttccctcctgcttctgcaaagttgcccacgagtccaccaaagagcaagccataaacaccagatcagtaggatcagctgggagttttttctcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1469 - DNA, 459 bp, Oryza sativa
ttgatgtttgcctgtgttgtggcaaagttttgctaaagtttagcagggctgggacgtcaacgccatgctaaatggcgctgacatgtccaaactcagcgccagtgcacctggcgctgaggtcccagcccagccatccagaaggcttgctgggctgggccatggccgaaacggccaagtcccacctcagcgccaggtgggctggcgctgagtgtcccacggtcagcgccattatggctggcgctgaggtcccagcccgcaagcgaaccagcaggcttgctggtctgggccttgggggttgcggccaagtcccacctcagcgccaggtgggctggcgctgagtgtcccacggtcagcgccattatggctggcgctgaggtcccagcccgcaagtccatccataaggcttgctggtctgggccttgggggttgcggccatgttcccacctcagcgccagtccg

SEQ ID NO: 1470 - DNA, 773 bp, Oryza sativa
gcagccctttgggccgaaagtcggcccaaaaccgctctctctctctccctcggcccaagccggcccagtccgggcgcgggcgcgccctcgctgccgctgacaggtggggcccacctgtcaggcccgtcgtcttcctccggccgaaaccctagcgcgccgccgccgccgccgctttccaatccggccgttcctttccttctccggtcgaattgattgaggggaaacaatctccgggatctcctctaccttttctcctttggaatctttggctaaatcgttttggaaagcgttggattcgagtttgtctcggattcattcttcccgatctttccttcctcgtcgtcggccgccgtgggcctttgccgccgcctccgagcccctttaaaagcctccccggtgtctcctctacccgccgccacccttgccttcgcctctcgtcgtctgaatcgttctagcgccgtgtgccctagctttgccgtcgccgccgccgctccagccgtgcgccgccgttgtttcagccatcgccgtcgctcgggaagaccgccgtcgtggtcgccaagtcgtcgccgtcctcgtccgccccttcgctgtcgccggagatcgccggagcttcatcgccgccgtcgacccgaaagtttcctccgtttcctcctagtcgccgtcgccgtccgttgatcttccgccgccgttttggtcaccggtgagttcgcccggtcgtcctctacgtgctggtgggcttcgtttgcgtcctaatgccgccgttcgccggcgag

SEQ ID NO: 1471 - DNA, 756 bp, Oryza sativa
actttattatattggttacaatagatattagaaataattggttagccctgcttagaaccattagcacactattgggataactcatgattcactattatttcgtgatggcttattgatagttcacgatggtcaatcgtgattagttaattaataaatgtgccaactataacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatagttcattgcggggccccagactgagaagtggcggagataagcccacgggggtcgctggggagtccatgccttgtttataaggggtgattatgatctaggaaggtgcactgcagtggattgtgttgtatgcggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtttcacacttctcaccatagtaaatgatgctttaactggtaataattagattagctcctggtttggaatggtatattcctggtttggagatagaaccgagccgccgggatggttgttcagaatggttgggcctatcaagg

SEQ ID NO: 1472 - DNA, 981 bp, Oryza sativa
tgaggaattttggaagttgaacggagtcaaacggatctacggttgggaggatattgaatttctaagattcttggatttttggtctaaaggaaaaggatttaattaaatcctttttggaaaagaaaagaaaagaaaagaaaagagggatggaaattagacttccctcgggcggctagggcgcggcccgagagaaaaggggcggctcggccgagcttaacgggccggccggcccaagaaggcggcccagaacggcccaagacgcgcgcgcgcgggagggaggagagagagagccggtggaccgggctcaccacgcgcggtctcaggtgggacccgcttgtcagcggcttggctcaccgtgcggagggagcacgcgacgcggcgctagggtggggggaaggacgcggtgcacgcgcgcggttcgcggtggacgcgggtgcggcgggcccacgcgcagcctcacggctcgcggtggagcgcgcgcacgggaagggactgaccggggtcggctcgacccggtctaggctgagctggcgccgacgtggcgcctacgtggctgccacgcgggccggcgggaggtagacgacgacgccgaccggaacggacggcggtcgacagcggcgagcggcggagcgaaccacggcgataccggcgaaagcgagcacaccgggtggttgcacgagacgaggggagacgagccaacggctcagattcgccggaggaagcttgacggcggcgaatcgcggcggcggcaaccggcggggagggaagaggggaaacggcgacgaggtcacgaggggccaattcccggcggcgagagcatctatgcggctacgggaatccgatgctagcgtcggattgggcggagctacgccgagcgaggctggcgacgagcgggtgctacggagctcgggcgccgacggcggcgggcacacggtgagcgacggcaacggtcggggcggcgccggctagctacggggaggc

SEQ ID NO: 1473 - DNA, 1121 bp, Oryza sativa
  unsure (1)..(1121): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataaccaacaccttgcctcaagttgatctcactgacctttcggctactactagaaaagatcaacgtacgcgatgcttgtgactgtgggtgagggcattcccaaccaagaaactaatatagattccataaacttaacagcataaaaaaaaaaactagtactatagacactattcttctaatacaaacactactattccatacttaaatttaatactacttatctcatataatgtcttagatgttgtatagaaactatgtctcatgcaagatattgtttccttctcttttcttatttatttacttaccacatcattttttatcttaggtggtagcttatttaatgctaaagacgcatcctagccctgatacggcgcctgcacccagacctgcacacgaccgtgacacactgacatgcaggtggttttgcgtttcagcgtggtgttgcgtactgtcgcctgatcgtccgtcgtgcggtcgtgccgttggtgttgacagttgagcgtgggatgtttctctcctttgaatattagcagccgcgtagcaagttatgacttactgtatatatgcatatcagagttggaatatatgaataccaataaatgaagaagattcttattttttttaagactgataactggggggcaaagtgcccacctttacatattacttggaaccaaatggcaggtttagccgcgtaagcacatgagccctgtagaataaagtgaaggaatacacgggagacttaaaaaaaattatgttattattttctcttcttttgggggtgggtgggtgggggggggattttatgttgctttttgttgttagctacaacctccgtcctaaagacgctgttgattttttatcacatgtttgaccattcgtcttattcaaagaatttacctaattataatttattttgttatgagttgttttataactcatagtattttatgtgtgattcatatcttatatatttgcataa

SEQ ID NO: 1474 - DNA, 24988 bp, Oryza sativa
  unsure (1)..(24988): unsure at all n locations
taattagagttgtttttagaaagaagctgtgagttttgcatgctaacgctggtccaaatattctcgggtacaatataataccacaataaaacggtaggtgcatatatgtcgagcataaaaaatcggccgggagtactacacgatttatttagacatcgtcgacacatcgtaagatcgtcgaaataattttgtctcactccctcaacagatcaacctcgtctcccgcacgcgcgttaacaaagactataataaggctgtgtttgagggagaggagattgagaagattgggaagatacggaaaacgagatgagccattagcgcatgattaattgagtattaactattttaaactttaaaaatagattaatatgattttttaaagtaacttttatatagaatttttttgcaaaatacgcaccgtttagtagtttgggaagcgtgcgcgcggaaaacgaaacaaacattcccccatttgttctccaaacgaacgcagcctaagtgacgcgcgatttatgccatcagaagcgcttgctcgggcgcgcaaccctcgatgcagccgagcgcccggccaccgacacggaagcagatctctcacgctattgcacaccatgacatactgttaggtggtcttcttttctcctgaagacttgaagataaaaattaagttttttacgtaaaatgagatggtattaggtggtcttcttttctcctgaagatttgaagataaaaattaagttttttacgtaaaatgagatggtattaatgtatgattgattgagttttaattattacaaacttaaaaaatagattaatatgatattttaaaacaactttcatatagaaagttttcccacgaaatataccatttagtagtttgaaaaatgtgtcacacaaattttaatcttcatcgttggagaaaagaacaggaccttaagctcataaataattctcgggtccacatgtcaaccaccacatcaaaattaaggaaattacacgatgaggatctcaatcccaccagcacgacttcctcctccgatccttgcacaactcgtactctcgtagcggcgtggctgctggtggagacggagagtacgtagtcctccttgcggcggctgacgtacgtcgtgctcctcctccccctcgccgatggtagtgttctcgatcgtatgcgcctcgtagcgcggtagcgctgcacccgttgcacactgctgctttcttcttgtcatggtggcggcgaccggcgatggtacgtgcctcaagacaacaaccaccccgagtgcctcgttgcggacggcgtgacgtgctgcatggcgccgccagcgctgtggcagagacgtggtggcggtggttcagatgagcgtgggccggcggcggcgaaatatcggcatgccctgcttactctgtttccttgtcttatctgtgtacgtgcaggtgtagattgtgtttgctactgtatggcgtggtaagtgctagcaatgagacgcaggcagtatatgcgaccgatccattgatctagtttacggcttgcatttagtatttgttttaagaaacacagtagatctacggcggcataatgttcttttctttttcaagattaccggcgcatgcataatgttctatgttctcccactctcaactcccaagccacggttgtggccttttgtcggctggtgggctggtttctattcttacctgctggcgcaggcacagcaagcgggcgaggacacacaggtggcagcccaatatcccagcccatatgggtgttaccactaggctcggcttgcaacatcggaactccctagtcccaacaaacgttggccgtagtttgatggctccattccagttcgtccgctataataagagagattttaaataaatataacatattctaatatgattaatagtattaagatgtgttatattttattaaaattttttatattttgagacagagcaagtattaaacttgaatacaaccgggaagccgtgttccgccgttccgcgcgacgcgcgcgcccacctcgcgtgtgtgtatactgtcgtgtcggcttgccgcgtggtcgcgccggccgccactcgagtctcgccagggcttgcgcgaccgtcgtgtcgtgacattgataaccggcgcacgaccgcctagtgcgcgcgcaaaaggaaatatggaatcctgcaactgcttgcatgcatttgtgggtttgtgctctggctagcgcgatctcgctaaaattgtgcgtgcgctagccactataaaaagcatttttgcagacgacaaaaagcaatttttacaggcggaggggaggaccgcctgcaaacagacaacggtgaaaatcatccatcttcacaagcaggcaaatggcccgcctgcgaaaatccaataaaaaaacaaaaaaaaatcgcctcgccgccgccgccgcaccgggagagggccgccgccgaaggggagccgcccacgtcgccgccgccgccgctgccctcccccggtctccctccccgccgtcgccgcaccgggtcgccgccgtgtccgcgcgcgccgctgccaccgcgttcacgcaccgccgccgctgccctctcccccggcctccctccggccagatctaggaggggaggccggggaaccacgtcgcggcagccgccgccgcgctcccctggcctccctccggccggatctgggaaggaggggagggagccgagccggccccgagcgtcgccaccgccaatccacgcctcgccgttgccgccattgacccgcatcttgccgctgccgccataggtcctcccccttacccctcggccagatatgggacgaaggggagggagtcgagccggccccgagtgtcgccgccgccgaccagcgcgacctgtgccttaccgttgccgccgccgaccccgcgcctcgccgttgccgccgccgacctcgctggtgccgccgccgaccctgcgcctcgccatcgcgcgcggatcctcacctcgctggagagaaaggtgagggagaggataagtgagggagataatgggacttagaaaaaatctactctagcctggtctatttatattgctccttattttcgcagtcggaccatataaggagcgcttgcgaaaataattttcgcaggcgccgcttaagtggtccaaatatcaccccaatttatatttttgtagacggtcatttggcaccaaaagtcatgtccgactacaaaaaataaaaccccaacgttggggaaaatgttttatctagtagagagcccgtccatccccccgtatgatctttaccacaacagagaacacgtacgcatgaatgaaaaggagtactgtaacaaacgtgcatatatagaagcacgtcgaagctcttatttattcatgtaccacggtctcatttattctcgtacgtacagaccatagataagatgctgcatgtgcgcgtagacacacgctcgtacgtgcgtcagagcgcgcacacacacaccatgtacacgaccgtgcacacacacacacacacactcacacatagtcatacagaaactgcagcctcgcgtacgtcgtccggtgcgaccgaacgtgctcagccgtagtactggccggtgcaggagtcgtactggcgcccgccgccgtggccgtggcggtgctcgtcaccgtggacgaggtgctcctcccggtggccgcccagatgggcatcaccgtggcggctgccgctgtagcccaggtggccgccgccgccgccgttgccgtggtggtgccccctgccggcgcgcgccatctcgtccacctcctcgtacgactccctcctgacggcgtagtgctcgccgccggcgtgcggcggcctgttcatctcctccgcgcagtggtccacctccgagtagtactgcgccatggtgcaaacaactagctgcaaattaattactacgagtgtttctgtgatgtgcaatgcagggttacaatgttgggtttgttaatgtttggttctgctatttatagtgtgcctgcaacaccagcagcccccaaaggtgtgcgtgcgtgtgtgcaagggaatttgttctgagatagatgcctttgtgcattgctgtctgccgagacgtgccagatggccgtttcgacgggaaggtaggagagaaatctagacacatttctacctatcaatatgcccgcgaatttctgactgagctgaaagtttcaggcaagctagggcctagggaaggcagacagttacacagatcatatggattgaagcaaagaagaatgtagatggaataaaagaagagcttggatgcttggtaaatggagtatatatatcctgcaaactagaagagatgagaataacaaagaattaatgtaatgttttgttggaaaaagaagcatgcgtatattgtgaacgtttagcctcagttcgaaggagttgtggggcttgcttaattattagcggtatgcaaaacgagataaatcattagcgtatgattagtcaagtattaattatataaactttaaaatgaatttatttgatttttttaaagagacttctgtatagaaaacgtttacaataaatacaccatttcgagttgttctttagaattcggcctttagcatgaatgggcataccggcatactgtatgaaggaaaccattgtctgatttatgcatggttttatcggagaaagtaaatttcagtccctttccagaatttgatgagtatgttactctgtactgaactttgtttcaattaatatccgggtgaaatcttcttatgtttgcaatgctagaaaatcttataatatgaaacggagggagtactttgatttgggttgtgatggcatggatgtgacaaatacagtatattaagatttacatatttatatatgcggagcaatcctataagtatatgaccatatcatatgtaagaagtattaaaataaaaacttgcaaaagaacaaacgataatcctgtacatgcggaagaatatttggaatctgtaaactaatatgaacaaatagtgcaaaattgcattatatatccattttcacaagaagctcgttttcattctacacctaccaaactgacatcctttagtatggtttatgaaacctcaccaaaaaaaaggtacagtttataaaagaaccaattgataggaacaatttgtgtttgagctgttctgctactcacactgtttttttcttgtgaatgtatgtcctttcattattgttcttgtcctgcttggtagttgtcatcaatgaattgcactgcctgaacaaaaggcagaaagatggcatcctgatatattgtggattacagatgggatcgataacagagatgtacagagatgtgcaatctgcaatgtttccaccattttgaagttcttcctgatcgagcacaacttaacaacgagtaaagatagatggaccccgtgcatatataataggtgttagaaagggggtggccgggtggggaactatatacatgggctgcaggaagaaaatgtgttaaatcaatctacagtctcattaggagattggaaaagaattgaaggtaaagactacaagagtgtcctgaaatgacgagagcccgcgattgagtgcatcatgcatcgattggatcaaacagggatcatgattcatgagcatgagaggcaggaggagcacgaggatttggcgagttcgctgccaacgcacaaccatgtttagatggtgcttgttcgtaaggcgttttactaccagtttaaatcatgctgaattttcctttttgccttctgttcttctgttcttctgtaattggctttaaattttgttatcagctacacgatgttaattatcagtccttatcttttcctaaaaatttactagctagaattctgataagaaagatggttcaatacaaggaccattgtatattccatctgtcttgaaatacttttctgtggatgttattcacctcttaacttggttgtttttttatttgaagaaaatgtttaattacttagaagtatatttcctaacaaaatatattacattctaatataatcataaaatgttattatattttcctataaacttgatcaaacttaaagaaatttaacttgtaaaaagtcaaaatgacttataatatgaaatggaggtagtagtcaataggcatcattatttggaacgtgagagagtatgtaaagaataatttttaaagataataccattttaatagaaaattgtaaaatagaagttggttggctgaaagtttgtaaaaacagtattactttaacaaaattcagtatgtaaaaaagtaattacttacaaatgacaacgccgtaatagtatagtaggagtaaaatttagcatatatgttaaaattaaggaccttctaatttagcgtgttacaattaggcaccgttattggctctcataccctagcttccatacgattggcgaagagccatatatagttgcaatgagatcatcacgatcattcacgatatataactaacctgatggttcttccttgtaagttaccggcaggcagcgacgatcgatatagctaaacctttttctgggcgtctggctgcttcttgcttaattaatgttgcatacgaactgaaactttatactccagactaatcactatcacactatcagagagattcagaacagtaatcgaccggtgataattaggacaagctttattatattcaggtcacgaatttatttttcatacaccccccctctccgttcgtagtgatcgcacagagaagaaggtgctaattagctaagctccgtgtacgcacgtacacacgcacgcacgatatacacgtagagctaagccaccacatgaccaccacgactacgtacgggcacacatatacgtacgtacgtacacgggtacacacagcaggttcgatcagtcggacttgagcaggaagctctgcttgcgctcgcggaactcgccggtgcaggtgttgaagtcctcctccaccttggtctcgcgcaccatcaggtagtcgttgccgtggttgtggttgtggtggtggcggccggagccggacctgtcgatctcctggaacgtctccttgacgacgtgctgctgctgcacgccgccgcggccgaggaagccgccggtgggggtcaccgacctcacctcctccgagcagtagtccacctcctggtagtgagccattgttttttagttggggagtgaggtgaggtggtgttgtgatgagcgagaaatggttaattagggtttcggtggtgtacgggatggtagggttagtgtagggggcggttttatagtgtggaggtgtggttagggaatctggttcgtgagagaggtgcatgtgtgcacactgcacaggctcacacaggctttgtgcttttcgggctttcagcttcgctttttggtgttcatctggaagtatttggaatattattgatttatcggccaggatgatacctctgcggcggctgggtgaactgtaattggacaagagagagataagatggactaaatagtattaatctgccgttaatgaggatgtttttcatgaggaatggtgggtgattttgagttttaaccagccaatcatggatctgtgcaagcaagtgttctgtacttctgtcgtgtacatatgttcagatttcagagtatcaactcacgagaaggcgcgcctgaagattcgtgctaaaatagaggaaatggagaaagccaatcttgaacatggtacatggaccatgcaggcagaggtaatatataatatgtttattcattcattagtttctaaaacaaaacatacttttattagggttttttttgggaagtatattagttaggtttgataataaaggtacaatggatgaattgttagagaacaataaaatattccatcgaaaccaattggtccaattaatcataatacaacgggcatctctgtttggttctcaaaatagctgaaatagaaccctggtgtttaattaacccttttgttactagctaaaaaactattgtcatgtaagcattttccatttcatgtggcttagctaagctgccttttaacctgatgcaaaattgcatttccatgttaccgctggtaaatgaacttatcgagatttgcaggtcacattcgaaataagtcaccggtcgggtaagaagaatatactcatcctttgtactacctttgtgttagtgggaatatatacttgcgttccgccctgcaccgcattattactgcacttgggatggtgacctcaagatgctcgcaggtgtgatgggagaaaagaggaaccaaagtttggaaatggtgaacacatccagacgtgtatgtgatcagttatgcgatgcatcgcccatttcagattccttccagcatccataaaaaaggaagaagaaatcattcacagcagtcattttctgaccagccgccgttggttttaaaccaagcggttattcaagaatgtggtacaggaggattccggaaacactatctggcaattggcatgatcatgagtcacaggattacaaacaaaatcataacgacagattaccaattgacttaagtatcgacgatcaatatcttttaaccgcgtactgaagaacaagttgacagatagatgcacaaaacctgctgattctaaccaacatggctctcatgccgaagaaaatcactcatttatactactcaattcgcacagatcaaaattttggttttgaatgtgacattgctgtgtgaaacgccatctgtgggttcactaatgcctcttcctcttgcctttatggtgttttctccgacctccgctcttgaaatggggttcggttgaaccgacatcattatccttgtctccatcgacgaacatgttaattccaagatcgaatccatctgttaggccccgtagcctgttttgtttttcaaaataagatcagttacatacacaggttgggtatattggaaatcccaacggacaacctcagctttaagctatacttgcacataattttacgtattttataatggatagtagcagaagatcagctccacatacccgtgaagctcttttctcatccacttctccgtctgcttatcacgttttgtcagcggagctcgagtgaacagctcctcttcttgtttctcttgcaactctctctgccgcatataccttgtaaattccctgctttcatcacctgctgtttcctttaactgcaaaataatacagatgattattcaggtggacatagaacactaatcatataactatacatctaatcaaattgctagtgcatcaaatgaaataactggcaaacctcttcaggtctatcagcagcgtcatcaataatctctttgaagtaagagctttctgtagccattcgcgctaatgttttgtctttccttgaagcttgtttatggcgcttatcctcatcatccatggtagcagcaataaattttggtggacgatagatgccatcgttgtcctgaagtcagggatgtacatcagcaaaaataattgtatgaacatgtcaaactaactaaaaaatgatcaataatgctctaacaaacagataaacagttcagtgtcaacggatatagtgcactcatatattctcaagtaattccaaatatgaaagaaataagaaaatatttaactgcgattagtatgtccatagaagcaagcattagaattaagccaacgctgatataaaaaacaagataaataaatcaccattttataaattaagtcaagaaatactacatcataagtatccatatatcataattctaccaaggtgtggactaatagtagttaattttaattccagacgaggactatactacaaaaacacacgaaagaagcatggccaggcttagcctagctgacaattacttaagaactattggttcatcgttgggctaaagtaccagctagatgtcaagtttgatttaatgatatccaaaaaaagaaaaaaaaatcaacgaatacaatttctacaatttcgagaaggtaggtaatttcaggtgcacacaagaacaaatctgaccacttagcaagtgaaaattaaaaaataaacagtgaaattgtttgtggagtggaaggggagatgaacaacctgccccgcaggatcgatcttagagtccatcatatcagggttcggccgatacttcagtaggtcttcatcatccttaggctgatccttactctttgcttctgcatttagcaccttctcctgggcagctccgctatccgcggcgttggtgagcttctggatttggtactccatcttcttgtctatgggacgaatctaaaatccatccaattcaacacagcaccctccaatgttagccaacaaaaattgagccatgaaacttaaaaatcagtacaggagggctctggcacaccttctccaagaacagcctgatctcgacaaggctccgcacgacggggtgaccttccaccgagagccccttcgccttgcggaggagatagtagacgatgtcctggcagtagctcagcagcaggtggtgctttgcctccaggtacccaatcccatccgccgtcggcagctggttcttcttgacctacccacacatcaaacgcggaatgaagctcgctgtcatcttgccaagaagcgggagagatggggcaactcacgaggaggaggggaaagtgggagtaccttgcgggtgagcgccttgaccttgccggtgacgaggtcgagcccttctttcatctccttcaacgcggcgagcagcttcggcgcgtcatctccgcggaagaccgaaccccggccaccagcgccgtcgccggcgacgccggcaggactggcagtgccgccactgtccatcgggctcctgcaaccgccggacgccttcgccccgcgcggagtaggatggttaaggttggctccaccacgaaggggagagggtcgggttggcggagcgaccggcggccggagagcggagaggaggcggcggtgaggtcgtgtggacgacggcggcggcggcgggtgaggatgctcgcgcgcgctggacctgttaagaggctagggctttgccgttttgttgctattgggccacctaggcttcctgggctactttgtttagagctaccgaatgggcctgtaagcccagtaacccctcgatcatcctaggattgaaaaaaaaaatgtaagcgtaaatagtagaatttaaaaagcagaaatgatcgtttcaatagatcacatgaaaaatatataaattggataaaataatagatttaaaaaattcaaaagagtttagttgtcgctaaatttcctctaaaattgatgtttatttgtcagaaatttcatagggtttaaaagtttcagtccttcatttcaaagaatcgaataggacaaattttttataggatttaaatattaaagaagtcctccctgaattctttgaacgagcactcttactctgcagttctcttttactatagcagcagtttttcaaaaagaaaaaatcgtatattcatgtgttatgtttcgtctcgacatatccggttcagtttcctttagaaacatcaatccgtccactctaacacggtctccgagttactactttaaccaacaatatatatataaaagtaatatattttaaacaaaaaatagtataatagtttgtttaataacaaatccagtgatatcaattttacatgattaattttttttgtttttttcagttaaaaatgtttgatttgacactatactgaaaatgcttatattttaaaacagagaatgcttatattttgaaacagagaatgcatatattttgaaacgttgaaacggagaatgcatatattttgaaacggagagagtacgtttttaaaattgctatcgtacttttatcgttcaaagttaaccaaggacgttaataacttccaaattgtcaagcaaagagagaaaatggtatacatcttccccgctcctttttccacatgcaccactaacgttcacatctctcaaagttatatatcagtgtaaaggttgttgcatgaagcactaccgttgaatagcaccatagatcaactgaaacagcctccctatcattcgcaactcaagttgctccaaaaaatgaatagcaatagcacaaataataccggatactaaaaagataacaaatggagcaaactgttctttcaagtaacccaacaatagtaaacaataacccggatactaaaaagataacaaatggagcaaactgttctttcaagtaacccaacaatagtaaacaataaccagtaccgcacgaggacgttgcctcaatagtcaaaataacactggacaaaccattctccaagtcgaagctaaacttggaacacatatcctacgctgttggataagtatatttggccattcgtgtgacatgttccacctccaatcaatgaaaattgacttatgtcaatcaagcagtcgagggaatctcaaaggaaatttaccaaagaatgcatttaatacctatcggtatacagtaaaagttttaatctttttgccgccctcagtatggccttcttcctcttatgggaatgctatttgagccagatctgttaccaaacccaccacgcccccttgaccggaaattgcctcctaaacacagatacaaatcgattagaaaataaggaaataacataatactatccaaaagaaaaactgaaatagagaggcacctacctcccatagaactggcagatttagccatagattctagcgctggattcacaacctggccagcttccctcaagatcttaacaagattcctggagaattttgcattggagagtgtgaaaaaggtgaatgcagttccactagcaccagcgcggccagttcgacctattctgtgaatataatcttcaagagttgttggaaaatcaaaatttatcacacacttaatatccttgacatctgcaaaaataacaagaaaatgatgagtatgtaatcaagataatacttttgccctgaagaccacagcagaccaaactgggatatcaacattgtcgatctccatagaagtcagcgcatggcttgaaccagagccgaagaacaaaaactgcccatggatgcactttcaagttctacaactaatacaagtcgaaggggctgaaaaactgaactgggcatcaataactgttggatgtggatatgatggtgattgatctgtcagccttaactcacaatactgaaagttatccaataacataccagtatccataactatccaaatgaacccaatgaaaatctgtaaccaattccaacacaggctgcaatgcttaaggtgctgcatcagaggtcaatatgaggatcacacttcacactgtcaagaacaatacagtagtaggcaatagctctacaaacatcttgggaccagttggcagtgataagaccagggcacacgtttaaaatagcagcatataaacttctaaaaattcatggaaaacaagggaaagcataacagcgagatccacacttctaaattacttcatttgtaaatttagttgaatttacactagtgacttagacaaataataattagtagacattttcatgtatgcatgcatgcgagctgaaattgttgttaagccacacatagatctacgagatcacaagtccacagcaaaaagggaactaagtaacacatgaataataaataactaaagatgcaaaagaaagtaattccttgaggagagaatagattcatataaccatatgaattttagcgcaggaaaattaacaggcctgaaagcgaaagcacctagagctctaaattttcaaacataaaaatacaaaacaaatttagaggtcaacagatgaaaaaaaaaatagtgctaatgataatggccatagactctcatcgattctatatttctacctgaagataagttcccctaagagtgaaagaccaaaagccaagtaattttcaaataattcctaaccaagactaaatgtcaacattaggttgaagtgccctggtaacactgccatcgcttactctcgagggaaataaacaggagaaaagacgatctacctctgacatgatggcaccttgcatacaccatcaatccacaagttcagttcactcaaccaaaaacagctgacagccctccgacttatcatccttgagcacttggaactacaacctaattctaattttcaaacaagtcaccataccaagaccacgtgccgctacatctgtggcagccattataggacttttcccactcttgaactctgccagaacatagtccctttctgcttgagctttgtcaccatgaatagataatgctggccatccatccattctaagttgacgagtgaccttgtcacagtcctttttagtttggaaaaatatcaagattctgcttccatccattagatcagataaaagtttactgagtctgtaagaaacaagttaacattaacttaactcatggaaatttttagttggaggaacagctcatggtacaactttgtaaataatagtgttattagtagatacctgggatacttttcgtgttcagatatgacctcaataatttgctgtatggaatgattagctttcagatcaggtgatcctatgattacctgagttacgacatgtgcaaaatgttagtaccaagaaagaaaataatagaacacaaaaatacttttcaaaagatggcatggcgatggcacaagttattcgcaccttgtatgggttctgcagaaattgtctagccaaggattctacttctcttggccaagtggcactccaatacaaggtttgcctgtctggccggatctattaacaacaaaaacgtttagcacaatagaaaaaatggagagttagccaaaacaccagaactgatataagcattctaaaacaagccatgcctgtgccactattttacgaatctggggctcanaacccatnncaaccntccnnnncnnncttntnncancgagatatgttactcttcgcaggttagtgtgaccaccttccagcatatcgatcaaccgaccaggtgttgcaatgacaatctcaacccctggaagtagacgcaagagacttagcctacaaaaccttatgtccaaaattattttcggtaagatgggacaaatacctctcctaaggtcacgtatttgtggtcccttaggtgctccaccatagatacaagtgcttctagttcttgagtatgatccaaatttgccagattcttgttgtatttgaacagccagttctcttgtaggagcaaggatcagaacaattgggccatcaccttgttctgcacccgttacaatgcattcattcaattgacaatttaaaatagagagcacgtacatcaattccgtaacagaaacaaacctagtcgaggctgtgcaccaacatgaaccaacccagggagaaggtaagatagtgttttcccagagccagtttgtgcgataccgatcatgtccctgcccttcaaagccattggccaaccttgtgactgaataggcgtgggctctacgaatccactcttggctattgcttgcatacagtaatctgttaaaaaatgaaaaaaaaatagaacgattatttcatccaagacatgttgccgtattatccagagatacagattgctataacagttaacagaaccccgatttgaaatagcaaacctgggaagttggcctcctggaagtagcgaaccggcttgggcacgtcgtggccttcaacagtgatatcacgctggcgacgatactgcgacacatccatgtctgacatggcctgcacggcggggcactccacatagaagttcttctcgaagggtataaggctccggaagtcaggcttcggcaaggagagcgagtccagcgcgtcccttccacctcctctcccaccgccgcctcggtatccgccagcgccaccaccaccaccaccacctctaccccacccaccgccgcccgcgcctccaccacggcctctcccgccgaagcgcgagaagtcgccaccagcgggggccacgggagcagccggcgcgggcgcgtacgcggcggcgtaggggttggcggccgcgggggccgacgcggcgagcacgggagccccggcaaggtcgctgcacggaacaaccaaaccaatcgattcagtcccatctcaacgcagatccacatcgagccgtgagctaagctagggttagggttagggttagcgtacctgcgcctgtcgcggtaggaggaagggtcggcgtagcggaggtcgtagggattcatgtcgccggtacggtacgtctcggtgcgtgcgcgcgcgcgcgagggttcgccggagtccggtggcgccgccgccgtgggggtcgaggaggaggaggggaaggggagacgacgagggaggtttggatctgggaggaaggcggcgtgcggcggggtgaggaggcccgtggtttggttttgatgggtaaggatgcgaagcgtgtggggccgggctaggtcggttgctatggcccacgtgtcatggtccttgggggagggggggggagacgcgacgcggctcgtacgcatgagaagtccctcacgcaactttccccgcgtgtgattgggccatgtcgtaaactcgtaatgggccgcatctccctttcactgtaggaataagttcactttgcgaccctcaaaaggtatcgaaatcttatccgtggccctaaaccacaaaaccaaatatcttaacccccaaactcttaaaaccgattcaatttgactccctgggcggttttggagagcggtttcgctgacgtggcgcctacgtggcgatattgaccgagtcttcgttgtacgtggctttgacgtggcacttacgtggcagttgaattaaaaaatatgagtgggacccattagtcattcacacaaaaagaatgtgggcccactgacatgtggggcccacatgtcagtcctccttcctcctccctctctcccttctctctctccccccttcttccccttcggccaacgggcgggagggcagcgagagcgagcggcggcgggcggcgaggccggagctgcggcggcaggcgagggctccaaggtagagagagaaaatccaaggggagctcgagcaatccgccatccgtgtcgtcggcggcgaggtcgtcgtctccggcaaggggggagccaggtcgaggcgaggcgggggagcccggaatccgcagatgcatgaggtacaaagcttataaggcattactaatcgtacaaacggcggtgccggctacttctttgcaccgccggccttactcctgttgtccgtggaggtaccgccgccgccgcccgcggcctgcgccgccttcttggcggccttctcctcaagtgccttcttatccctgcgtcaaatccaaactcgaagatctaagaacccgcagattggaaccccgcgtcaggccggggacaagggagatcgaatcgggagacaccgagcaaacagacctctcgcggcgctgctccgaggtgagcccgtcctgggggtccttggcgttgggcttccgcgcctgcgcgcgctcgcggtcgcggttcctctggttgccgcgtgcacaccacgccgccggcgagaagtcaaggaagaaacagagggagaagaacggatcgccactagcaagaacaaaaacgagatcacgacaagcaaacaacacgaattcgagaggtagagcaaaggatacgaacaaacgagatcgcgacaaggaaacaactctggagctgcgctggtgttcgatccgcgtcgcctcgcctagccttcgtcgccgtcgagggcgccggagatggccaatcaccgcctgccctcgcccgccgccgcagctccggcctcgccgcccgccgccgctcgctctcgctgccctcctgcccggccgaaggggagagagagaagggagagaaggaggaggtagaaggaaggaggggccccacatgtcagtgggcccacattttttttgaatgactaatgggtcctactcatattttttaattcgactgccacgtaagtgccacgtcaacgccacgtactaacgaagactcggtcaatatcgccacgtaggcgccacgtcagtgtgaaactgccctctaaaaccaccgagagagtcaaattgcaccggtttcaagagtttggggtcaagatatccggttttgtggtttagggtcacggattaaatttcgatcacttttgagggttacgaagtgaacttattcctttcactgtacgcggccattgcttgggctctggatggcctggtagtcctcgagctacaaatactcggcatagtggcccaggagaatagtagacaagtttgaggtctcatcggaggcatttcacaagaatctcgaaggaaatatatagtttttctttgtataagatttctgcgtttcaaatgataaaaagctttcggatgaccttgaaattttttaataggttgttttatgtttaccgcaattgaaaataggggacaataaaggctaagagaattgaactttcacgctggctttggtccaacgtgagacatatgcgctaaactcgagtctcgaacatcacgcacacgaaagatgggattggcagcgctagtgaagttagcagaggaggctgtagccaacatacattttggatgagtaaatggcttcatatctgcatgctaagttgttgccccaacctccaataaccgttggcatgttactaggagatatgtgatggtatttttatttgaattgaagcagcgggtgctaggaacaaagatgtctagtatatagcacagatgcataaagtacacatcctcacttcctttgtgggtgtctgacctttagtttcatgatgcagctcgctagcagaagaaaccagtgtcgtttggatgtgtccgaatgccgagaagtggatggcaccctgcacggtggcaccacatcggtgaggggttaaataccagtctacaactcacgccaaaggcaccatctgtttcggcattgtcaacgtgaaccttaaatgcactctacgagatcatgttcactcttttgctccgagcatgattttgagctaggctggtagccaaaagcccatatcgctataccctggtccaagctgcaaacaagtgtaatcttatatgctgttaagtgaaaaacctagtagaaacatggtccatcacgtaacatgagtaataaaaactagctatagtgtaattcgctcgtataaataaaatgaaagatcaggaaaaacaaattgaaaatcatgcaaatggcagagactaacggacccttcgtttcgtttattcgcggaataagccaaacgatatatttacaaacgaatagtaatttgtgaataaaaattttatatacgtgttcttagtgatataaaagtaaatactaaaaagtaaactttaataaaataacctcaaaatttaatattgaaaattcaaattttgactaataaatataagcataagtgaaaagattggcccaaacaggagagcaagtttaatagtatagctaactgttggctccaaattatctatagctaatataatagcccatttatataatagttaactataaaaatatactacatcattaatactagcccatttatataatagttaactataaaaatatactacatcattaatacccggtcccacctctcatacacacgtaacgtcttggaatccgtgttgtagccggctacaaatctgtagtccgctttcttctctctcttctctcttcttctcgatatatgattatagctggtttataactctattgtacctgctctcaaagctaaaccagagcaccaatctcaaagcattctcctcctccccggaggccggagtccagacgtcgaggcggctgctgaccggggggcgagcgaaaatatttctagtcgtctccctccctcaacctctcatcagatctggccactcccacgcacccagtctcctaaaccctacacaccctccccccctctcctctcgccggccgcgccacccgccgccgccgcggccatggccgccgccgggggtctcccagcctcggccaccctcctcctcctcgtcatcgccgccgtggccgtcgctcccctcgcctccgccgtccgcccggtttccgacgcccacagatccgctgccgccgagctcttcgccgcttcccccgacggatccttcggcgagtaagtcgacagtgtcccgatctcgagtgcttgtcccacgccgggcgcagttgcgcgcgcgccaccgagctcagctccagatcgatccgaggcggggctccctgcttgagaattatggatgcttacttgcgttttggtctgttcattcgcgcagtttggagacgacgtatgaggcggtcaggacgttccagatactcggggtggagaaggacaagggcttgattggtaaggcgtgcaagttcgccgccgagaagctggcctcctcgtcatcgtcgcccgcgaaggatctgttccacgcggcccggatcagcggcgtcctcaagtgcagtgttgattccggagtttacgatgtgggtcttagcttagcttaacagatcttgttgatgccaatggggttttcttgtttgatggcatggtgacacttgtgttattggtgttaggatgtcgctacgaggcttaaggctgtgatcaaggacactaactcgctgctggaactctactattctgtgggagggttgctcagcatcaaggttactccgctgaattcactactagtttatacttgtttgtttgatttgctcatctccacttgttgatagttggttgatcttttctgtccattaatgaatttgcattgtttgcttcaggaacaaggccacaatgttgttttacctgatgcagataacacatttcacgcaattaaggtgacaacagttcattatagctttgcgtttttttctcttgtttacattctgcaatttacatcagaattttattttaaaattagagttgctgagatgtgtctttgttcgtttaggcacttagccaaagtgacggaagatggcgttatgacactaacagcgctgaatcgagcacgtttgctgctggtaacagttattattaaattgtaacacttaaaatatttctggcacctgtaaacataaatttaatgttgatctgaccttgtattagagggtgtgcttattgctgttcactgtttaatttcttgagactcatttaagttattatagggttgaatagtggattagtaatcagtgcctctatctctgtgaagctttctataccaccattcaccacttaatgggaagatctttactgcaattgggttgcatattttttgttactgatatttaacataatgtatttctacaggtatcgcactagaagcattgtctgcagttatttcactggcagattcggaagttgactcatccatggtgtgtgcatcctctctacttgagtatctagtatatatacttgatttgcaatagctatatgatttttcttcctttgacctaaataataaagtaccagtaatttcatatggtgtaaattatgttataaaaccatgaatagggaagtggctttgaatggatggagaacatatatagcactcatcttatagattatattacctctgtaactgataaagaagtatcgatgaccatagatagctaaatatcataatacaagttcattaaagtttgaagtgcttaatttcacaagaaaacaacaatctggtaatgttgtatctccccaactatcctcctttaggtgcgacaatctttcatctgaaaccttgaacatatatcaaccttgtctgtgattttaaaagagattcaaccatgccactatggcattctatgtaccatgactttcatagtttattttagtgattatgtgttatcttttgtgtagcactgcttcatacaatttgttggtgctcttcattcgtatgtgtcattgcctgttagcatggtgttgcaaatttgtactgattcctgtttcttctattaaaatatcatgacaacagatagctgtggtgaaaaatgacattgtgaagctatttgacacgatcaagagctatggtatgttctataaccttttgtttgtgctgcaaagttaccctgatggtatcagcttccaaattacaaaacctatgagatttagataagtgacagtagccagtacaatttatttttcatattttgattttatgcgtagtaagtgaggaaatttaccttgcctactttgaaagattagtaggaatcatcccacctacaaatacaaaatataatgaatgaatactttctaatggtatatttgcagatgatgggacattttactttgacgagaagcatgttgatgctgccgaatacaagggccctataacaacatctgcttcagtagtaaggggtgtcacctcttttgcagctgttgcttctgggaaattgaatgtgagctttcttgcatcaatcttgtaataatcattcaataaatttatgtgtaaaagcttttgttaagtagctgcacttaatctacagatccctggtgagaaaatactgggtttggcgaagttttttcttggtatagggctaccaggtagcgcaaaggattgctttaaccagattgagtcattatcattcttggaaaacaataggcaagtcattatttatttgttttcttcaattggcatgcatcttttattcttttttgtaatatattgagtgacacctctttctgcccttttcttaatatattttcaaaaatgtaaatgtttcttagtgcactgttagccttttgtgcttatttcttatctacaatttgcagggtatttgttcctctggtcctttcacttccttccaaagtattttcgctgacctccaaagaccagcttaaggtgattagtacttgctaatatattggattttgccagatgtataaaatttttactaggattgagtgtgaatctctgtatgaatgagcattcgattgatatgtgctgtgatgaattgacatttatatgaacactgcaaaagtgactgttatgatgggagaaatcccatattattcaacttgcaagcactgcatttaattgtaaaattttaattcctaactcatatcatattttaagtttgaaccagcaaagctgttatagtaactcacatgccattttcagttgtccttctagattatattctacacctagatttttcttattactcgattatgtctacagttagtataaagtataccttatctacaatagtttctcatcgatttcctttttttgtaatgttttagtccatataagttaactccagtttgtaaatacttggcattttcaggttgaagtcaccacagtatttggatctgctgcacctcctctcagagtgaatcttgtacaagtgctgggctctgactctaaggtcatcactactgaaaccaaggtagaatcaagattagtggctacctcttggaacttcctctatgcctgtctttttcccagctgccatcctctaaaacccttttacttctgatatcaggaacttcagtttgaccttgataacaatgttcattacctggatattgctccattgaaaatagatgttgggaagtactcgcttgtttttgaggtatgtgtaaagtgtattagtttgtttgtgttatgataatagtaattgacaagccttttttttttctcgccagatttctcttcaggaacaagaacatgaaactatttatgctactggagggacaaatactgaggcgatctttgtcacaggattgatcaaagttgataaggcagaaatcggaatttctgataatgatgctgggactgtggagtctgttcaaaagtaaattgtttaacgatgtgattcccttccatttttttttaaaaaaaaagaaagagagaaaaaaagttagagctacattaaaaaaagacaagctgccaaccttgtactgaagaaatttcatctgctttcttaagtatatagccactgaaagagttccattctcatctggaatagcagacaagtgctacaaaattacttagtttttatttttcatttccctgatatatgtctggagattttcctgctatttttaacttgtttacttttgttgttttgtgattgtgaatctatttaatattctgatttagttaatataaaattgcatgaaaattgtgaagcgggaaagcctgctttatatgtctcatatttcaagcttcttcatttcaggatagatctgcagaaagatactagtgtttctctttctgcaaaccatctgcagaagttgcggttatcttttcaactgagtacaccactcgggaagacatttaaacctcaccaggttgctctagaatttaaccctttttttcccagtggaacactatggttctttccctgacttcattgagcaaatcaattttcaggtgttcctcaagttaaagcatgatgaaagcaaggttgagcatttatttgttgtaccaggctctgcaaggcagtttaaaattgttctagttgagtaccccatcccccagttagttacactcatctttttcagcttgttctatgttttcgagtgctacgtcatcatcagtttcctgtccatgcattacattatccagagactagttatatacagagcagtttctcaatgtggaaaggaatagctaggctatgtagcttggtttgctttagaacacatggccaccagcaccatttgaatttgatgtcagccatatttatatgaacactgttggtgaaagttgagatttgaagaaaaagactaccatgtgcatagcatatacattgaaataaggcaaaatttgctataggacacccgaaaatcgtgtaattggctgtgagacaccgcaaaatcttggcttggcccacggacactacgaaatttgtgaaattggctgtgagacaccgaaggcaatatttataatttttgaggcaaaagaggtcagataattttttaaaagaccaatctacccctgctcccagctgtccatctccctccccaacccgatttcccagtcctgaaccctaaccctaggcgacggcggtgc

SEQ ID NO: 1475 - DNA, 3834 bp, Oryza sativa
ccctgtggcaaacccgacgagtcctgacggcaagtgcgcggtctggcggtttcaagccgatagcggcggacggcggatctcagttgccaaatgaagggcacgttctctgcacagtcgtcagttaatcaactaattaagttgtcctttggtgacaaatatttcctggtgccatagaccaattagcatctgagtggattataacagtaggtgcatcgtcaccgtgcaggatcaaggaggaagaagcagccaaaggcagtaatggagcgcaggcggagaagacgagcgagagattttctctgtatggaacgcgctaggcacggccctattcgcgtctgtgcgcggcgaggcgcggtgcgcacatgccatgccggcatgccaattgcgcaggggtagattggtcttttagaaaattatctgacctcttttatctcggaaattataaaatattgcctccagtgtctcacagccaatttcacaactttcatagtgtccgtgggcaaagcccagattttgcggtgtctcacagccaattacacgattttcgagtgtcctgtagcaaattttgccttgaaataaacaactgatttatttatatatgtttcaacataatatagcggggatggatcttcctgtatttttcttggattcagcctgtatttgctactatacaaagacattctcatgttaccacagattataatatcatgggatttgtcagtaacaagtgttcctacgtgtctgttcaatttgtcataggactttcttggtttggtggagaaattctactacctttctggaagatatgacctggagcttgcagttggtgatgctgcaatggtatgtaaccatgttactggactctcattcccgttttgttgcccttgctgatttctttttgttctcaggagaattcatttctacgagcccttggccatattgaattggacctgcctgaggccccagaaaaagccccaaagcctccggcccaggctgttgatccattctcaaaatttggtccgaagaaggaaatatcgcacatattccgttcaccagagaagaggccacccaaggaactctcatttgcgtttacgggcctcacgcttctgcctattgttgggttcttgattggggtgggtcaacaactcctatgtgtgtttcttcatttctcctttgcagttttttttgtttagtctaacgtgtcactcttatgttgtctatgcttgtggcattcgtttgcagcttatgcgtctcggggtaaacttgaagaacttcccgtccttgccagcacccgcagcatttgcctcacttttccatgctggaattggagcagtgctgctgctctacgttctcttctggattaaggttagtaccgttcattgttggtaaagcataattgcattaacaaaggtttctgctggcgctgacattcattcttgttgtaatagctggatcttttcacaaccctgaagtacctcagcttccttggtgtcttccttgtgtttgtgggccatagggctctatcttacctttcctccacgtcagcgaaacagaagactgcttgagaggacgatccaaagaggagtattccgaatcacaaaattttcaagcgtcacaagttgcttaggttccttattttagcaccttcgctttgatattctgaccatttttcttgagcaacttcgagttacgagggacgagtcgatttcagttttgtgggggttaagaatactggagctagaatgtaggacctcaccttcttgtatgatgatgccctgatgtgttctcaatagacgtatgtttgatgatagaattaataatatcttattctgcaaatgcatagtatgccttttgcaaaaattgagttccatatgcagaatatgaacactcttaatcccgaggcccatatgatatcacgaacggtgacttcagaatttagatatgattaaactttgcacgggggcattcgcgtgctccatttcatcagaccatatggttctggaaacacaccttcgctgcaacctgcaacttcgaaaaataatgtctgtttatcgtgacacggtcacacaggtatacaaattgtaagtatacaatttgagaaataagtatacagtgtaatgctctatgcaaattgtcaaaactggagtaaactttccctgcagagtatataagttatgatttccgatggtcttgactctgatcagaatgcctatacatttgtattacaggttgcgcctgatgacatgtataactatttgacttctgtaaagaatcatttgcagttacaggttcccggatcctccatactaccgacccgttttatggtgggaaacaacttcttagtttgattagttatcatcatttgtaaactatccagtttcacctgtttggccaccacggtcagggtcactcgtaaagaatacaccaattactaagaactctccttgcctgccgttccacttgaaaaaaaatggtgtggagtagaccaatctctgtgaattcaggactaatcgagggcgtcgttttgtcgcctagctaatctggaatacaaaccatcgtgcttattaataagctcgctgtggtttccatcctgcataccacacaaaagaactttaagaaatctgaatgacatcatatcatgtgtatagtaggatcagattagttctggtttgcgttttcagtgaagcaacagcggccgaaaacatacctccacaatattaccattttccatcacgataattctatcagccgcttgaattgtagatagtctacaagagaaatgattgtgtcaactaaaatcttaaattcaaaataaacaactgcagtatgagcatacattacctgtgagctatgatgatcacggttcttctagccttaggatcagtactaaactttgtgattacattctagcaaagcaggagggagcgaatcagcaagccgcccataggcacattgtatttatatctaggtacataattggtcaaatatcttgatgaagaggttaccttcacataatgttcactctcagcatcaagtgcactagtggcttcatctaataccaagatggatgggtccctaagaagggccctcgcaatagcaacgcgttgcttttggcctccactaagaagagcatcatcgacaatggtgttataaccatcagggagagacattatgaaatcgtgagcatatgcctgctttgcagcccactccacttcttcattgctaacttctcttggacaaccatacctaatattagaactaatatccattcggaatagcctaggttcctgcacacaccaatatatgtggctatttaatacaacaaaagttctagtggtagcagagccttgagttagatctgaacctgtccaacaaaaccaatcctttccctgaaccatctgatgtcaagctcactgagtgggacaccatctactaatatctgcattgatcacaaaacataacttcagaccagccaactggtttgctttgaagcgactgcatgcggtcatgtggcacagacaatagtttgacgcagaaattatcttacttgcccatctgtaggttcatatagccgaagtagtaggttaactacagtactctttccacttccactaagaccaacctttaaaagtttcatataaatgcagccagtttgttagtcagaaatgagaattcagaagtatgaaataattaaatcaactgtgttcttctacacaacacacacacatagggagagaactagaaagcaactgtgttctctatctcttacaattgcaactacttcatttggatgaagtgttagattcaatccacccagaattggtacctgttaaaaaa

SEQ ID NO: 1476 - DNA, 13750 bp, Oryza sativa
acaacagtatcttgtaacatgcaatttattttcttgccttcagaactaagctgtctgctaggaagtagatccatcaaacggaagaccttttcacttgctccaacagactgcatcagagaggaccagttgtctccaatccaccatgttgacaaaattagccactcagcatagagtatgaattttgtcagttgctcagcagttagcttcccagccatgatggatatccctccaatcaacactgcaatgacctacacaaagcttatttgcaagaatacatcatcaacggtacaacaaattcatatcagaaccaggcattttatattttacaaaattgctaatttaaatatgttctgattggagtatcattatgaattgaacagaaacatcaaactacctgagtagaatggtatagatagttcaaactcaagctccagcctccataagccattgtttgccgaaagcttacatcatatagcttatctagccactttgcatatctatcagagtacaaggcatcgtgagattttgtttttgtgtgtatgtatgagcgtgtttgagatagagagagagagagagggaggtagagattgccttttaaactcctgcttttctgttccataaacccgtactgtccgaaccaaacttatcacctcttgagcaacctgatttagtttaatgtgaaaactgagatgaaaactttgccttatgaaatgctaccttcatccaaaaatataagggatttttcccatgggacagaggaagtagcttattgtaaagagtacaaacttacattgttggcacttgcagtgaactcctgtgcaaatttggctgctcttttctgatacctattaatcacagtatcataatgatttctctcgcatggatcacaggtgttaagcaacaaaataaaaacgtggtggtgcttccttgaactttcactactcaggtaatgtaatatgaaagacagctaacacagaaaagggagagacaatatacaaggtaaataagagtaggtttttaccgtccatgaactagcataatggtcgacaatgtcgcacaaatcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcaggattaccaacttctttggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcctcgccgtcctcgaggcgccaccagcttcccccgggcagcacgttccgcagccgctcgatgaactccccggcgagggcgcgccgctgggccagcccgccgaactctcccccgatcgccgccgcggcgcggatcctcgtcggcctcgcccgccccggggccctcctcgtggccgacgccgaccgcagaagcagcgacggcgccctgggccccaccgccgccacgcccaccgacagcgccgccgagccggtggccgcggtgaggagcagcgccgccggagtcggcattctccactctcgtcaaaccccctctatccctcccctccacccccaccgcccgattcagattccgattccgcgttcgccggtgagagagtccgccgcctcggcgagcaccggcgaggtttaaataggcgtaggccgctgcgtcctcgccggagttggttgctctgccgtgcgcggcaccggcgccgtaacgtctctaccttctccggctaaattgtattttttccgcggcttttttaatcctttttctcttccacttttcgcgtgtgcttcttttttttttctttttcctaacgtgttttttttttgcgattttttctacgagaagaaatggatggaatgaggcgatgtggtgtggtggtggtattttgggggatttaaaacaattttctggaggagaataatcgtcgttggattttaggattggacacggagaaggattgaaagaacggcttcgtgcgtggtcgtggcattggaacatgaggtcggtgacacactgacacgggatgttagagaacaggtggtggtgccgtggtggtaggccctatatagactccatcgtttgtcatggagttgaggtagtgtttgtaaagtgctcccggttttaagctttaaagtagtgctactgttgttgtaaaaggtcaactaaccacttataaacgttgcagtatgggttagtataaaatattatctcgatcacaaaatatgaaaatataaccacatttaaatagattggatctatcgtactatgaatctagataggggatttgtatgattcacccgttcaaaggttgctatattttgaacgaacgaagaagtaatttaacatagagcatgatgatatatgtcacaccacaaacatttcagttcaaattttatcttcacgaggaaaaacaagttctaaagaaaagctggaattgaatgagcatgggggcatggtacgatgcatgggattcgatcttcgtcaagagcattttcttacaacatattccattcgtttcaatttgatcgtcacccataatagccctactcctattgatcagccaatatataagcgtggaactcgagcatagtggttgaggttagctgttgtaagctacgagattagaggtagcttgtattgtgttatctctgtttcttattggtggttccccactcttctcttgggccttgtatttctacactcaggtgccatcttatccaagtagaagtgtagaactaggatgcaaggatggatacgatccgagtggtcttggtcgggtcaaagtacgattgtattttttttctttatcggggactcctttattttctactacggactctaatataacatacttgtttccgtatatataggacttggaacatggtgctcccaccgaggtatgtacacgtatgtagaatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttgaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtcttggaccgccaagccccccttgaccccctctcttcagtcgtttattgacatcatcgacgatctccgagtacgggggtttttcgggatatgaagtcgttgcagacttcgttggtaggtggatccagccgcttcaggctcgggcccatccagcttataactattccgggccaaaggacgtgacccgagtttctcctcggggtatctttctcgcattcatcttgacatacttgtgttcgcattcctcttgacttatcgtaggatggttctcgattaacaggtctgagcggcgaaaccgtggagcgtcgcgtcggccaagtgatgatcagcgacccgaccacggcgagtgacatccctgtgcccctttgtgaaaagggggcagcagaacgtgatgaagccatcaacgtaagtatattcgatgaatatcccgcattctcctttcgaaatcactttatgacttgattgagcgtaggcccttcctttgactgatatcatcggaccgctcacggaccatcaggtggcgtcatctctgaaagtgaaggtcgtcaaggaggtatctgatgctgccaccactagcggtggcaatgttccaacaaagccgaggaaattctcgtctgtaagcggacaatgtcgcaaggtgtcgaccccctcggtaatttattttgttgttaaatcatgcagcaagaaggatttttccttactttgcgttgattgtattccaggcctcagatgcgtctcccccacctccacgacgacaacgcattgtgacgatcggcgagaagtaagtagatgaattcttgaatccccgcgcttcttatttgattgttgtctgactcgtggtcgtcctgtagggaggcgcgggcaaaggctgcgcaagccaagtccggaggagcttccagtgcgtcgcccgtcgtggcctcgacggatgtcgtgcccgcagccgggagccgggaggcgacgcctagtggccccgtcagcgaccccgcggcaggtcgtgatctaccagttgcagtcctcacctgggaggagctccaagtcgagatggggcgcctcctcgaagccggtgctcgcagcatcggccgcgaaattgcggaggcgaggtcggaagcggcgacggtgaacgtgcgtgctgacagactggtgcgcgagttggctgaagcccgtgaagacctcacgaagatgagggagttggcggctggcaacgagcgacaacggaaggggcttgaggaccgaatgtcggaactcgggaacaacctatctgagatctggggctcgttgagggtcacctacaccggccttcaccagctcgctggggaatgcggcgtcacgtccacgatcccggcgaatcccgatgagttttcgctgacctcctctctcgcggaactggcgacggcaatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacatgcgtaaggaggtgatggaagaagtcggtgatctgggggagtctgttctccccctttttgaagagtaggacttcttgtatttcctagataatgtgtaaaactcgaactctgaccgcctttgtgagtgcgattactatcccggcttactttggtatgctgacctcgggaacttttgtcctcttgtagagatattgatgacgaggatgtccagcagcgcgggcagcccgagtcactggcagtaattccggtactcgagtttgaaccacacgtctcgcctgaccatgtggatcaaccccttgatatagagggaaggatggcgacgacttcctcaggttagtagtcccttcaccccttaatgcccatctgactaggtcagccatgttcccgaaagagatgtacagctcgacttagtgattatcacgtttagcagatctcgagggtgcccttgctagccaagatcgtcgtatccaatactggaagcgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgatgagtcggcggccaggtacatctcgtggcttaatggggcctgtgcccaactcgatggaatcggtaagcgtatcgacgaggccttgaagcaggagtgtcgtcgatcgagccgatatgccggggggcatgtgttggcttgcctacgagatcatcgcccgcacctggacctcgaacatcttcgtgagggttttgctcgttctcggagggctccggcggagatagaccatctggcaaggtcaatgtcgttctcccatcttagcgacgaatctgcttagtgctgccatgcatccggttagcttttgtacctccttgagtcttgtaggcgacttcatgttctcgattgccttgatcttctcggggtttgcttctatccctctgccagagacaaggaatctgagcagcttgcccgacggtactccgaacatgcacttctcaggattgagcatgaggcgatatcgtcggaggttgtcgaacgtttcccgcatatcgtcaatcaatgagttgcctgtcttggttttgacaacgatgtcgtcgacgtaagcctcgacattgttgccaagctggttgctaagtgcgccctggaccgtgcgctggaaagtattcccagctgttatcagtccgaacggcatcttaacatagcaaaataccccaaatggcgtgatgaatgctgtcttctcttcgtcctcttttgccatgctgatttggtggtagccagagtaagcgtcgatgaagctcaataactcgcaaccggctgttgaatccaccagttggtctattcgaggaagtggaaagtgatccttggggcacgccttgttgaggtcggtgaagtcgacactcattctccattttccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgggctcaatcacctccctggggacccccggcatgtcggacggccgccaagcgaacacgtcggcattgtcgcggaggaaggtgatgagtgcgagttcctatttctcgtttagtgtcgccctgatcttgacggtcttatcggggttggcactggagagtggaacaatcttgatggcgccgtctggtttcggcgtcttgtttgtcttggtcactttcttgggtggctcagtcgtggcgggtggactgggcgtttgctcgaccatgtcgaggctccgcttgtcacattgcaccgccagctttgcgttcccctgaatagtgattgttcccttcggtcccggcatcttaagcacttgatatgcataatgagatgcggccatgaacttcgcaagtgtagttctcccgatgatggtgttgtaagctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttcgttgtgtcactgctttgtgggtctgggcgtttgggagggttcgcgtattctgctgcgaggacttccgcttgagctttccttttcccgtttttgcgatttttcttcttgcttgactcagatgtgtccatggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcatcgatgatttcaggaattgtgtttctgcactcgttgaaacatcgaacgtattccctcaatgattcactctagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacatggtcggtaaatagtttgctaacgcgttgtcgtctgcttcggcagcatagagtactgtggagtagacttgaagaaactcctctgggtcggtgctcccatcatacttttctattgctccgggtcagaatctctcaggccatcggacatcacgtaaggaacgaccgaaagccctacacccagcgttgggggcggtgggttgccggcggtcgtgtgtccttcgtggatgtctgtctgacgatgaggaggaggcggatgatgacgatgacgatgggtcgcttggttccggtgtacgattacgaggatgacggcctggatctcgacaatcctgtcgtcgtcttccgctgttgtctcggcgccgatctccatcgtcgtcgtcgatacggcggcgaccatgaccagtattgtctggcacccgtcgttcgcgatcgttgtgatcgtggtggttgtcgtggtcccggtcctcgtttgagcgatttcctcgatttccgttatcatggcgccgtgaagagacatgacgccgagagcgattcacgttgtctcgtgtgcgtcgtgcttcccggcggccgttgatttgatctcgaagatcgccagtgccgcgaggtggaggggtagcttgttgaggtgattccctccgttccggatcttcaccattggcctctccagttggtggctgctcctggtgtgctgcggtagcggcttcttcaaacgcgttgctgaggttagtcaccgattctcgtagacgttctgtccaacgctcgaggtcaacgttcagaacgggatcgtaaggagtttccctcagtatcgcttgaacggccctgatgtgctgggctggagtagtcgattgattccccgcttctgtgttggcgtgcgctgacgtgccaacgtcatcgatagccaatacctcccgcggcgcgctcgttgtcgatgacccatagtcctcaaggagatgtaagaccgatggttcgtgaggatcgatatcgattaccccaacgaatcaatctgaagttggagtcgctccttgttccttgccgttatccctgatggggatatatgacttaggagactgagctttcatggcgccgagaaagactttgcagctcgagaggacatgattctttgtcttgtgaataggacaatagacatcccgagttggagaagtacgctgaattccacgttctttgcaggcgcgaatttcagcacggacgttgaggaaaacccagcaatcttgcagggtgtgtttcttggttttgtggataggacaccaagaccttgtggcttcgtaagtcatctttgtcggctcgtggttcatgtcggaaggacaaggtttggccgtatcagaatccttcttgagcttggatgtcatcgatattccgttctccgtctcgacgggaggatttttcgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttgagtaccaaggacccctacctggcgctccactgtcgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcgactagctctcggtgacttggctcctcataagctccggcttcgtaggctgtggaggtggtgttggctctgagattcgatgcctaaaccctcccggggggggcccttttatatcgcagatctggaggtctccacatagaactcggagatatcagacccagttctgcccgagtaggattcttcccatctgtagattccgtgaaaggttttcttagaatatacaggaaatatccgaatgcgcgtgggtatgccatatcgatatgtaacgtatatcgaagggtaaagggtatgcctaacccgtaaccctgacatattatttaaaagatattttacatgtatgatttacaaagtggatcatatataatagacttactaccgtaaacgtgtggatagccaaatgggtcgcccgactcggcccgagcacaaccaggccgaggctgagttcagtcaagtcggcacgacctgacctacacaccaggacgggccatgcccgtccaagtgttgcaccaacagcccatgaacgactagaaggcacgaaagcccaccatgctcctccttggaaaaagtctattttgtctccctgatctctttgggccaactctcatatggctcaaaataagtatattttgaatccctcatctctttgagccgtgtcgagccagcccatcgcgccgaggcagaggcccaagcacgacccaaaggtctggtcgggccaacaagggcctgactgcttgggccaggcccaaacccatgccattggccgagccgtcgggcctagggcgttttggtcaactatacttctttccacccgatgtactttgattttttttatttttaatatatttttgaaaataaactatttgaaaacttattttcagctctgaacctttttagcttgccattttaactgacatggtaggacaacgttttggcactttcaacagtggcgtatggtaatggcagtgaagggagaaaataaatcgcggatggcaatggccaaaagatttatttttaaaagtaagattttcatagggtttgttttaaaatttttagttaataatggttagaaaaaagatcgagctacttagccaagcctcataaattctgctctgttttctccctttagtgaatatactagtagcagctagcagagctcctgtttgtcttatgaaaaagaaaaaagaacagagaaacatccgcaaatgtaacatggcaagtttcggtgtgaaacgagttcaataggttaataaaaggaccaattggataaatttgacataagaacggttatggtcgtatactaaaccaagtgctagcccgttaattaatttggtcaaacgcatgcgtgtaagtactatgg

SEQ ID NO: 1477 - DNA, 2145 bp, Oryza sativa
tgacaactttaccaaaatttgataaggttgaaaatggcatcaaagttaacaggcccgaaaattcccattagtggctctttactgaaccagtgtttttctaatgttgacttcttttcctcgactcaaaacgataacttcctcatttcttattactacatattctcgaactgctaaaatatacatcttatataaaaatcgttgtacataaaattttttaataaataaataaataatatttctaatatataatatttaatatgtaaacaatcatgcgctaatgatatgttccgtttgggagccacaaatagctctagccaaactacattcgaattaggactaacaaactttatatagcgaggttcacataggtcgactcaatctgtacgaatacaaacaggagctcatgcattcctacagaagagtgtcctagtctcttctctgatctctcttgtacatctgatcctctacatttttttaaaaaaaaaaagcagtgtaacttccggctcgaaaggagctccctagccgttgttgccgctgccttcccaaacatcttctccgccgatgccgctaatgttgttgtcaagctacggtggcggtggcggtggctctctctctctctctctctctgccgcccaacaacatcacgaagcagataaggtcaaaactcggccatcaaaatacaaattggattggactacgttggcttcgctgccatgtccaacattacttgtcatggttgcctaaagccctcatcactaggtgtgatgcaaaattgattcaatctggtcgtgcttgccatggccgttggaggatggttgttggctttgtttaaaactgagcatttgatgcttccttcctccatgtttcaaatagaaagtgtttcttccattcacctgatagaggcaaataaaggaggccaaagctccatcctgatggctacactttgatactatttggtctttgtcgttggtgaccatatgaggatgcatgctactcaggtggtgtcgtggcaacctccattttgatcgggaagattggtcagcgattgttgaaatcggtttagaagatccatctttgattttttttatggtagcagttaatttcttgtccatggtgcactcgctttaactagaaggtggtacagagtgcaagcaacaatgactccagggtgaaaaccttgagatgtaatctaaattcagcagtgtcagctcttgtttgtcatctcatcgttgaaggtgtcgtttgaagtgttggataaaaatccagccctatttttggatgacaatgtggtagacaggggccaagtcgttctcgaaggtgcttggatccgagtaggtgcataataccgaggtttgttttcgttacggaattgctaaaaaatcgtgcgatagtttttttcaaagaaatttgtcaacgcgctttaactagaaggtggtacagagtgcaagcaacaatgactccagggtgaaaaccttgagatgtgatctaaattcagcaatgtcagctcttgtttgtcatctcattgttgaaggtgtcgtttgaagtgttggataaaaatccagccctaaatcgatcccgccaccttcatttcactcaggtgtctcatttaccaccaagctagcattgtttttgtgttccaaacccagttacgtacaacttccagggtgtagttacaatgtaattgcttcgcaaaaaaaaagttacaatgtaactggggtgtagctagacatttttttgccttaaaatctgtttacagcgctataggtagacccttggtaatgtgtgttgagttgctccaagataatatatgtctgtcttcgccttcccccccccccccccccccattcccattacccaaaaaaagttgtatctcctagcttctcaccaactaaaatgcagatatcataatttgaatatggtagatggagttatattttcacgactttatcatcgcaccagtgatgttttccccttccgattgtccactcgatgcatatgccatgataagatccgctttccactttttctctgggggatgaataaaccttccatatatgtcccaatgtaaggtatagctatagctagaaaccatgcgcacgaacgaaattaagaaacgaacgcgcaagaggacagggcaccaatagt

SEQ ID NO: 1478 - DNA, 14114 bp, Oryza sativa
gatcgatcaagcgcacacagttccaatcatgcatgtgactaatgtctacgcgacgaggctctgcagtgcgcgcgggcagaagctaaggttaaaccctgtttggtagagctacaactcctaaattttgcttcaggagttgagtctggagtgaagttatagagctatctaaacccaactccacatctctaatttattttgtgagagaactccacccagctccgatcacattttaagtggagcttaaactgtttggctgagctctaactccaggagagatggagctagagctgtgccaaacaaacccttaatattatgagaagttagtatagttaagaatttggagaagctgacaaaccaagcttccagtttttgtgtcaatttctagattctactgctgtagttttttagaatccggataaaaatttaaaatctgaactgtttaaaaaaaatttcagtagctagagattctacgagaaattacggctgacagaagctcccaatcaaacccgagataagatgagaagatgcggggttacgtggcgttgtgagagagagagagagcctcgaagcggggccaactagtttatcataaaaccgagcgtgccatatcgccttgtttccacaagcccttagcacatggcgcgctctcgtcgctccagcctggcagagtgaggcgaagacaagagatcagaattcagaagcagctagctctccaccaaacaggctactcttttactttagcttggttaatttcgtccagatcaagaatcttgctaggtggagagatgcaccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaaatatgcatgtaaatcctaaccagatgctcggctaaccacgcagaaagaaaaaaaaaaaaggtagtaactatattaaaaacatgatcctatgtctgcttgttagccgcaatggacacgacgattaaggtaattaattaattccataattcgatgcatgtacaggacgacgacacactacaggggttcaacgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtttcttcagatgctaaccgccatctggctcatggaggcggcggcggcggcctcctggcgagaacgccgcacgccgtgcggggacttgcccttgcagccgccgccgtcagccttgcctgccgccgccgccgctgcggcttcggcactgtcatcgccgccggtgccgtcctcggcgccggcggcctttgtattggacgagacgccgggtttctccggcgagccatgcttatgcttacctaccgcccccgacgagttgccttgctcttgcgccgcgcgcctcaccttcacaccacgtatcagctgctaataattaagagataaattaagattacggttaataattaattagctgctgcttgcagaaattaacagaagtactccataaacaaagatactgccaaactggtcatccgaattaaagacaaacagtggcatgcagcaactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgtgcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaacatagaacacgatgaatgcatgctcctatttgactcccagattccaatgatatgttcgtatgacccacttgcccaattgggaaagggaccatcccatagtcatttactatttctggttcagaggtttctatcccctcccaattaacaaagaagcaagtggacttaaacaagcttaataagcaatcccaaatcatgcttgatgcttcgatcgaatgttgattactcaccggtaccgcatgttccacacctgagacgtcccgatgtcttccatggggatggagacaccatccctcgtcttcagctccggcaggtgaacctctgcttccttctgaaaccatccacagatcaagaaaggggagactttttagttctaccatgatcggaaatgtgaagagaaggttcaggcaaattccgtctttgattaggggagaaacatcaagtatgtgagtgtgtgcaagtgggatccttccatggaatggatttgtgccaagtggggtagtggatttggaaggagaaggtgttcgagatggtggtgactgtctcactttggggagcacgatgcggccgaggctcccgacgtcgctctgcttcagcaccttctgcagcaggaaccgcaggttcttgtccgtcttcgcctgcagcaatccaatcgatgccgtttaattagctaggttgataaatattggagattctatccctggacagcgatgtgagtgagtgagttttgagtgtgtggagtgtgtgtgaggaggagaatcgagttctcactcgcgtgagatcctagctatggtggatagcgattgatgtcaatcgtctgcatgcatgcacacctgccgcttctctgaagccgtcgagcgctgaaggctctccgctccggccgtcgccgccgcctgcggcttcggcttcggtttctccggcgagggtttcggctgcttcgacgtggcgggaggaggattgggcttgtttgataggggattctggatgatctgggccgccggcggccagatgccccagctccggcagccggccgacgacggggtgaccggcgccgagtgcgcggcgcgaggggagggctcctgtggatggccggagatgtggatctggctcaggttgagctgctggctacgttgctgctgcaggcaggagaggcggcgctgcctcgccatccgcttcttccgggcctcctttgtcgaggacggctcgactccggcgaggcgtggagagcacatggcgtggccgccggagtactgcccggggaatccggcggtgaacggcggtggcacgaccgacggcatggtgtaggagctcgtggaggagacggggaacggcgcgaattgctgcggccaggccatgttccctccgcccgacgcatgcatgtcgcccgccgccgccgcggtcggcggggagaacggctggctgctcacgaccacgctgctcttgctgcagctctgctggaaagggaacgggccggcggcgcctgggtacatggcgtcgccgccgtacgcggctggcggcgtgaaggcctggtagggcatccaggatgtggcggcggcggagcccatctcctggccaccggaggggaactcgtagccggggtttgcgccggggctggggagctgagggtccgacgacgcggcgccgtcgtcaatcgccgtgcgggggcgcttcttctggaggtggtggttctgcacccaggtgaggatgagcttgagcagctgcatggtgccctggcgcccgccgccgagccgcgcggccgccgcctcgatggtggatcggcggaggcggatgctgcggaggtcgtcggcggagatgtactcacggttgctcgtgagccactccatgaagaacgccggcagatcgtcgggcgcatcactcccctccatgcatgcgtcgccggcgtcgtctcctcccccggccgcctccatcaccgccttcgtatcgccgtcgccggtacagtcgtccgcctgatgcggttgcccggacatggcgtcctctatcatcatgccaacgtcgtccgggaacagcggctgctcggcctcccacgggacggacagcgacgcgaggtcgaggagctggtctatgtcggcgagctcaccaaacccgtccgccgccgaggccggctcggacggctcaccgccgcaaccccctcccgccgcggtggtgaaagcgctggacgagttcgacgacgacgacgacgagaaggttgagcttgacggggaagaaaggcacgggaagtccgggagcaacgggaaggtatcgtcagcgaaaaagacgtcatccctcgccgcctcacccctgatctccgccgccggggccttcccccgtccgccgccgccgccgccgccgccaccctgcttccccgggttcccgtgcgagtgcggcgccgacgagccggcggaggcgtccatgcagagtggaggcgggcggggggcggagagcgcgagatgtaggcgaggcggggggtttggctttgtttgtctgtgtgcgtgtaggtgtggaggtgggtgcagttactgagaaaggagacgaacaggagaagcagcgggaggtggagggtgggagagtagagagagaagagatgcggctgcggcccacacgtggcggccgccgagggctgtgggaagcgctccaccgcccacgccagcctctcctcagcgaccgtacctttcgccccccgcacggcacggccacgtcccactgacccgtgggccccacatttcctctgggcccacttatcattgctgggggctgcgtttctggtgggtggggttccccttttttttcctgagttgtaacggtcaatgacagtggggcctacgtgtcagtgggaagtacgggatttcggcgcgtgctggttttgaccgccgcggcagagggggagggagaggagcgttcttgcctgtggtccaatgacatgtgggacccaaaaggaaaaccatagagtggtagggtcgtgtgcgcgtagcgatttatgcgcgccgtaggatgtccgtgtcgcgtccgcgccgactaaggggctacgcgtccggtgtttccgagccgtccgatccgaaccaccgcgtgatcgaacggacgccatcttcgggaggagacctgtgtgctgtctggattaggaatatggggtgcgttttttctacgcgcacgtacgaaacctacacgagctggagatgatgacgtggaggtgtgggtcgcaccttggttacgatgacgtgggattttaccattggttgcagtggaggtggcccgtgtgaacacatgcagcgaacggcccagctcgatcgatcaccagcagccgggaagcgtaagcgctaagcagaggcatggcaatgccatggcatacgtgatcttgttctggccgttgcgtgtggaactgtgggtggagcatttgctttgtcttgttcgatcggaggatgcggctaggtaggatacatgttttgcaggggtaagagcaaatttccactttctctttgcttgtttgcttcgcaacaaatgcatttgaaaatgacagacaggcccccaaaatcagattaaaaaatatgttttctttggtgtccttagtgatgaggagcacccaaataacccatgcgacatcatccaaggattttattttttttttgcaagtttgtactttaaaatgagccaataaatctataatacacatttacgactacgtgtccttttcaatatccgtggaatcaattgatatattgattcatggatgcaaacaaaaacaattgtaaattttgggtcattgaacgatatatatctctctaaaatattatttatatcaagatgacgatatgcatgtatctttcattattaattgttcgctcaagcatatcgtatcctttcgagggaatgaagcatcgaagctcttgactcacatccaatacattgtctaattcaataattggatttgaacatcaaatatattccatgcgttgtgcaatttacaaatcatttttaattagtattttactattctcaatctatattatcgataatatgtattttactattcgatagcaactgtaaataaaggtcgttgggtgttacaggtcaacaatcatttgagcgatatggtaggttgagtgtttcccctatgttgttttggcataactttcatattactatgacaacaaggttattttgaagagttaataccgccacgtccattgtgcatatttataaaaagtaactatcaaaacacaactaaacccgtagcaaaccacatgcatatatattgaataagtgattttgtaaaaaaatatttatagattttgatatatgagggatacttgtaaacttatgtatataactcagccatgtcatcatctcaaataattttagacaatcggattaatatatatcacatcatttatacactgaccattcgattggaaaataccggtttgcaacattggaatactactatactttagtcatgattgatacaaatttcgatttaaaagtgtagttgcatgaattttgattcatgataatctatactgcaattatcatttgcattgtgatatattcatgattgatgacttcgatgctcggccacagggtttgtagcgcgcaatctatttgagcgtagccatgtagcattgtaccatgaacatatcaatatgtggtgacttcatgcattaaaagaagatggacacgttgtaaccacaatacaactttcttatctcccaacaacttatattacgtgcggacgtatataaatacaagaggctgcaacaacattttggctctttgtgattcattgatccgaggtaaggtcataaccttacaatggttcaccaccatgtatttttcgaagtacacccatgactacatctatacacgtacgcacggtgtttcgataaaacaattttgctatgagtatataggcttatggttcactgaaagacacacactaataaaaagacacaagatttggctcgtgttttggattcacgaataaatctggaaaatattttcaatgacatataaaattttctactatccccataaaaaaatgtactaactttctttgatcatggaaattaaaccctacaacaagattaacgcatatactccatctatctcgatatatatatatacatatatatacatatatatatatatgcgatgttgttaaatcttagatatatatttgattttattatgtatataacaaattaaagttattcataatatatcgtaataaaagtttgtaataaaataaaataataattatataattttagtaagataattgaaaatagcgtaactgtatcattcgtgttagaataaacagaggaggtactcctaattcctttcactggagaccaaactacatcatcgactcatggcgtcgtaccacagaagcactagctgctggcaaagccgtagatcagtgggacgtggcggaagccaagccgtcggatcatcccagcgaggaaaccacccgcgaccgcgacgacgcaacagcaggaaaacccaaaaccggtcggactccacagcgacccctccgccacgaagcagcacgcaccaaaaaaagaagaagaagcgaagcgggggcgaattgaggcccaaatacttgggtggggtggagggccgagcgcgagagatttcggagagcagcgcgaatcccccaaaaatccacccccaaatcccaattccaaatccgacctccctcctcggccagatctcgccccctctccccggggggcctccgatcgaatcggcggctgcaccgcggccggcgattcccgggaggaggaggaggaggaggagtaggaggaggggatctcgccgagatttggattgggtttggtggttgggtgggagggagggagctggggggtgtggccagccatggcgtcggcgcaggtgtcgtcgtcctccgccgccgccggtgcggcgtcgtcgtcgtcctcgcgaaagaaggatctccacgcggggaagaagctggtatgtctgttgcttgcgatagacgtagtcgttggttacccgatgttggtagtttaaccttctggaaatgctggatctttttgtccagacacgtttgattgaatagggagcattgaccgctttgcgttagagatgtagttccatcgatcgttttgcttatggtagagaagtcaaatgcgcgcaaattacccccgtcatcagcacgctcagtttgaaatgttgaattttcgttacctagatcttgctatttcatcaactgatcctgagtgatgatttgatgcgaaattaagttcaagttggttgtagaataatgatgtcgtgttttctgatatatccagctggcggagtaccgtaagaagaagaacaaggcggcgaagaaggctgctgaaactgcagaccaggcaacggcgcctgttcctgatacactagagaaccctcctccaaatgccaccagtactaactcgggagacaagttggtatcggacgtggatgtgaacacaacaagcacatcatctgtgccaccagtctacgagaatggcccaacgagttattccagaggtgacgagcccttgtcaaatggacctgcccctgtaaatgtgccagtcagtgttagtaatcctgccccatcgcatgatgtcagtagtgttggagggagcaagatttatgggaacttgagcttctctgacttagttaatgggcataatgaggattggagaggcgatgctgctcggaaaagggaggaacatagtcctgacaaggacgtgactttaaaatctaaattgagtgcctttggaaactcagatgaggtctcccattcttcagatgaggtcttgctgagtcagggaagaaatccagtcttgagggaagtaagtgacactgagcagtctagttcatattcatctggcagcctttttggaaagttagaaggcacgcaaagtcagggttactctgcaaacaatgatatctttggtcggttccgaggtatatccaagccctttttcatattaaattatgctatctgatgagtgatgataacttgaatatgtggcacttttaactctttacttttgctgctatgcagccacctctaaagactcttcccaagcagatggcttagcgtatgccagcagccgggagtatggaagtgccttcaataattcttggaatacatcaaattccacacctgtttgttttgataaacaggatccttttatgtcatctggttatccaactacatacaatcgatctcggccatcttttcttgattctattggagtacaaagagctccaacaactgaagtcccatacgtggagcctgcaaaggctagtaaaccatttggcaactcgaattctgagagttcattttttcagccaccaaatcaacaatccgctggaagcaatgatgtggatggttctctaaaatcaggaagacaagaatataacaacgagaagggatcatatggaaattccattcgtactgattcctttccttccaaagatgaacggaatctgcaccatagtactcaaatgttccaaaacttcacaattcctgggaaagatgatgattttgctgcactagagcaggtgatgagtgctcgatctatgttttcattgtctgtgctttcttgaggatatataatattttatatgtatgtcaggaatgacctagtaaaattggacattggacatgatattgagagctgtgcatttattaacaaaatctaaacgcttatttatgtttgtttgaattgatgacgcttacacctgaatgctattgtacacaaaacaaaagtttagctgaagttatgtctgtactagccatatgtccaaaagataattttaaaaagtatatgcttcataatatgtaacaacttgtttgactgcgtgctgcgtatagttactgttctgcgtggtgcagcttctgggtctatattctagacagaacgtccaaatcttgtgatggacgtgccatattctactaaattaacagccttatccttgattatatatttttacttctcctgaattgcatgtactttttgttatttacgagtatccgcatcctactcatgtctgctctggtttggctgttagctcattgaggatttgacaaaagagaagttcgccttacaacgtactcttgagaaatctcaagaattggctcaaactttggccacagacaactcagctttgactgataagttcaaccaacaggtatttccaaatctccattttggtttttggagttggatctagtatcctcacaaacttttgccatttattatgcaagtccacaacagaaaaacactttcttcacaattaataaaccagtttctgctataacgtagtatttcaatgtcaaagtttcattctgcccgtttctctgtctttccttgttgctctgccttattcacggtgaatgatattcaactagcataacatgcttgcaaaagtgtctctagcaactagaaaatgctaaatgagaatggaatagctaagcaatcacccaaaatttaccttacagtcaatacttcttatctgatcagtaaatcatcaattcttttacagcattggtataaggacagaatcaatactgattagtcatatttccagtcacttattgtcttgtgtatcatatttattattttgtttgcaaatgcttaggcacaagttatcagcaacctgacatctgacatggagagattgcagaacgaaattcaagctcaactggttaggcttattccaccttttctagcaatcattaagattctgtaattccatgcttgctatgctgacatgcttttgttctgttggttttttagtagtactatcgctgtgtaatttggaaatataatgtgctagttgcaagacatatgttagcatagaatatgacttatgaaatgtagaatgtctccggatatgaggagctagggaatgagttcataagatcacatggttcactatgtacccagcatgcacaatatgtttagattttggtgtttgactaggcaactggctgaagtatggcgctgaactattgcttgctaaatgcctaattcatatgaaagtatctccactaaatgtttaggttacttagtgtacatttgacttactgatgtttctggtagttagcatcatctgtgcactcagtgctagtatctatcaatatgaaacttatgatttagggccagtttgaatgtgcatattgcctgagcttacttaggggcacgcaacacagaacatgttatcagtgcattattaattaagtattaactattataaacttgaaaaatggattttttgaagaaacttcatatacttttttttttgcataaaacacaccatttagcagttcggaaaatgtgactaacaaaaaacgaggaagttgtagtttggagttgaagttttctcataatttgtatagttttcttaccaactccaatttttcaacagctggcacttgagtctgtcagaacggaatatgctaatgcccagctagaatgcaatgctgcagatgagagggccaaagttcttgcagcagaagtcattctacttgaagataaggtgcttagctatatactcgtctgcttcctctctaatgttgcaaatcaacctaaccttcttagtgggataataatattgacactgtttatagtttttgaatgctcattattttgagcaatgtttttttggagtatgttattatactataccttgagtacattaagccctagaggtgtcacaggctcacagcaacaaatcaaagtataatgacagatatcctatacacctgcaggtaggtaatgcctattatattcaagttttaatgcatcagatgtaaatatataatatcccttgatatgccaaacatgcagctgctgtttttttatctaacacttctctttaaggcactatttatcaaaagcgcatgcagtttgatatatcgctattttttaggctcttagactgaggtcaagtgagttaaagcttgaaaaggaaattgagggtttgagctctgagatttcttcatacaggtgaggttttctgctatgagtgcatggtatgtgttttacaaggtggggagatcaattgataagtgaaatgggcttcaaatataaatgtgaaagaaagtttctggtttttctcacattggcattcttgaaattgttatgcgaaaaaaatatgtgagtcttgtgttaacatgcaaaaaacatgacatgagtttaagtttactgaactcacacactgatcatccgagggtactgacagtgtttcctttacgattttcttttactatgcacaggcgcaaagtttctagtctagagaaggagcgtcaacatcttcaatctactgttgaggctcttcaagaaggtagttaccgttttactctgatgtaaaacttttttgaactcgttctttatcccatgcccaactcaattatctggtgagtcctagaaaatcattagttgtgttcacatcttgcacgcacatttttgttccctattatttaagccccatactcacacatcctttagtgtcacttatttttggctgtcaaataactaaaactaaactagaaatttatctgtaatattctagttggaataagacttgcatgtgtgtgatagacttaatttatgcatgaatattgccggttgtaaacttgacttcacattgatacttttggacagaaaagaaactcctacactctaaattgaggaatacttctgtgactgagaaggtcaatattatagaaaaaccttcagctgataaaagagatgcatcaactgcaacagaagatctaggtatgaatgttgatctccccttttgtttgatatctatgaatatgtatttcaattttcaactagtagtctgcttgacacgaaatatgcatcttcagatacaggggaaagcagctcttcagaaacccttaccagtgccattgacacagtagaagatggtgaaacatctgtatcgcggtccaataatgtggctgattttacttatttagaagaggtgtcttctagcatcccacatgatcagcttagaatgatcgacaatatcaactccttgatgtcagaggtaatctctttgatgtgcaaaaatccagtgtggttggtactttatatcacttacattgatcgattgcacctaaataaccttaaaccacagcacttgagtttcatagcctacaaaatttacttccttgttaatagtaattgttgcattgcagttggcagtggagcgagaagagttgctgcgagctttgagaattgaatcatccaattgctccaagctgaaggttttgttcatttcgcagcaactttgtttctactatttttgattcattgagcctatatttcttcctgtccagagcttcgatcgacccaatataaatgcgatgcatgtataattaagcactaagcctctagggtatacaaatgcctagggtcttgtatagttgcccaagggactatcccagctggcttaacctaccgggccctttcctccggatgaaatcatgtccaaatcgagggctattgtgtactgtaactttgtcatggtgtatctatcttatgcagtccattctttgtcttaaaggaattgaacaaggatctaacgcaaaagctggagattcagactcacagacttgagctgttatcttctcaaaggatggctaacgagaatgtcct

SEQ ID NO: 1479 - DNA, 5215 bp, Oryza sativa
ttttgtattggcaatgaacagaatagctgccagcaggaaaaatacgcccccttatatattccataattatacgtggggtggaggtgtatgttgtaattgctgtatccatttgttatttcattcacttgttatccctagctctactatctccctcgttcattttctcttctgttatttgctgcaacttgtcatccgatttcctatattgctctggctactggttacaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataacaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtcgactaaaagactttcctgttctctaaaagaatgcgaaagtcgatttttatccgcatgggatagtatgatctgaccaacgaatagactaaaatataacaagaaataatatatgatgactatttcttgttatgggtaggaacgcttagatagaacttggtgttcctgaaatcatcaaggagtggattatatccatctttggtcctagtcttcaacggcagtccaaactcttccatgaaggcagcagaatcaagctaacgatagttgacaaataacatcatactcgtcagtgcaccgaagtttgtaaaagatgtgatgcaagatgaactaggacactaggttgcatagaaaacaaaactggcttaaatagtctgaacttacaatgatggttctcctcgtcttaactggtttaaatgcaccggggttcttttgctgttttgagaaaccagagcagtcatggtcgatcttctccaaaagccagaaatcggttgggaagaaaatatctgcgtcaccctggcaagtaacataaccgagttcttttaataatatataataacacatagcacaacaacttaattaaacacatagcataacaacttaattgctcaaagttatttagttctttttccccatggggttggacagtagggtcaactaagctacgacatgtttgcaacgaatctaatattcagatataacagaacagaaacattattcaaacctgagcctcaagatagttgcgatgatccaaagtcctcccgtccttctgcaagcaggacacaacatcaacgaggtgtcctagagaaattgccttgttggaaaaacgcaccaaaagtcagtgaaggtcttgtcacctttgaagaaaccaatggagctctatcgccaggtatactgacatcaggaagatagctgaaatctgaagctataagggacatgcttggcaaagcttgatgtaaagtatctagtattttctgcatatgtcataacacatatttcagagattctggcagtaagctgacaaactcatcagcatatgatcacatatagaataacagtttataacctaacaagtggaagtgggttcaaaagacataccaagcatccagttggtaaccaagctctccgaggctttgggaatacttttgacacaactccttttgcagcaagtgataatttgtctctcacagacactttctcttcatttatgccagtaatctcgacacagcgggaaactagtgggtcttgtaatggtttgtatacctcagagccttgtgaactatttttcataaaaggcaaccatacaaatttaatgaagtctgtcctcattagttaccaggcaatatcaatcaatacaactgtccagattccagaagcacaagggcgatcgactatgttatactagaggggtaaggaatcagcccttcaacaataatatatcgaaaatgataaatttatctaacaagaatctagtaaaagaccagcatgagagcactataaaacaagcagaaccttcccttaatcttctgttgaagaatataccttttttcctttccaaaatataaagtatgtatactaagaataaacttatcttatgtagcactgtgcttatatatgttacaaatacaatacagtaatatatagaaaagaaatcataagatcaatagatcattagccacgaggtaacagaagagaattcagtaaaagaatttcactacagactgtcagacttccatcattttttttttacccacaagaagcataagttcattcatttcatcaaattattccaaagtccagatcatttcattgaacttgcctaaagccgcacataaataatcggtataagagcaaaaaagatactttcatatattgtctgaagcatacactctcaggaatcagaaaaaggaaaacacaaacctgccatttactttttcaatccatacttccatccatggagagacctgatctggcgaatagacaaggtcatgtggtagattgtcaagtacctgacaatacaccaaatgaatgttgctgttgaggctgctgccatcatgtctctaagatatgattgcgaagctaagaagtccatatgataatctaattcttcacttagcaaacaaaatgatactagcaaccagtgtttccctacttgccatcatcagtcagtccagactactggcatggtcatacaatggttaataagtgatggttggtagaatgtctaaagaggatcctatatctggttgttatggcaatagtgagggtacgtaaaggaacagcgcccaacgttgatacagtgttttgtttgcaatatcattggcaaagagagagtaatcaagagtttatgtctgctataactttataacctactcttacatatcctttgaaacacaaaataacacacagataaactcgacactgaaaaaaggtatatttgcagtattcacatcttgaaagcctaaataacatttgaggtgctgctacacattctgccaagctactaagttagtgcaaaccagccagaggactgcagctaagcgtcaattaataacaggaaaggtggactgtaatgatggtatattgcttctttgattcatatgagacatcaaagaaacaaccgagcagatagtcaaggcagtacctcaagcattaacacccaacaaggttgaggatccttgcggcctgtaaaatatgacaggaaagtaacccaaagtggtcaaggaataaaagtgcaacaatataaagatcagaagataaaatccgatataagtgtgatttgacatggagggattagtgggaagtctgtgtaagtgtaacccacacattttagactgagcctatcagcactacatcaaaatatggtgtaatagcattagctgaaaatttgcaagctgaattatcaaagttcatacattattttttaaatagaatgcattttagagtagattgccctacagaggagcagggacaagaagtcagcttaccccatccagctctgtcagttgcgtcacgacactcaaccatgaactttgacaaatggcttcgcacctcaccaacagtttccaattgcttctcagctagagaggaactaatttctactgagctagcaaattaagataaaagcaaggtcaaagcatattcgatcacataacagagatcataaagtgaaggaaggtttccttacatgtatttcatagtattgtatactttcggtggagcatttaacatcatgtagtcaagtatgcattttgcacatgtgccagaaccaccaccaatttcgtaaatctgatccatgcaggggaaaattcatatggtttggtgaaaaagaaaacagatgactatgtgccataatattataaggtaccttttctccaaaaaaaaaatttggcatgagaactgcagtaatattactagttgagaaggaatgaaaaaaagaaaaggaaaatggtgcagtagcacagccatcatttattaaatcatatgtgagcggttatggcgcttgtaagagcaaatgggtggatggaggtctagaactatgctgaggaggaagttaagaatgcaccttcagtgggactgaaagatttgctgtacggaggattgatgcagctattgcataggcataccatggctgcaccagagaaagaccacgcatcaagggtcaaactgacagaaaaatgacactacatgctattgaacagcttaagaaaacaccttgaagagctccactggagtgaaccaagcgatgtcatgcttcttgtacaacttatcaaggtactgcatatacgcactcctacctacataagcaaattacttccgtttctagtcaaatatccaagatattaaaacagcacaacacagaatcgtaattggcaaacaatcaatggagttcaacagtcgtggaagaaaaacagaagtcccaaatttctgcatgagaggaacagtggcacgcgcaacgtgttcgtcgaaatgccacctcggcaaacaaatgttagaaccggcctaatctgattcccgcaatgccggaacacacacaccaaactcccacatccaaatccggtccaagcaatagaatgatccaagaagcaggtagaaaggaggattaccgtcgagctggttgaagcggatgctggagtcgagcacgcccacgggtcccgaccgcttggagaagtagccatggttggggtcgtacagcgccgacctcacgaagtcacgcacctgcgcgcacgaagctcccaccaaatcatcacccgctacaaggagatctcactgcgcccctcccagcccgcgaaacctccgccccgagcgcttaccaggatgggcttgttctcggggacgatccccgacgagaacatcgccgccggataccaccgcgccagcgtcgccgctcgccggagcgccgccgggacggacgccatgtgcggcggcgccatgggggagtcggggagtgagtcgctgcggcggcggcggcggcaatgcccacgcggttccgggccttttccccgaaagaaaagaaagggaagtccgattagtgttcgggcccaagcccaacacgagtccgagttggagtcgtgggctgtttgggccgtacggcc

SEQ ID NO: 1480 - DNA, 4450 bp, Oryza sativa
agattcattcaattcgaagggcgggagagaaggaaggggagagatgatgatgacatcagcgatgccgccgggcggcgggcgcggcggcggggaggctcctactccggtcaccggcgtcgccggcgacccccgccatgagcagcgcatgaggctggtgaggaaggcgagcgagctcgcgacgcggtgcgccgtcccggtcgccttgtccggcccggccatcggcggcgtgtgcgagccgctgcgctggccgtcgatggacaaggcacgggatatcaacaatcggtacaaagcgctgccggagaacggtcggaggaagatctccgtgggcgacgccgccgacatcgcgaaccaagccgcgacgcagcagccgcagggcgtccccgccggcggcgagtcggccagcgcggcgggggtggccgctgccttcggcgccatgaccgaagaggagctccgggagcttctccgatccatcgactgctccctggcggccgcgagccacgcgatccagaaggccgccgacgaggccgaacagaagctctcgctccagcgcgcgggcacgctcatggcggtggactcctcctcccaggacgccgtgccgccacatgccgcgcccatggacatgggagacgaggtgcagggcgcgcagccaccaccggatcggtggttcgaagaggaacgagagccggtaatttgctccaaaaagaaaccagagccgtgctccgccccgccgccgccgccgccgccggcgaaccggaacggcgtcgcctacgaggccgaacaaaggcgcgcgtgcgcgctcatggtggactcccaggaggatgccgcgccgccgccgccgccgccggcgagcgggaatggcgtcgccgacgacggcgagtacatcaacctgggcgggtacatgatcgagcgcaaccgattcgaagcaatctggcgcgaacacgcgatccctcctccacaaagcctcctgccggagtcgttgccggacgacgacggcgagccgctgcggctgtggtcgttcgacgccggcgagagggtaatcctttgaatgtgcccgcgttgagttggcctctagactgattttgttgttgataagagtaatgctatatttactttatggccgtgtggcttgtgacagaagtaagatgtaatctattttcattaaaaaaacactttaaaaaatctgtactagtcttaattagtagttagttaggggccgtttagattgcagtcaaaataaatctaatgctaaaattttagtagtttgacaatattataaaaattgacagaatttcttatatatttactaaagttggacaagaaactaaatgtatgcacatttttaataattttaacaaaaatgatatgatttaaaatgacatcaatctaaacaacccttcagttagaaaagaatgggcttaaaatcaagaatcaatcatattttatccacatcagcttttcaagatgctttttctagacaaataacagatttttgtacgcgtataattttccttttgagaaggttttgtatctaaaacagtttcatttatgcagagctcgagaaaacagcacaaaaaaatgaaaacggctgcgaggggaagatcaaagctcactggacacctgtgttgacgacattctgtaccggctgaagggtcttcgatcgatgatttcacttagatagcagtgcagtggtctgccttttttgtgaacttgatgtttctgtaaatttctatgtgagattcagatgttgctcgatctgtagctagttcctgtcttccagctgtaactgtaactgtaacgagaattaacaggcaaaagaactttgttatggggattctttaataaagctggataactaggtgatctgttcatctaaaaagtagtcgtgggactgatcgagtttgctgtttgccgccttccgacagttgaccttcatgtcgccgccgcagttgccttttgctgaaaattggatggaaaacgtgcatcgagggatgggtatttgattgatggataattggatgtcatcaaacaacaacatggataatatggagcatgctgggtggcttaccactagcttgactctaggcattgagagacaacacaaactgtcaaagattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagtaccattcatgttttatcatgtaataaaaaatatttatcataaaaaatttctaataaaataaatggtcaaacattggacataaacaatataaaactacactattttgggatggagggagtaccattcttaatgcaataggggcaaatgacaatgcagtagcgaattatctatcgattacgttgaactgctcatccaccttatgtcatattctcgatcaaccgagcatcgtttttatataacgggtaatattttcaaccgctactgtttttttatatataaatgttttttctaatttctttctgcatcgtactggtgtcaacactgagtagtttaaatgatgaatatgatcaattatcgaccgatcgatcattgtttttgaaaagatgctattgattctgaatgttttcgaccgttttcacctcttttaacttccataaccatgaggatactccatacaatctctactattataaaaattaaagatgtttttgtcggtactttgacacgttatccgtgtatggttcggtttttaagttcgttcgcttttggaaatacgaatctgtatttgagtcaagttttaagatcgctcgcttttgaaaatacaaaaggagtcgtataagaaatccccttaaaagaactaccatgctaacttgagatgatcgaactcttaactacacatcatgattttctagaaatatatatatatccaagtaaattcccaccatgaatttcaccttaactaaaccatacaacaataataatattaaaatagccttcgtccgttgtaacatacgggcattttttaccgttattttcagggtagttataaaaggcacacggtcgaggacgatcttcacgggttcccgaacttccaaaaaaaaggggcaattacttatttgaccctgttttgaactgtaattgatgatttggccctactttttgaactttgcttatttgaccctccttttcgagtacgaagctccggtctgaccctattccgtttgggtgaggtgacggtgttaattttggggtaaatagtctattttgcccttgcttatttgacactgttatatcccttttgtttgcttgtttgaccctattttgttataccgtgtatatattcaacaatgttgaaatatttgtaataatttttgctcaagtaacagatttggcattaatttgacagatttgaatcattttgtgaaatttgacttaaatttgacagaattttgtgaaagtgaaaataaattaaataaaatgtgccccaattatgacagatttggcataaatttgagaaatttgattcattttgaaagatttgactaaaaattgtcaaatttgaggcaattatgatagattttgttaaaaaaaaatcgaacagcatcgacgccatcgacctcgctctctcggcagtcggcatgacagtggcgaacggcgcgcacggcggtgcggccgacggtgagcgggggcgggcggtggcggacgaggcggagaggcaagcgggcggcggtggagaggcgggcgaggcgagctgcggcggacgaggcgggcgaggcgagcagcggtggagaggtgggcgaggcggccggc

SEQ ID NO: 1481 - DNA, 10100 bp, Oryza sativa
atctccccctccctccccggcgccctctctctctctctccctccgctccaccccgcccgcgcgccgcgcgcgctgcgtgcgcgagcgcgcaagccgcgcagaacgcccctcctccgctcccaccgctctgtccgcgcgtgcgtgagccgcccgcgccgagccgagccctcctttccgcccctcctttccgctccccgcgcgtcgttcgcgcgcgcgcgcccgcgtggtcctcgcccgcatcgcgtctgcgccgcccggccccgctaccctgccgcgccagcagccgctcggccccgcagccagcgtgcgtgctcgagccgcgcctctccatccgccgcgccctcccgctgcaagccgcgcgcgcgtgccgagtggccgaccgtctggtcgccgccgccgtcaccctctgccgcgccagcccgcgcctgtcgcccgtgtcgtcgcgccgctccaaaccgccccgccgtcatcgccgccgtcatcgcctcggccccgccactccgcgcgcaagccgccaagggacggaggccgagccctcctccctctgccgcgacgcctccgcctccctcctcctttttcctaaatcggcaagggggcaagccccctttctccccctcctttttccctttttcctcccgccggcgtcatcctccctccctcctgtcgccgttttggccgctagccggagcgccagcccgcgccttgaccgccaaagtcggtttccaaaccgacattgccgccccctataaacccaggcgcccgcccttcctcttttccccctcccaatcttctctgtttctcgcccgcgccattgtcgtccctctcgccgaccgcagccgtcacgtgtgtgccggaggagccggtgcgcactaggacgcggaaggggactttggccgcgccctctccttcctcttccccggcccgaggccggagagattactcccgcgccgtcggcctctcgtctcagcgcccctcctcttcatggtagtgcctccctccgttcttcctcctcgctccatctcccccccttagttttcggtggtagcacgagtagcctccccgtagctagccggcgccgccccgaccgttgccgtcgctcaccgtgtgcccgccgccgtcgccgcccgagctccgtagcacccgctcgtcgccagcctcgctcggcgtagctccgcccaatccgacgctagcatcggattcccgtagccgcatagatgctctcgccgccgggaattggcccctcgtgacctcgtcgccgtttcccctcttccctccccgccggttgccgccgccgcgattcgccgccgtcaagcttcctccggcgaatccgagccgttggctcgtctcccctcgtctcgtgcaaccacccggtgtgctcgctttcgccggtatcgccgtggttcgctccgccgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtcccttcccgtgcgcgcgctccaccacgagccgtgaggctacgcgtgggcccgccgcacccgcgtccttccccccaccctagcgccgcgtcgcgtgctccctccgcacggtgagccaagccgctgacaagcgggtcccacccgggaccgcgcgtggtgagcccggtccaccggctctctctctcctccctcccgcgcgcgcgcgtcttgggccgttctgagccgccttcttgggccggccggcccgttaagctcggccgagccgccccttttctctcgggccgcgccctagccgcccgagggaagtctaatttccatccctcttttcttttcttttcttttcttttccaataaggatttaattaaatccttttcctttagacgaaaaatccaagaatcttagaaattcaatatcctcccaaccgtagatccgtttgactccgttcaacttccaaaattcctcaaatctcgagatctatctaatagcacgcttagaggtcattaatagggctttattttcgccgtttgttgagttgtcccgtttcgcgtgtagtttcggagcccgaagacccgcagtgcgaggatttcgaggatcaagcttcagctctcgagcaaggcaagccacctttgaccatcttgagcctatatttgaaatttaattatattgcttgcaaaatattatgcactgataggatcgcacttgatctgcttgtcccgtctgcaaggcagattggcggacctacctaattttgttgcatttgatcctccctttgttaattgcgataccatgtccccttgtaaccatctagttgcgtctcgatattcgtgcaccctgcgcgagtatcgacggacgccttcaaacttaaaatctgagtaacaacttgggtaaaaacttgggttttgcaaaagacttggaaaacccgacacctgggtcggtgcttgcgaactaaatgaatttccaaaaccgcggaccggggaacataccgggtgtacggtttcccgttcttgcacttaaggaccgtttccttggaatttcatccaaacataagacaagtacgaccatatgggtggaatgggacacccctggctgagtaactagcttatcaggggtgccttgatgccgagagacatgtggattcgccggggtggtgtcggggaggacccctgggcttcctggcacagtatggtctgggacctaacctgttgttggtctgggacccctctcgtcggcatatggtaaacctgtgtcagctttggaaataccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcatagcgtagttttgtttgactactgcttgtgaaattgctgttgtgaaaaggggttcgacgtttgaaaatctgtagctgatgggatcagctaggcccgggtggccgtttgaaaagttgtaggcccgggtggccgttgaaaagctgttggccgggtgccaaccttgttttcatttctaaagattgatacatggcacatactccgaccggacgagacgcactgtctcatccgtgtcgtttgagaagcactcacttagttgtttcagaaaagagttcaaataaaatcaattgcaaaaacaccagtctctccttgaagcctgcattaaacacttatttcccctggcttgctgagtactcccgtactcacccttgctctatataaataattcccccccagttgctgaagaagatgaagcggatcctgctgatgaggagttctttcaggagcaagccggctacgatgagttttagggtttcggcctagttcccaagtcgcgcctgtattgtttggtccaagtcctgcttccgttttccttttgtaatgcagttgtgagctcggggtctgtccgcagcccaacatgactgtactactactctataataaagagacctctgttgctgtgatattctgtcttcctgtgataccagcactgtttcctgggactggtatcgattaacaggttaatttggagcgtcacgggctagttccagtcgggactagttcggggtgtgacaagagatggtatcagagcacaggcttggccctagggcgaaacccgatgtttaggacgaccctaaggatactaagttcaaaactacttgcgaaaagctaaggcttcttttggtttccttattttcaatagtttgtttctaaaatggttactgatctttctccctctttcaaaattgtagatggcagtgaacgccagcttcagttcccatggttttggtgagggtcaccacgtcgctcagcttcgtgacctcgcccgtttccttggcttctcgtgtcccgagtacacggggtactccgtgggccgtgttccccctcactgtgagctctctgtgtacctctacccccgtggaggtatacacggagctggccttgcccacaccacttcactttggccaggcccactctccagatcgcgtaccaggacctctcctggactgcgcttcgtcgcctggcccacgactacagccaccgtctcgggggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcttgggactcaggccgcccctgtcacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaccgtgttccatttccactacccagctcccctaccgccagcggcccgtgctgctgccggccctcgacaggttccgccggtcccttcgcgtcagccgatcgacgtttcttcgactgaggagccgactacaggaggcagccaggccgacgaggagtagaggaggcagtcttcagcagccgtccgtgtgctaggcccttttgttccgccgccaactcttttggagtcgtggcgaggtagtgcgtgcgtgtgtttgttgtgggtgttgtttggtagtctggttctcctaggtggtgtgcgcacagtcaagctcggtgtagctctgtgacttgtccacacccgttgtatcaggtgtttttatgatttgaaaaatccagtttatgcctagtgtgtgctatctgagttgctatttactttgctccttgccctcctaagtgcttatctgattcttaccccgccctcttctgggagtttagatggctagccgcccccgccgtgcagctcgtgcgccagcccgctttggttttgaagatggtagagccgagccagaagtaaatcatgagcagtctccccacagcaaccgttcgcaccgtactgcttcccgcaacgcagaagttgagcaaccccgccgcagcaaccgctcgcatcgcacggcttcctgtgatgcagagatggaacagtctcaccgctctcaccacactgccagtcacaattctggagaagaacgcctcccttccccacctcatgtggaaaacaacatgcagcacttaatggcagttcagacacaaatcttgcaaggattagccgcagccgtagccggttttcagcataatgcgcatggaaatggccaccctcacatgagcaacaatagatccaagctgacagattttctgaggtctcgtccgccagagttctctcagaccgtcgagcccgtcgaggctgacgattggctgaaagatgttgatagaaaattcaacttagtgcagtgtacccctgttgagaagacgctctacgcctctcaccagctaagaggacctgctgcagattggtgggagaattactgcaatgcacaccctgaacccactaacattgcttgggatgagtttgctacagctttccgtgcagctcatgtacctgaaagcaccattgacatgaagaaagaggaattcaacagacttaagcaaggcaacagcaatgtcaatgagtacctaagtcagttcaacaagttggctcggtatgcccctgaggaagtggacacagacaagaagaagatcaggaagttcttgaagggaatcgcagttggaatgagactccagttgcttgctcatgacttccctacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccatcagtcggtcactcaagctaaccgccagccaggctacgcccctcgtcctcagatgaaccgtccggcaccccagccacagcagcgtgcccctagtggcaatactgcgccaaacagtgttacctctttcaagtcaccgcagggaccgtcagcagttcagtgtttccggtgcaaccagatgggtcactatgctagacagtgccctcagaatcctaccaacaccagctcagggcatgctaatggcagcactgctagaactcctactccagcggcagctcagtctcgtcctagctcccaggcaagtggacaaggttctcatgcgtccaacaactttggtcgaggccgagtgaaccacattcaagccgagactgctcaggatgctccagacgttgtgatgggtatgttctctgtcaactccatacccgcaatagttctgtttgattcaggagcttcccactccttcatatcacaagcttttgtgaaaagaaatggttggaaaacccaaaatttacgtgtaccgatgatagtacattcccctgggagggatataagggcaactcaaatatgcccggaagttaaccttagaattgaggaagttgacttcctagccaaaccgatagtcctagactcgcaaagcttggacatcatcctagggatggattggttggcaaagcacaaaggacagatagattgtgccgaaaagtccatcactttgcaaggacctggaggaaagcaagtccgctttacctctaacagtcctaccgcaagtcggtctatcttaacctgtttacaagtcacctccttggagtcggtgcccatagtctgtgaatatcccgacgtatttccagaagaattaacgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgcttctggttaagaaaaaggatggctctgaaagaatggtaatcgactatagagccctgaatgaagtaactataaagaacaagtacccgttgccacggattgacgatttgctcgatcaacttaaaggagcaagagttttctctaaaattgacttgagatcaggttaccaccaattgaaaatcagatctgaagatatcccgaagaccgctttctcaacgcgttatggtctatacgagttcacagtgatgtccttcggactcaccaatgctccagtgttcttcatgaacttaatgaacaaaatctttatggaatacctggactagtttgtcgtggtgttcatcgatgacatcctaatatactccaagaatgaggaagaacatgctgaacacctgaggctaataatggaaaagctcagggatcatcaactattcgctaaatttttgaaatgcgaattctggttagaccgagtagcattccttggacacgtgatctcctccaacggtgtcgaagtagatcccagcaaggttgaagctgtacttgcttggaacccgcccaagaatgtgtcagagattcgcagcttccttggcttagccggatattatcgaagattcatcgaaggattctctaagttagccagacccatgaccgagctgttaaagaaggaaaagaaatttcaatggtctgcagcctgtgaagacagctttcaagaaatgaagaaaaggttgaccactgccccagttctcaccttgccagatatccgaaaagatttcgagatcttctgtgatgcatcaagacaaggcttagaatgtgtcctaatgcaagaacgaaaggttgtggcctatgcatccaggcagctcagacctcatgaagtcaattatcccacccatgatctcgaattggcagccgtggttcatgctcttaagatctggaggcactatttaatcgggaacagatgtgaagtatacaccgatcacaaaagccttaagtacatcttcacacagacggagttaaatatgaggcagagaagatggttggaactaatcaaggattacgatcttggaattcattaccacccctgtaaagccaacgtggtcgctgatgcgctaagtcgcaaggcctattgcaatgtagctcgaatacggcctgaccaagatcgcctgtgcagagaattggagaagttgaggctgaccgtggtgcagtcaggtgtccctgccagcttgacagtacagcctaccctagagtcgcaaatccgggaagctcagaaaaacgacgaagggataaaagagttaataaaaagaatacaggagaagaaagacaccaatttctccatagacgaccaaggcacagtttggtgcggtccacgcatctgtgtaccggccaagaaggaattaagagatctcatcctaaaagaagctcatgagtccgcctactccattcatccaggaagtacgaagatgtaccaagatatcaaggcatatttctcgtgggctggaatgaagcgagacgtcgcagaatacgtagccttgtgtgacatttgccaaagagtcaaggcagagcatcagaggcccgctggtctgctacagcccctaccaattcccgagtggaaatgggaagaaatcggaatggatttcatcaccggtttgccaagaacccctagcgggtacgactccatttgggtaatcgtggaccagctcacgaaaccggctcatttcgtgccagtgaaaaccacctatgatggaaagaaactagcagaactctacatgacccatgtcgtatgtagatttggctgtcccaagaaaattgtgtcagaccgaggcactcagttcacctcaaggttctggaagcagttgcatgaagccctcggaaccgatctaaactttagtacagcttaccatccgcagaccgatggtcagacagaaagagtaaaccaaatcctagaagacatgctacgtgcgtgtgccctggatttcgaaggcacttgggatcgttgtttgccgtatgctgagttcttatacaacaacagttaccaggccagtatttagatgtcgccgaatgaggcaatgttcggaagaaagtgccgcacccccttgtgctggaatgaggtgggcgaagcgctggtattcggtcctgacatactcaaggcagcagaagaacaagttaagctaatccgagaacatttaaagacagcgcagaaccgtcagaagaattacgctgacaatcggaggcgtgaccttaagttcgaaaaaggagatcatgtgtacctgcgggtatcacccctccgtggtatgaggaggtttgggatgtccggcaagttagcaccccgctacatcggcccctacctcataactgccagacgaggcgaagtggcttatcagcttgagttacctgaaggtctcgcagatgtgcacaacgtgttccacgtatctcagttaaagaaatgtcttcgagttccagaagagcaagtccccctgggtaatatcgagctggaaaagaatctgacctacaagggaagaccaatcaaggttcttgaagaggcagaacgtcaaactcgaaggaagaccatcaagttctacaaagtccaatggagcaaccattctgaagatgaggcgacctgggagcgagaagatcttctccacgccgagttcccggagctgctcccttaggtgctgaatctcggggtcgagattcttgttagggggttggtctgtatcgcccgttccgtcgtggcgcctagcgggaaaattatctcttaaaaaccctaattgtgaaatttgtttcttcgcttgtcgtctagtgtccgtgccatctcaagatctcaatccccgatctatcatcgagttcaattccgaatccaaatccctccaaatcaaattcctccacaaaagtcaagtttgcctcccccgggttcgatgggccgaatccctctcggcccatctccccctgc

SEQ ID NO: 1482 - DNA, 23456 bp, Oryza sativa
  unsure (1)..(23456): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgccccgtcatctcgcaaaaacaatgaaatcaagtgaagcggccggctagctatgatatctacgtgcaggtgcatatgcatcacatatatgcaacaatataatcggattgggaactctaaaagcaagcgttatacttggagagcaagaacgtagagcatgctgctatcatgctactccgtgatcccctctttatatactatataagacctggccttttggtttgttttaagtcgcactttttaaagttgatcaacttaatttatagaatgaatgtagcaacgacatttcttaaaaaaaacaaataggctgtaaaaaattcaatggtggtgatgaaactaattttatgttgtagatttcgatttttttttataaaccttatgtacttaaagaagtttaactcagaataaactcaaaatatcttatacttcctccatttcacaatgtaagtctaacattttccacatttatattagtggtaatgaatctagataaatatatatgtctagattcattaacatcaactagctgggtggcccgcgcaattgcgcggctagtacccaaacaaaatcatatatttttttagtatgattttacttaaaatttattaaatagctatctcattgtcttaagattttgaaagatcaaaccttatcatcctcgtgtttctaattatatagtttttaaaagtcacaccagttgctaccccttatgtcatctacttctttatttgcttgctcgatctaccaatatttctattcattcttcttggaacctttaaaaattggattttatagtttttagagtttattgtcacattgggtttcatttttataatttctagatgttccgtcaaacgttaccattatactcctgtgtgacatgtccactgtctcttctctttattgtcattgagattttaaaaattgaacataattatcgtttgggttcattttttactttctagtagtcccgccaaaccgtcagcggctttgctattgtactcctctacggcttgcccgttgccttccttctttattgtcattgagattttaaaatcgaacatgataataattgttttttttttactttttagaagttctgaaccttaaaaaattgaacttgtagttttattttttataatttttagaagtcccatcaaacgatgccactatgctcctgtacagtccgtccgccacctactctttattgtcattgtgattctaaaaatcgaatataactatcgttggaattcattttttattttctagaagtcccgtcaaccgtcgacagctctgcaactatactcttatgcaccccgcccgctgcttctcctttttattgtcattgagattttaaaaatcaaatatgattatcaatgggttttttttactttctagaagtcccggcaaccgccttacttgtttacttcacggtctgcctgatatcccttcttttaatcattattaggattcaatttggtgttttattaacaatttttatatgtcgtaccaaccgccaccactctactcctttataggcctgttaattaatttatctcgtcatgtgttttagatggtcttttcttaacaaccgacaccttgtaagcttcgatgcctcgtgagcatggactcgtttcaatgatattttttccgtattgaaaatccaatttgaaatttatttcatattttattataaatataattaatctcattttgaattttagatggtctgtgtaaaacttataacctataagccttatattttaggcttaactacattaattaacactaaattatgctccgaggtgaatacagctccgagctgaatacgtttaaaataaatttacacgattatgattataatttgttgtcagttgccaatgtggccggacgcttctgggtgggttgcatgcattgctggtctggaatgctggttgcagctttgctttgtttgctttacctattgggggcgatggtaatcaactttgcttgtcacttgttctgccgcagcagcccaagtatatctacttcatatatctgcgttttatatgtgcggtaacaatgcatatatacttgcgttttggaatcataacaaattctgtaccgtattgtatcccgcttgaatttttgataccgtatagtaatccaattggatttttctaaacggacaggactttttaatctatatcaaagctctataattctttattttttctatagcaaatctaaaccgttgtaatctaaatctattataatccaacggtgtataattttctctttttctccgattaatgtgagaatttctagcccccacagtgaacgtggtgccttcttttcgagctgtcttaataatataatagaagatatgaatgtgggaaatgctagaatgactaatattgtgaaatagagggagtaatatggaacgaaggggattgtgtgatgttgccttaagacaagttggaccactaccttgagttatgtgagaaaaatcacacctctctacgcgtggtattaactaagtacgcgtaatcaaaaaataatataaatttcttagggatatatatctatcgtgagaaagtactatttgtgtccctactaaagatatcatcatcgcaaatgggtgataatataatcctcatttgtaatgggtatccactagagtataagtttggatgtccatgaaaatgaccttgactcgagactttaagctattttcacagcttatgcgagaaaaatcaagctcttctccgtgtggcatcaactacatacgcgcaatcgaaaaatcaatggaattaaatttctgggtgatgtgtctatcgtgagacgagttataattaatattggtgtgtagtgtggtcttgaaatttgagtgcatcatttgatccagtagagtttaagtatgtgtgaatatgacttagcttcaagacaagttgggctattttctcagcttgtgtgagaaaaatcacacctttctccatatagcactaaccatatggatgcacaatcgaaaaaaaaaatattgatactattcggtcaacgtatatggtgagaagaagtatcataggtgttgagttaagtttaagtatgtacatcacttcatccattagagtttaaataataaatatataagaatatgcgttggctcatatgacataagtaatacttctagaataaaatacgtcatgtaataatatttaattttaagtgtgatttctcaattacatggaattcaactagtttaaataaaatataacagggaaacttttaagtttctgctaacaaatgagttactgaatttctaccttgcgagtttgcgaggacaatgtatagaagaattatatggatagcgccacacaagaaaactcatctaatttccttagtgtacgtactagcacctgtttatatataacgtacgaatccgggactagagagtcccaggactgccgtaagatagggagcggcagtcccggttggtccatttttctttttttttttcccttccaaattgagtgagatgtatatacctaaatcaaacaccagatccccaaatcgtgtgctatgcatatacctaaatcaaaccccaaatcaacgtaacatcccaaatcattcacatcacaaatacaaatcctaagttacttacacacaaatcaactacatcacaaatcttaaaaaaaattacacacaaatcaaatgcatcatagatcgattatacatatcagatccatgcaataaatcacaaattgtaataaaagaaattatacatctcttaatcacaaattattaaaaaaacggagaggagaaccggcgcgttgcctcccgcctgctgccgctcaccacggccggcacgctgtcgccccgtgcgcggccccgctggccgccgccgcgtgctgccccaccacccgctagccgcttgctcgccgacgctgcccgccagatgtgaggaggagaggggaagaggaggaaggggggaggagaggggaggggaggaaggaaatacgagggatagaaggaggatatgatcttatctaaatattttggtgaggaggaaatatcatctgggacttaaccgatcagatatggagagaaatatttacttccggttggtagtatcaaccgggactactttagtgccgattgatacctcagcctcctgacatgcctctgacaggggtttgtgttactaaccgggactaaagatcaaaatttttataaccgggactaccggttcttattggaaccggtattattgtggaaaacagccgatccagcaaagatcatttttctagtagtgtagttttatctcatgtcaaatttatattcgactttattcagttaacgcgttgttaattcgtggtcgatcgatctagtttgtaggtgtagctgccgcaagataatatgcacaagcacatggatcagattaatagctgtcgttttaggcactacgccatttatgtggatcaggacacatgttgcaacttgcaagtgacatgaccgcaagtatatgcattgaactagtctaaaaataataataataaaaatagtctaaaaaagtagtatatgcattgaaccagtcaagtaaacgcaagtaaactaggtactttgatagtctgattgacacagacatatgtagcaactaaccggagtgtgtatggggcacaacgtacgcattcaaaacgttgggcattcaggcatttcagggttatgggtcgtaagtgaaaaaaaaatgtgaccactaatggaaaaacgcagttaatttacagcaagacttttatacccttacctttagttagtggaccaaaagatatagctaagtgataaaacgatgaaaaattcccaataaatcctaagagtacgctttaaaactcaacattattaattgtctttgaaacaagcaagcctaatcaacaattctgattttttttttggtggatggcacatggagcagtgttgatatgcttagatcgaggtcgtgcgtttggcggcgaccttcgtgagcgtggttagcggacgggaaccgcggcaggatgtggtgtgtactttgtggcagtatccttgcctagtcggctttgatgactttggaggtggtaatatctaggtcaacgactgatattctccgatgttactccagttctatttaggttcgatgtcagatgtgagcaaaattcgattagcacaataatcagccgctgatttcacagaagataaggacttcatacaacacaaaattcgattagcacaataatcaaccactgatttcatagaagataaagacttcatgcaacttataagccattgagcagaaacaacgaatggctatgtagattctcgccaaacatagattaaagtttagcaatacctattatctttatcttaaggttggtatttttaattcgtagccattcgatccagccacaacctacgtaataattggttatagcttctttgtagcatatgttgggatgaatttcattttaaaaaatgtgtattgctagattccaagagcataaaaatttgcgaaaattaggtcacctaaaaattacacattcataagcctaaaactgcatcggtatgcaatatacaattttacttatttttaactataatattattcttatatatagttttgatttattaatttgtatctgagcttgagtacttctaaaaaaaaattaaatctttatctttcatgtagtttggtaatatttattttttaggttagaatagtttacaaagtagcgtgcctcgctataagacatgtcacgtgtgtttgtcatctttatatatgatatccttataacatgctttaaggcatgttatacttgagtatgaagtatgaatcttttcactcccccccccctctcttcttattcccctttcccttttaaaagttgccaactatgcaaggtcaattagcagcacttctctcacgcatatgcaagtagctagtagtgcatgtgcatgggcgactgacaaggagcattctcgtaagaataatcaacaccttatccctatcgatgcctatcgatgtactcgtttacttggaagtttggaagttcacttgccggttcttacattctaaaccccgcgtggtacgcgacgttattagatactacatatactgtgtacctatatgtttctcccactagctagctaattaattaatctctcgtacgtttctatatatataagtgaccgcgagatcgatccaagccacggtatgctatgagctactgaaacctacctagctactcaaaagatcgatctagcttggcgagcgtgaggtggtgaggtacgtttacgtacgtacgtatactcagcatggccgggtacaccgaaattttggacaccaaccatcacgagcacaaggtgtgcttggttcgcaaggacgaacctttcatttgctctggctgcaaagagctcggcttcgagctccggtacgcttgccacactgcgggctgcaaccatcagtaccacaggtcctgtacactgcagcctctcaacactcgcgtgccagctcccttctacaagcacgacttcttcttcttcaagtcggtcagtacagctggtgcccgttgcgaggcatgcgctgctgaggtctccgctctcttcattcttaattactaattcctcctggcaaggtttatgattagatatacttaagtctggcttgtatatatttatatttgcacgtatttcgaataacataaatacatatttaaaaaccaaagtaattttgaataagataaatgcatatttaaaaaaaatcaaaggagtcatccatcataaaattaagccggtgataatacctccgaaacatgagaaactatttttatcccttgagggatgttccctcattgtttatatgttacttatgttacttaaatagttatgaaaaaaattgagaagatatattaacatgtgatataccactctacaaacatgtaagtttaaattcaacttatgcatctcgcaaaaaaattaaattatagctagttaacatatattcacagtcaattttattttttttctttgctagatatagaaattgaatttgaacttgcatgttcgtggagtgatatatcacatgttaatatatcttctctttttttttaaatttttttcataattatttaagtgacatacaaacaacgatgagacatctcctcgagttatcagaatccactcccccgaaacatatgttgatgtttctttccttggatggcgaggcatgcgctactgaggtcctcgctctctccattcttaatacttccttccggcaaggttgaccttgactgcaaattaatactctctatgactttttagtaaagaacgtcgttttgattttttacatagatttcatcatttgacttattaaaattttatataattatgatttctttattatggtttggtttatgattacagttacttaagtatgacttgtatttttacatatttgtacatattttgaataaggtaaatgcatattaaaaaaagagacgtcatccgatccattgtaaaagccggcgataatacctccaaaacatatggagttgtttcttttctttggatgtccctcgtttcttacatatcatccaaacaatataaattatttttgacaacattaatcaatatgtaatatatatatatatatcattatgtaaacatgtaagtttaaatttgactcatacaagttgaaaaaaagataatgaaactaactagcaagctagtgtattgttcacatattcacagtcatatttattatttctattccaacttaatttgtatataggttgaatttaactttaatgtttctgaaataacataccacctttgatctatattattagatatatttttttatttaagatggcatcgaagaaacgatgccttaaggagaaaaatgactttccatgaaatatatatgtattcacgaaaatagtattagtagattttttttcctcaaaactactccttcaatttaatcttttagaagaataaagattaaaaggtgctagccatatacattgagaataaaaaagttgagaagatatattaatatgtgatatatcactccacaaacatgcaagttcaaattcaatatagaagttgaatttgaacttacatggtttaatttgtttttttcgttgcgaggtgtagaagttgaatttgaacttacatatttgtagagtgatatatatatcacatgttaatacatcttctcaaattttttcaattttttatagctatttgggtaatatataaataacgagaggatatcctctcgatgaaaatagtttcccagtagaaaaccctttcccgccgttaatttacaccatgctttaggaagctcgcaggtgcgaggttacgtgtactactgcccggacaagaaggtcagcctgcacccttgctgcgcagatctcccccgcgtgataaccaccgagacggtgcagctgaaactggagaggaagatcaccaagaaatgcggcatgtgccacgagcggaatcaggggagcttcagcaacccatgggcctacgcctccagcgagaagatgatccagctgcacgtcgcctgcgtccggaaagctctcgtttcgcagttcgagtcgaggctttacggcgtgcaaaagccgaagatgctgctgccgccgccgcctgctgctggagcaagcgctgcttcttcaactagtagttcgactgccattgtggaatgcaacagcttccccgtgctcgaggtggataagtaccggaggaaatcggccgggttcctcgatacgttcaggcggatcgtcagggcagtcatggccatggtctcggcggtgatcaccgggaaccatttggagatatacatggctttcatagaattcttcaaaccgaactgagctgacaacatttgcatctttgcggtttggagctcgtgtgtttgtgcgcagcaccagtttctccctttaaattatagatttgctttcagaacttgaaaatgggtttgggtggtgtgtggtggttcttgcaagttgtaataagggggaaaaaaaggaacacatttgttcgtacaattttcaacatatatgtataagacgatcagtttaactggataaggtggttgtttaagctgcagagatgtttttggattttgagttatgacaacatgcaaatgattttccgaatgtaaattataattaaattttctttcagaacttgaaaatgggtggtgtaaaaaaaaacatattcttcatgcaagggaaccgtgaatagttcaaagtatagctcaggtgacatggtgcgagggtgttcgcccagtcaacctgggtcctggttttgaatcctaaatcagacttgtcgggcctgttcactttaatgtcattttcaaccttaccaagttttaataaagttgccaaaaaaatggctacatttagtttgtagctaaattttggtaactatataaaaaatcctgccaaaattttggcaagttaccaaaattttcgcaatgccaaaatttggtaaggttttttttttatcaaagtgaataggcccgtcatctcatggtgtttcttgtaccccttattcttaatacaaagatagccagctccgttattcctctttttttttttttgaccaaacgttattcctcttttgtttccaaaaaaaaaaggaagcgcaatctggcatacatgcatgcaaacacgaaccacttaacagttggaacatctgaaaaccccggccagccagatgctgaatcaactgtcgatcatgccgctgataggatttcgttagaaatagatacacacacatatatgcatacactgatacacaaaagcttgacctggagaatcaggccagagtatcaggttgagttgggactgtgggagctagtacaatcacagagtcgttctcaaaaactgtacaatgaagtagagaacggccaggaaaagcgcaatctggtacacatcttggttcaatccatcatccggcctttggaagaactgcaatattgaacacaaaagctcaaaaagttgaaaacactatcactggatagctacagataagtgggtgggtttatataaagtgacatcaatttttgcaatgtatgattcatgtaccttagtaggatcccctgagggatctggataaacctccaagttctcatctttctttgatgatagccgagatgctgtaccctttgcagcttcgattgtgtcctttccggcttcaacagtggagaaggccctcctggacaaccaaaagtaggcctgggcaggaggagacgaggcagagaggtcccatgagtcgacctgttcgagcacttggccgctaatctggttcaatacgaactgtgaggtaacagagacgatcaggtctcctccgatggttgcgaagattggattcttaggtttgcctctgaatgtccatttgatggtcaggttgcttgtcgattgcattgacatttcctggactgtctgacgcaataacacgaatgctgattagatagtcagactggaatcaatccaaactcatgagcatgccaatgtgaaataaggagagaggcattctttgtttgaatttgaactgacaaagtcctttttcttttggacagtatgttatgcaacttgtttgggttagatatcttacaacagagttctaacttcatggatatggtatagaattgcagcaatccttaccactgtagggttttcgagtgccttggtgatccacaatggcctcttgtacttctcccgtccaacaaatgttctgaccgggtcctgaaaaaaaaagaaaggcacgaaaccacaaggtgatgtcaagtagctcatcagttattgtatctgcatctggacatcctaatctgtcactagttcagtagtttgtttcttgctgttgtttgagtggtactttcgttgctattcttcttaatataaaatcagcatcagcctggctaaaacttctgaaaatggaggcatgttacctacttaaacattcatcagatttcctcggggaaaaaaaacattcatcagctaacagcagtattttgtgttggttcatagagcttttgcaagagcttctcggggtctactctgtgcctgaaactattcttgttggtgttgctaaaccttcggagcgaatacgcaaaagcgttactcgctgattgaaatggcatagctctatttttcccttccaagaaaaaaaaaacagatagtactgttaaaaaaaaaactacagatagtgtttgccacagttcatggaatcccatgatcatatcagactcgtagcttacatgtttgctagattaacttgaaaggagatgcaaagcattggtgcgagattggtaccaaattaatgtctgaattactgataacacatagtacggagtagcagtaaagtggtaattggtggtacaagggtgatgcgcacaccttgtatttgacggagacggcgtagcaggtgaaggcgcggttgtcgtcgcggaggtcgaggatgtcgcgggcgagctgcctcgcggtggcctccacgtaggggctgcttatgcactcgaagtcgttgcagagctccccgaagtccatcccgtccaccagcttgtccgtctgcgacctctcctccgcaccatctccggcagccgtctctacctccttggaatcatccacaactgcaatcacgcacagagccgggagttaattagatcacgtacgtgcgagctggaccgcacggcgagatcgcattggtgagatgagatcttcaccgtgcaggggggcgaggcggcgttggagcgcgggagcatggcggcgggagaggaagccggtgacggcggcggggatgcctcgccgtcgccgtcgccggggggaggaggagggggaaagggtgcgggaggagaagagagcggcggcggtggcggtggcggtggccattggtggcccatggcgcggtcggcgtggcgggacgtgaaaaggcgggaggataaggcgcggcgctccacggcctctcgttgccacatgtggcctccgctccattagccctggcccaacaactgctagtccattccatttctcatttctcttctatttttcctcaatttttttaagggaaaacaaaattggcccgtgccaactactataggtctagtattttctagtggactgccttcttctaggcccaacgaggaagatgtatcccaggatgggcatgactttcctgagctttcacgtgcctctagcttcgtgttttgttgaagaacacaatgttttcttatagaaactgttctagaaaatcatgcgtcacttatgtaattcttgtattctgccctctctgtttcatattcattttacgagttactttgattaagtatataaaaaatatcatagtattttcaacacaaaacaaacgtattattgtaacatattgaatattagatttgataaaactaatttaatgtattagatattgctgaatttatttataaatttgatcaaacttaaaaagtcaaaggtacatgtaatatgaaacagagaaagcagatgggactgcaaatgggagatgattttgtggatgaagtataggtcctgtttgggggagcttttagcagctgcagcttctcctagaatcttcagttgccagaagctcccccaaacagttcatcttttaatctagattttgagaatctgtagttgtagaatctgaaaaatgaactagaagctagaagctgggacccagcttctccagattctcactagctagcttctcagcagctcattctcagaatcttaagctccccaaacaggcccatagacacgaagaatacctctgttgctccaaaactgcccagtttacggacaacaaatcgaaagatgcacctgtgatccgggctacatgcaacagataaaatatacttgcatcgaagagtactttactcctggaggtaatcatatacagtatggtgataaagtagtgagttgtcctctttgtagtggaggaggtagtagcatttgtcgcagaaataacagggattgttcagagtccacttgtcgtccaccgtcatcttcgtggcatggaagatctggcacaccgaacacttctgtagccgcctctgcatctggaatgtcatgagagggtattccgcttggttctgtgtgtcctccgggtggatcaacctcatgtccctgatcacaatcatgtgtttgcagtttccctgaaaacgtatgtgcagggtattgtcagaaacatgggggaaagggttgtagatctctacctcaaccatcatacattactacagcttcaagttaatcgattttagatttcatcacaaaacatagataacaaacaacacaaggtttgattgtgactaaatgacgatttgatttccacaaaaaaagtgatgcagaaacatcacaacaataaaggcataaggagaatagataagaacctgatgacagtagaggtacccagcaccgagacggaagttcagatcagaaaagcgagtcttttccatttttgcagatttaaaatcaggaacatttgaaacattcaaacccatcagtaaatccttttgtcgtttcttcagcacaccagaagtaatggcatcccacttctcttccgcctcatttctggaatttttaatccagtcaagtataggtttactataatcaacagtagaacgccttgtgtcattatagaatgtgtcctgacaatagagagcgttgattaatacagttgcaattctttaagaacacacagcaaatttctgttcacagatgcatacctcaataagaaaataaccagaatgaacgtgttgctttgccacattcatcagcttgtctttgaaacagtaaatattgtctctaagatctgtaaggagctggcttcccaacactagaaattcctggctctgcaaggaaaggagatcaccaaaaaatttattccccacatatttcaccctacaaataagtataccaaaaaatatatgtatataagtcattactttcacagagccatatctcttctcataaacttccacacacagaagtacttctggatagactacaggtctgtgctccccaggtttgaaagttttgttctgggataacaaaaatggttagtgtgaaatttgagacaaatgagccacttgtgtaaaagagcaaatgaaataggctatagtttttaatgcaaaccttccaagttgtgctgatgtacctaagagattttgcaacatcaactttctcagctgatggcttagaaactttggccaacacagaatcaccactgcgttcaaaaaaatatgtttatagaaggctgtaatgaaaacaatataacagataaaatcaaatcatctagttatggccataagtgcatagcctggacagctgtattttatacttatcttattctctagtggctcagttataaaaaggaagcaaactattcctaccgggcataccatatatgatttacataaatgggctaataaataggatacatgagtaaatgtatgggctaatcaaaatccagtattaaggggaggtaaatttctatacctagttagttcagccagcacagaagtaccaattttttactgaaacatgaatctagccaaactgggctgcatcctgctatcatctgaaccacaaagaacgatttacattacttttacactgttatttgccacagcccatcagtaaaagttcaaattacttatcaacagaaattccacagctcttcagcaaagctgtgataacaccatcccattcggtagaaaattaaataatatatatctatgagcttatggcacaatcagaaaatggaattactaacaatacatacccacaaatcaaggtcaaataaatacatgcccacaaagttaactgttttacctgaatgagtgcaagctggctgcatgtttgtcttcctcttgtttggccttaatttctgccatcttcactgctttagtaagatagctcccctagttatagccatgccacaacatatgatgacgcaaaaccatggtcagattttccagagattaacaatagatgcaagaagaagagggaaatatgtatatatatttttttagagaaaactactatacaagataaattcatcagaaaatgcatgcaattaagcagagatgcaacattagggtaaggcatacttgtaaaatatgtgctcgaacttctctatcaaaatgcctgcctctctttttgccctttccgcattttgtatctccatctgcgcctgcagcatcatgtgaaacaacttccagatcctcgacaggtggtacagactcatgtgaaacaacttccagattctcgcctaatgaatttgaagtggtatttccaccttttttcattcttcctctggatttccccttcatgccacctgttttcccttcgatgccttgttgtggtacgtatggtacaactgccgtgtcaacagatggtccaggtatctccgtttcaactgacgaatttaaggtcggagtgacattttttcgcttcctgcctctagtttccccttttacccctcttgttttaccgttgtttccatgcacatgtggtatgcttgccgtatcctcagtaggtgatctggaagtctctctctcacctgatgagcttgatgtgatagcaccatttccaaaggtggaactagctgacattctgcatgtgatagttcgaaagaacatcagaccctatcattttgtgagccacataagacatgaatattaaatataataatatgaaaagaaaatttagatgccaggaattcagctacaagccataaaaattgaaaagagatgatttggtgcataaagtgcaaaccgctgttccatgctaccaattcacaatagaactttctttatgagttggcatggaatgacgctatccaacaattaaccgtccgtgttgcatctaattccaactcgcataaaagaagcaccaatcaagcaaaaatagcttaccctccatcaatcctctgatcctccagctgtgacaaagcagtggaatcccagccctcctaaaaacaccaaataacagagacatcacatcaaaatattgttcacaaaactagaactacaattaagcacattagcataagctcgataggaacggtcacctccatagcctcccggagagcgcgctccaccagctcctcctctgagaggaccctcaactcatctacgctgcagaatccacaaaatgtacaaaccagaacacgaataagcatatgaacaacatgacagacactgggggatttctccacctgatacggcggaatttggggggcttaccagagctcttcgtcgaattcatcaccaggatcgcccaattcatctttcagcgactgctcgcaaagtaacacagaacgcgattacaccaaagcaagggcacggattgaagagctagggtttggcggtgtgctcaaggggattcgaacctgcagctcgtggagcgcggaggacatgaactcggggaccgtggagacgggtccgaccatgaaggggacgaacacgggcccgccacgagcgaagggcatgcgccgctgctcgccggcggcagagctctccgcctcctcccccgccgccgccgccgacatcgccgtgtgtccgcctctttcgctggttgggggggttttcggcgccaatgcggtgggaagaaggctaaaagctactgggcccagtataaagcccaatatgaagaatcactactgggccgtcgtcgtctccgtcgagtatcgtctcgctccagagcactcggctggcgggcgaattttttttttaatatttacagaaataatctatcgaccaaaaaaattgcagaaatagcccctgccgccccaatggtgggcggcaagctgacgtggcagacggtgggtcgaccacgccgtctgccgccgtcggccaaaattgcgattagaccctagggcggcaaggggctaattgcaattttggccgcccataaagagcttgcggccgtaattttttcatctgggtcccttgccgccccaatagagagcgacaagggacccaaatgaaaaaagtacggccaaaagatatttctatgttatgttaataataaataaagaagtatttattggtaaaacttgttaatattgttataaaaatgtattgaagttggttgttgcgcaatttcatatgttaagtgaggtattattttgtaccttattcgatgtattagtactcagataatttatataggcctatcgcagtctgggtcatagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatatagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtatctatccattctctgtattgacatctccttggtggttcctgggaggaaagattaaatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacaaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcaaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattaattggcatcgatcaccgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagttacatgcatgatcggcgccgaaagttacattggtcgtatgcgccaaatggcgggcaaatatcgtatcgcacgcgaataaaggaggctgcatcggtgcggcagaaagtagtcatgcatgcgccgaaaggtatcgtgcatgcgccgaaaggtatcgtgcacatataacaacaacgtagtcattacacaagcatacagtactgaaaagtgaagcaaataaacaaagagaagattgctctactggccctgccccgcgccgcgaccacgcttggtcctccgggcctgtgctcgcacgtagtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacatcctctgtcgagcctgaagcgaagtcgaagtcaaagtcagtgatgtcgaagagcaaggtggaaggcagcaagcggtccgacgaggtcccagcatggtccagtggtggaccctgactcgacgtgccggctgcctgtgatgaagtcccggtgtactgccagaactgcgctaagtgcgaggtcgacgcagctgcctgagacgctgaccttgcagcctgggagaagtgggcggcctgcgtcatagcgaactgggcgaaacctacacatcgacaacgggacccttgtaagctaagacataatgcatgtaaattgattgtcgaagtaatgttgtttttttaagtacctgtggggggcacaacagaaggcctagccgaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaacgtgcgcagctggacggggaccagtcagtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaatgttggatcgtcgttgaaccatcaacgacgacccggttgatgtcgtcgacctgcatggttaatttgttcgtaaatattcgtaaaatttgatgaagagaaagacatgaaaacataaaggaatggtgcgatgcagggtactcacagcacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgaggaaccagtcctcaacaaaagtcgccaacgttactagtgcgaaacgtgccgtcagatcgtcctaccagtccacagccgtggtcactggcccaacagcgtctcccgcgagcggtagccccaacaagtacgatacgtcctgcagggtaggggctacctcaccgcacggcaagtgaaaagtgtgtgactctggcctccatcggtcgaccaaagctgctaggagggacctgtccacagtctattgtctggccgggtccgcgtcgccggcggcagcctccaccagccgacacatcggtaggaggccggcctcacgcagcctgcaataacaaattaatatgtcattataaaaaatattacagcgcaactaacttatagtaatacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatactgacgtgccatctctgaaaaatatagtgtttcgtgttagaacaattcagaaagtagtaatgtaaaccaaaagataatttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacggagccagacgtggcacgacgacgcctaggacgtggtcgagtggaggtagtgccttcacccgtagggcgagctccatctgctgttgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacatatattgcatctggtatgccacactccgctgcggcagcaatgacatgggtgcatgggctgtggagcagcttcggctttgcacaagagcaatgacatgtgccgtcggctttgagaacacactcctgcttcactctcttgcggtagatactcatgcctgccttatcttgacatagtatctcaaacctgtgctgttgggtaccttgcactagagctcgatgtttcatggcctttttatgcaactcctctagctttttctgcatgaaagctccaaacaaaatgctgttattcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttatgattgcacagcctcttgaacatgttcatgagctccttgttcttgaattgcttgaagaaatcagcccccatatgacgcatgccccacctactctatacatcttcccaaacaccggggtatcctcgttccatactcccaaactgcaactcttctatcgctcgcagaatgccaacgtgcctatcatgtatcatgctcacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgctatcttgcatgcatgtagagctaagaacgccctttgcagcacactcttgccaggatgttcaattgaggggaatttcttcacttcgtaagagctctcagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccagggacaaccatcttttttcttaacacaccgaacttcatattgcgaccggttcgacttggcaacccaaaactctctatgaagtgacactgcaaaatgttttactgcttccttcatatcttcttctctactataaatcgctccctgaataacctcattttctttgtgctcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccacttcacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatg

SEQ ID NO: 1483 - DNA, 5756 bp, Oryza sativa
tataatgcatttattcaaacaaattttaaagaatacacactatttaactcaatagtcacatataggatctatgaatattacctgaaatcggcgtctgaatctggcagggcttcgccccttcttctcttctcctcccctctcttcttttttttttcactggaattgaggagggaagaatgagggctgggggctaggcggcaggccttttataggcagcgaggcctgccgcccggctagagggcggcaaggggccgcctgcaaaatggccggccccgactggcttttttgcattcgggccccttgccgccccaccagagggcggcaagggttttcctgcaaaaaaaccctccctccgtcaccgcccgttcctcccccgtttgccacgtcaacttgccgccctagaggtgggcggtatggtctatttttgtaatttttttggccgatagattatttctgtaaatattttaaaaaaaatctaaaaccgaaaaaaattcgctggcgggctgggtgctctccaccgccgacccgtgactcggcccggtcgcaacgccgccaagctactccactatatccagtattatggttcattgataccgattagatttagctactagatgttaagagagttacagtaaacttattcctatttttattgaaattgaattattcttttatgaaattgaataaagactgttaaattcgcatacccaagggtactaaggccctgtttgttttagtttaaaattattgtaatctagattattgagtcagattattataagttggattataaaaagcctacatagaataagctgttagctgtttgtttctctgaatcattagctctacatagaataagttgttagctgtttgtttctctgaattattagctagttgttaggtgttagccacccagtatagctgtttgtttctcggaattattagctagttgttaggtgttagccacccagtaatctaaaaaaacacctttagagtggataactagattatagtaatctagcttatagattataataatctatcaaaataagctatctgtttgtttcatcttacttctattaatctatattataatagaagtaagatgaaacaaacatatagcttattatgatagattattacaatctataaatccactctaaatgtgtttttcttagattattgagtgactaacagctaacaaacagttaataatcaagagaaagagaaacaaacaatcaggtttggaaattccagtcatttcggacctcctttgatacgatattatttcggccaaaattttattttttttaacttttcatgaatttcagtaatatttgttcaaaatttcggactaaaatttcagaaaatttggtctatcggtgacctccgatacagtcggtcaatccaataaattaaaccctgcaaacagtttattctatatcagcttgttataatacagcttatagtaatctagatcaataatctagattacaattaagttaaaacaaatagagcctgaatcaataagcatgtaaaatggatctcaaccataatagatttacaaagtcatgtttatgcgtcacttacaaagttatgcttatgcgtcatgtccaaatacgtgctcattcaaataattggtttcgataagcaggtttccgttgctacaaagagaaaagaagatctatcaggtttccgttgcacaaagagaaaagaagttcccatgagtcatcgcttgtcaaacgttgtttgacgatatccttctcccaattattatccatgagcgccaattatcatccataagtcatcgcttgttgtttgacgatatcttctcctaattattatctcgttttcaatctaagataattttccgtgaaaactcgataaaaaagaggaaactcggtaaaaaaaaaaaagagtactgggattgctggttctcgttctagttcgttgaacatcaatttcacaaataagataatccaattcatgaacatcaatttcacaaaaaagataatccttacactgctatctaatcaaagtataaccctccagtctctccaggattgctatctaatcagtctctccaggtttgctatctaatcaaagtatcgatcgaaaatccatcagtttatccaggatttcatcaacacagaagtccagcgagctctgatcgtcccctcctcgcagcggctttttccatctctgcataaatcaaactactatatacacaaaacattctcaaaaacaaaatctttagtcaaaaaaacactcacggttcaaatgactaccgtttcgccgtcgtcgaacgaccacagccgcagcggttcgccgccgtcgtcgtccggcaagactaccgtttcgccgtcgtcgaacgaccacagccgcagcggttcgccgccgtcgtcgtccggcaggaggctttgtggaggagggatcgcgtgttcgcgccagattgcttcgaatcggttgtgctcgatcatgtacccgcccaagttgatgtgctcgccgtcgtacgcgacgccgttcccgctcgccgccggcggcggcgcggcatcctcctgggagtccaccatgagcgcgcccgcgtgagcgtgcgcgtgcgcgcgctcgagcgagacactttgttcagcctcgtcggcggccttctggatcgtgtcgctcgcggcggccagggagacgtcgatggatcggagaagctccagtagctccacgtcgggcatggcggcgatgccgtccacctgcgccgccgccatggccaactcgccgccgccgccgccgggtccttgctttgcggcggcttggttctcgcagtaggaggcgttgtccacggagtgcttccgccgatccttctccggcagcgatttgtaccgagtggcgatcgcccagacctcctccttcgacggccaccacgtcggctcgcccccggcgccgacgcccgggcagatcacggcgacggggacgtcgcaccgcgtcgcgagcgagctcgccttcctcaccagcctctccttcctcatctccaacgccgcgcgccgctgctcgccggcgacggcgggggtgacacgagcctctccgccgccgccgccgccgcgcggcatcggtgctcccatcatctcaaacgtgtgcgtgtgctagcagatgaatcttgtgctagcagatgaatctcctctcgcgcgagttttgtaggctgctccccttccgggcccaagaagcgcacggggttgggcctgaacacgacccggagttcccttcttttttttttttttggaaaaagtccacttagactcccttaattgtttaccaaatctaattggtgaccattaactgaaacaccggataggatgactccccgaattattgaaactagtgcaatttgactcctccaacggttttacaggacggttttgctgacgtggcggtgctaacccgattttcattctacgtggcgctttcgtgtcattagaattaaaaaattgtttgtgggacccatttgtcacacacaagaatattatgggacccaccgacatgtggggcccacatgtcatcctttctccttcccttcttcctcctccctctgtctcccttctctctcttttctctcccccttctctgatctgatctcccgggggcgcctcttcggcctcactcgacagcaactcggcgagatcggcgagcgtggtgaccgacgggcggcggcatccatgagagcaggctcccgggggcgcctcttcggcctccctcgacagcaactcggcgagaccggcgtgcgtggtgaccgacgggcggcggcatccatgagagcaggccgggcggcgcagatggagtcggcggcgacgcggcgtggatctctggtggtggtggaagcggggcggagcccgaaccgtcctggctcgcggaggatggccggcggccggtcggcaacgggcgcaaacacccggctctggcggcgaggccctccagggcgggcgccggtcggcgacgggcgctcatccccctggtctccggcgaatggcgtctttctctcagatcaatcagcaccatcttttcacaagatggccggatcgagtcaaactagaaagcaacattgtatcaccggggagattccacgccatttgcagctcgacgacatagacacgggcacacggccgatattacgcgtacagcaatctgacaaacgcgttgttattcccctctccaaccttcctcgatcgtatatatggcagcagcgcagcacgtcgtcatccggccatggacgtcacgggagctggtcgcctggtcaggccatggcggagcagggagcggaggggtcgatggcggcgttgagacgaggcgatgcgctcggagccgaggacgccgtgggagcaacgcggcggagggggcccgacgacgccggccgtggacctcggcgcagagggcggaggagatccggcggagaccgaataagggaaggagatcagatcagagaaaagggggagagaaaagagagaggagggagagagagggaggaggaagaaggggaggagaaaggatgatacgtgggtcccacatgtcggtgggtcccataatatattcttgtgtatgaatgacagatgggtcccacaaataattttttaattttaatgccacataagcgccacgtggaatgaaaaccgggttagcaccgccacgtcagcgccacataagccaaaccacactctaaaaccgctggaggagtcaaattgtactggttttaataattcagggagtcatcctacccggttttctagttaagggtcacaaattagattcaatgaactattaagggagtctaaggggactttttcctttttttttttggcaattgcttatttgaccctgttttgccgatttgaccctaccttttgaactttgcttatttgaccctccttttcgagtacgaaggttccgtctgaccctctttcgctgactccgttagggttcaatttttttttaaaaaagaaaatgtttccagagttcctaatggcaaaaataccctccaaagccaaaccctattctgactctctctctctcactcgtgcgtacctctctctcacttgtgtgtgcggcggcggctagctaagggggcggcggcgacggcgagctgagggggcggcggcggcgtcaagcacagccccgccggcgcccgctcgttgtggtggagggcagcggcggcggcgagctgaggcggtggcgacgacgtgatgtacagccacgccggcgccctgtcacgccccgaactagtcccgactggaactagcccgtgacgctccaaattaacctgttaatcgataccagtcccagaaaacagtgctggtatcacaggaagacagaatatcacagcaacagaggtctctttattatagagtagtagtacagttatgttgggctgcggacagaccccgagctcacaactgcattacaaaaggaaaacggaagcaggacttggaccaaacaatacaggcacgacttgggaactaggccgaaaccctaaaactcatcgtagccggcttgctcctggaagaactcctcatcagcaggatccgcttcatcttcttcagcaactaggggggaattatttatatagggcaagggtgagtacgggagtactcagcaagccaggggaaataagtgtttaatgcaggcttcaaggagagactggtgtttttgcaattgatttatttgaactcttttcttaaacaactaagtgagtgcttctcaaaccacaccgatgagacagtgcc

SEQ ID NO: 1484 - DNA, 491 bp, Oryza sativa
gagtatcaacggatgccttcaacttaaaatctgagtaacaacttgggtaaaacttgggttttgcaaaagacttgaaaaacccgacacctgggtcggtgcttgcgaactaaatgaattccaaaacccgcggccggggaccgtaccgggtgtacggtttcccgttcttgcagttaaggactgtttccttgaaatttcatccaaacataagacaagtacgaccacatgggtggaatgggagacatgtggattcaccggggtggtgtctgggaggacccctgggcttcctggcacagtatggtctgggacctaccctgttgttggtctgggacccctctcgtcggcatatggtaaacctgtgtcggctttggaaatatcttgtcatgaaagcttggaggtctcccgacgtggctgatccccacgggctgggtgatccgggttagtaatgtcgtgtgggtaaagtgtaccccctctgcagaggttaacaaactgtt

SEQ ID NO: 1485 - DNA, 410 bp, Oryza sativa
agcacaaaattaaagcctggactagagacttccttagcacgtgagtcccatgatttctgtatggtagctgatcctcgtattgcatctctcatcaaggggctcctagaagcttcgatggcttggttatcacttctaactgctttcgggtatggtcctagcagaaagttgaaccttcctgcattagcttcttgcgttagcttaccatgataatcaaagagatgtccccagaactcatcaagaatcgctgctaattgcctccttgctgcacgacccaaaccaggcagtcttgagaggttactgccacgataaccagcatcagagtctctccccttgctcaaagtaagagatgttgggtcatcagaaattggaggtgccttgtttccagaagacttgctgacttccgcattata

SEQ ID NO: 1486 - DNA, 13079 bp, Oryza sativa
tcaagttgtttgtccaggtactatcaccaaacaggatttccgcagcaaaaatgatatttgtgaacagcaaaagaagaaatgctaggatggccaatatttcaacgtacaaagatattttatatctgctcattataactcttgatgaggaaacacggaaaacaggaataacagatgaaggaaggaacatagcttggataactgggcagataatgagtaactgatatatcccttcagaacctgcaacctttgcatagtacatagtaggaaccatggcaacggcctttagtagcagatgatgagcagaatgaggcaagtttacaccaaagaaattcttcaaaattgcgtggctgccaataatagatgtcaatgagatgacatgactcgaaaagataaggatcactaaaaaaacaattggtgccatcggattcatgaacatctgcagaaggcattcagaggaactcatgaaggaactatggtgcagaattcatactcaaaacaagcagaatgcaaactggaggcaaaaacctggttcattaaatctacagaatcttgaaaagtaaccagagtattattggattcaactgctgctgagcccatcaggacataattcacaaggaaaaccccagtgaaaataaacaatattgagaacaggtgatcgtggaacagagcaccaagggaaagagttgtagattgtctttggccctgcacaaatgatttctgaattaacaaaaacatggcatagcagatagaacaaaaggtaaaaaataaaaaaggaaaatggtgtgggtttacgaaaactgcatggcacggagagcacaaatgtcaaaggtacagtagaaccgacttacacgttttatgacaagtttaagcttcagaaacaaaaaactgtattggatcccctgactttctattagttgattgtagaaaaggcatataaatttaaaatgcaggtttagtgatcatcatttgcttagagaaaattgcaagaaatttttcatgagcaaaagaacaaatcaagcatttggatcaatctatgcatatttttcttactcttttcttaatatggaaagaatgtactacaaagttgcaggattatgcttgcacatcttagcataggatgcatgattctggtttgccaacccacacaccagtttctattatcacaccacaaagttgcaggattatgcttgcatggcttagcatgaaccagaattagcttccttgcagatttcaaaactaataccaatcatgtattagaaaacacaacttaggaaaaccggttactttaaactacagcctggggtcaagtcaacctgtgcaaaccagaaatcagcaggctcagttatgtgattagcttcatggccagcaagattgacattgcccggttttgaacagtccattcaaaacctggattgaacagcccaaccttaaactataatgccaagtgtgggaaatttttttaaaaaatgagggacaaaataggttctaccatttttccaaaaattggcaagtaatgaactgtcctcagaattcatggactgatcagaatagttatacaagttaaagaagtatttactcatatatataacttatgggtggagtacaagttcaacaaaagccactatctcagcatttacttaagcatcagcataaggaaatggagcttgcctgtacaactgatgaatgaacataaaaattgtgcgctattacatttccgccaagaagcgccatcaaggaataagcactttcaccactcaacttggggaacattgcattcatatcaactggaatttttggttgactgactaataaaccaagcacaaaacaaagaagtgcaaagcctgctacgcatgcattcaatgtcccagccatccgtttgccctagaataaagtaaaggcataacgtcttagagttgctcttagtggtgcagaactgcagatattctgagatcaatcataagcttaccagataagacatagtgtaaggtagcaaattgaccacaacactagcaaaatataagcctgcgataggatcatcatattcaaagaccaggttgaatccgactgatatgcctgaaagctgaaataaccaagtattaaaagtttgaaagctggcaaaaacctgaattctctggtagtgaatgctcctataggtcaactatgcataacattggtaaattaactctagaacaaagaattaacaaaaaaaaaaaagagagaggaaagcttgtctaaagtgtatgaacataccatggttagttccgcggttagcaaggacaatcctgcctgaataccaaggatgacacatattgatggactgtactcctcgcggcaaatcttccgttcatgtaatattgttacaaaagttaacagctctcgaagaaaatgatagatgacgaatatgaaatatcaaccacccccctaaagaaaaaaaaaggaggaaaaattgaagaactcccccactattttttatgtggttgatgctatctgagtaacactaaatacttccacttaggaaaaaaaggtacagccattcattgagctaaactgaagaaatgtgagtaggtgacgacagatgtcagcaaagtggtacctccgcaagatttttcccagtgaccatgccgatacacatcgacagatactggcacagaatggccgacaagttgaaaagcaacaccagtattacgagatcatagccaaaccgagacccggcatctatcgtttccacccacttcccaaggtcaatataccccatcgagatcaggagcaccggtccaagggtacgggaaagatgatgccaaccatctccagtagccagagattctataccgtgcacaccttccattttttgtggcagcaaatcttataacaacaaaagatggatacgaatccacaccactggatcaaatgcccgacatgcttatcaaattcagtcccttgaacactgttaactcaagcagtctaatcaaaccctccgaagctggtgaacatctagaacaccatgaaacacctccaagaaggatcaaatgcttatccactcaggtctcttcaaagctcttgtggtgatcgaagaagtctaaccatccaaacctgggggacatccatccacaacaccatgaaatcctccccaagaagcatcacatgcctgaaatgactaccaaattcagatccctaaagccctcctgttgtgacccaagcagccctaatcaaaccctccaaagctggtgaacatccacaacaccatgaaatcctccccaagaagcatcacatgcctgaaaaatgctttaccaaatccaggtcccttaaaaccctcctgttatgacccaagaggccctaatcaaaccctccaaagctagtgaacatccacagcaccatgaaaaccccccagggagacacccctgatctaggttgcccctgctctaagctccatccatcacagccaggggcggacctagcgtggaccatagatgttccattcaacccaatcccaaatgctttggagaacaaaactggtatacctagactactccagcacgcaggagcacaccattcggactagattgatttctcgcaacatacaggagagggatatacaagagattcgtacgcaaaaaggaaaaaaaaaacagaggaatccaagctgggggggctttgccgcggcaagaggcggagatgaatccggtggaggtggtggcagtcgcgctcgtgctccggtggcggagagcgcgtggaggtgagagcggctgctaggtgaagtggatttttttagtggaactgtggaaagagaggatgtgcgagcgcgagaaaaaagggcaaagctcgtgctatgcccgtgccttttttgtagattgtaaaggcctgtttaggtggtgtttggaaaggagggacaccttagttccctaaactttttttctcaaaaaattcccatcaaattttagacacatatataagcattaaatataaattaaaaaaaattaattatacagtttgtatgaaaatcgcgatacgaatattttgagtttaattaatccatgattaatcataagtgctacagtaacatatatgtgctaatgaaagattaattagacttaataaattcatctcgcggtttccaaccaagttatgaaattagttttttaatcgtgtctgagaactcattttaacatccaatcaaaagtttaatgtgacacttaaaaattttcttttcaccaactaaacacagcataaaatgagcaagcataatattctccagaagaagaccgcggccgaatcagattacggcggagtcgagacgagggcatatacgcgatactacgcctggtcccgtgccgaagatgctgccgaattaaccaaacacacgccgttgtctcctttgtctctcgggttccatcaaaccgctctatctcggggagttcagctgcaaaagcgtgcccacccaccctttcctgttttcgtcgtcgtcgtgcgtaggagaggcacccttaaacccatgcaaaacctctaggagctaaagtagctttgcacgtgtatgttgagcaacttgaccacgttcacctggggttgtgagttcgtctagctctctgctgtgctgtgctcccaccaggatgagcttgcagacgagacgacacgagaaaatcagtcggcagcagcccatgctaggtcgcaggattatggtgcctcctcctcgtgagtttggcagcatcccacgcccacgacacacactcgtgtctttgtcatgagcaaagccaggggcatcccggacaaattgggtccccgtgcgaaatattaaaatggatcctagtggcctagtaactgaggagaggagacgaagcgacgtggcgttgggacttcgacgacacggacgactgtacgatggaaattggaaaatggatcattcaccttttgcattgttttgggggcttagttttactaaaattgaagcatttaatattattatatattgggtatacttaatattttagggcccttgaaatttgggggccctgttcggtcgcacagcccgcatgggcctaaggacgcccctgagcaaagccacccgtcaacaatgaagcacgataacatcactaggaggagatcgtggcaacggtcaatatcgatgttgatggctaggtgctaggacacggtgttataagcaacaacactagttgttacctatgggtactaaccagatgatgtgtcatatgacgtacctacacataaggtgggtgagaaacatgatcgcttcaccatgttaggtgccaatcaaagctccatatatagcagcctcatggtctccttttccatcaccaatgacaatttatgggaggaggaattcgtgccggtcggtatcaattctccttgtttgcctcttttctgcatgagagtcaaatccggtgcacatcgtcatgccttaagcatgagacggaggacggggagttgaggaggccatgggtccagtgacgttcatcgtccttgtcatcaatgtgcgcttagactttaggcctttaggtttaatgctggtggcatgtcccattaccaccatgtgcgctcagactttaggcctttagatttaatgctggtggcatgtcccattaccaccatgcctattcacatactccctccatactcataaaggaagtcgtttaggatatcgacacggtctccaaaacacaactttgacttcttatttatataaaaatattcattgaaaagtgatatatgtatacttttatgaaagtatttttcaagacaaatctattcatataatttttacattttcaaactaaacaacttgagagttattcatgatttatattcccaaggtttgacttaaacattgtcctaaacgacttcctttacgagtacggagggagtatcaaatactttatccgtttcacaatgtaagtcattctaccatttaccacattcatattgatgttaataatctatatagatatatatgtctagattcattaacatcaacatgaatgtgggaaatgttagaatgacttacattgtgaaacggagagagtatctaagtatctatggctaaggagggagaagaagaaggggagcacaggaggggaacgactggagggagtagacgggggaagatgagatggtctgtcattaagtatctcgttgtcaagataagagtttcccccatctgaaaatttcccattaatcaaggacaatttactgttggactaggatagaggtaaggtagaagagaagattgattttcaatattgaatatatagccgcgtgaaagtatcttttgtgacaaatttagtagagcttttttaccacccttgaaatagtaccttgaggtactagtaatgggaggtactggatcaaatccaatcgttcatttagcagggtgaggatggaccagatgaaaaaacgagagagagagagagagaactcttatccacagcataggtccgtgtctcttctcccatcaccttgtcgcaccggcgacttgcaacctgctcggctgctaatctctatctgcaccgcagctgccacaaatctctccccttccttgctctggccggctgcgctatgcgtcctagcttcctccccttcaacgccatgccgcgccgttcctcgccgctctcctcttgttggatgcagtggcaagcgctgcattggaccactgagatgcggaaaggcgccgcggcagtaatcaaccagccttcacactacgcaaccgcagtaatcgatccagctccacgcagccaccgtgtaggaaggaggccgacctgacgtcgtcgtcactcccgccgaggtcgggattgagaaggttgctttgcttgtttgggctggaccgctggagacgcagacgctcctatccactagaatgaacgaatgtgaatgctaaaatacaatttttcccttccgctcaagtattgcatgcggactgcgaggaggtaccgtgcgcacatgaaacttgtacctcctgatactaaatcttgtcaacccttggatctggctcaatgaatggatgggattttggtacctctcaccctcaagaatgataaaaaagctcaattgtgcattctaaaacgacgttgtttcgctatttgggaatatatggatcataaaagttgaaacaaactctgaaagcaaaatgattttattaactttcattattccatgtgaataattcctaatgaaattatccatgcctcaaggttactcacatttgcaacgacttatccctgagaccctgaactacgaagaatcacggtaatgcacactgatacaaacaatgaaacaaatcgacgacggcaaacgcgcaacactagcaatagcacacgtatatcgatctaaagaatgcacgcgagactcagatggagatgctgttggggatgcccatggcggtgagcccttggcccttctccttggtgacatccgacgtgttggggtacagcagcatgtacggcatcttcaccggcccgttccggttcttgagcgccgagttgccgttcatgtccttgatccggttctcgatatccaccagccggctgccgaacctcttgaacgcgtccagcgccttggcgtccgacgtccactccggcgtgtcgcgttggccgaggtagacctcgtcggaggagtgcttggacaggatctcgatgagcgagatgccgaggatggtctggaactggctggtgattgtgtggatgaacaccaggtcggcctcgtcaccgccgcgctccagcttcgcgtactcctcggtgcccggctccggcatcggccgccggctcaccgtcggccggttcgggaggaaccccgcgtacgggtactggccgaagttgaccgccgcgtgcagcgccgacgcgatccagatgatgatggtgcacgcccgggtgagctcctggacggtgtccatcttgggccaccagtcctggtccttgaggtcgccatggccgacctcgcgcacctccttccaccacgcctgcagctcctcgtcgccgcggagcacgccgtcgttggggtagtagatggccaggtactcgcccacccaccgctcgatcgcccaccagatcaccagcccgtccacggcgtacgggtagtccttgatcagcagccggacgttgtacgggctcgtcgggtccggcacggccacccctctgcacacacaaaagcaaaacccatcctggtcacatcgttgttcttgccgtgttctgatcagccagagctttgcaagatgtcattcattttggttttacctcttgacgagatcgacggggagagcctgctcggtgaacttccagttcttgtacacgacggaggacatctcgagcgcgtacttgcctgggaagacggtcttctcgaagatgccatcggcgttgatgagtgtctgccgtgccagagcgttgatgttcatcgtgtcgcggtagtgcgggctcagcagcttgtgcacggggtgcaccacgctgagctgccggttcgtcgcgatcacgaacggctcgatcacggcgtgagtgttcagcctgcagcagcaacatgcaaaaacatcatgagcctccttttcatactccaacacagaaaacgaaacagaggaggctggctctgtaccagtggctgatcagctggtgccaagcagagtcgttgacggaggcgtaagccttggcgagctgccagatttggctctcgacgccggtgttggctggagtgtacaccttgctgacggcgccgtgctgctggccatcggggtgcggcaggctcagctcgatcgccaggggcttcagggtgccatcgtccttcaggagcagaatggtcctgctcgcatatatgaagttaccgtccaacttgttgatcttgtccaggaacggcatgaagtgatcgtggtggtctaggatgaaaagcctgttgcccttcagtgcctgcatagcatggttacttattggtcaatctcctgagtgtatgcagttctagtatagtcatatacgagttatttgcatttcaaagatatagcatgcatgtttagagctgaaatgtttcgctttgtatgtcagtgattcagcatacattttgcaccgtgaggccctccatgttgtgcttaatgtgagcttcggtgatcttgctggtatggtcaccgtacacatttggatccagagtactttttgccgggaaattctatgatcagttggagaacaaaaaaaagattactcactccattatgcgagcacagatgcacatacttgcatatcctacaacgatgaagttactaaccgtcagacgcttgatcatcactgggttaactcctgcgagcatttctcgtgcaaactcctcatcagtcctccaagcaaatttgtcctctgaaacatcataaacaataagttgtgataataccaaatatgaacagaatcaaattacccaataaggtataaccatacagagttatgctcatgcagaaagctggttacctttgataacatgtggtaggggtaacttcaagacttgatcgccagcaactggcaaaagactcttaataagttcaaagggaactctcttcttgatctctgctagtgcagaggcattggccactttcaatccaccttcatagagttccatgatgtcttgaaaagaatcaaactcctttggtgtcgtatcgacataggtccttattattgggagaacaccctcaacaatagccttaagagagtacccaaggaagtctgacatcttgaggtgcccgaaccgttcgtcgcgtgggacataaatgttcaagtccagcagaggaagcctgctttctgtatttgggtctgagaaaatattgagcaagaaaagaatttgagggaaccagttgcaaggtgccataaattcaaattgaagaaaatgcatgatatctataactcaccagtctttgttggggcccggccagttctgcctcgacggggataggggagttcttggctgccaccgaggactggtcgtactagtttactgcctttgtctggttggccaaggtcgttatagtaatcataacggtagatacggtcatgctccttgtatggtccaattttaccgtcccctcgtagaatgttgagttcttcttgccggtaagggatcaaaggtgcaggcattttgctaggcagatatgtctgcaaaacagcaagaaaataaggcaacagataaacttagtaaatagaatgagcagtttcagtcactcatcaagaagataagctgacaggtgaaaaccctaatagcaggagtattaattaatcaattggaaagtgaatttatattactataattaatcaattagaaagtgaatttatattactactcatgctttaaaactgaaagaaaatacaggcagtatcaatgacctccatttgattgtcagcgaggcagctattacttgtttttttttttcataaacaaaagaaaagcattcaatttttttatttctatcaactagttgtagatcaagcgattgcatatgccatgcatgatacataaacaaaagcttaattaaacagcacacaggtgagtggtgaccaagctaaactattcttttgtttgcttgtaagaccaggtcgctaatagggacgaacgagcggttggtggctttgtgtctgtgggcattcagtttggtgttgtctaggacaagtagcacaagacgcattcaatcattttgaagaatcaaacaaaaagtggctagtaaaaggactgtcattttcaaaatggaactcagcaggtgtaattttctagctatgtgatgtcttgcatgatttgacagtaggaatgtaggatcattttaataataaagactagcatgtaccattcatgagttacgagtagttgtcgatgccataacttgaaaaagaacaacttcatttttatacagccaattgtagagtacaggatgttatttccactatatgtttattgtgggaagccctgaatcccggacatcactatggacagttggacggttgactagactgcagcaccaagctcaaaaactgctagtaactcaacttatcagctgttctatccaactttctttccctgttgtagatcatagtggaagtcaagtcagcttctatactcctaacctgctgacagactggacaaggatgctatctattaatctataggtgtagtaaattaagaaaagatacgatcaaattctagatcacagttatttccaggagacaaggtggatatgcatatgctatttggatctaggtacagctatcacggtacctaatccaacaaacacttcaaaaacgaaagttgaccatgatccaatatataatccataaatatatgttatgacaaaaaaatggcataggtttgtttagcttttcaaggatttctaaaggcattgcgatatctaaatccatgagttggtgatagccgcctatctccagtcactgtagaggcatttacatattttcatgcacatgtaagatgtcatatgtccaagattcatactgttcctgatgtttctattagtatctgcactctgcagccatcatattgtctgcagaaagtggtcatcaattattgtaccatcgtctgcagtaatcaattttctaagtgacgtgtccaagattacttggcatggaccatccgatcagaaaccctcgttcagtgcaattatgaaaactttgccttgaatttttctaagtatcatccattatcatcatgcattcatggtcggctgaaagacccccacctgaacgaaaattccttactgcaaccaaactactgaaccgtacatagttcatcaattgcaaactttggcacaaacaactatgttctcgtattgattagaccactagaatttgcatgttgatttcaatattcctaatagcaagggagctcaaggcttatatagttaatgtcagcggtttagctcaaggctcttaagcaagttctcatctttctttagcttaagatgtagcggtactgctcattagcaagaattaactatggtctttgagcaacactgcagaagagcagtggcattggcaatgtccatctggaaatgaaaatggagtagtactactaggcttctactgtaactaagatgaccgttgaccaagaggaggactaggagtggactcacatcgttggcgaagaagacgcgctcgtactggtagttgtcggcggggtagatccacgagttggcgacgaagacgacggtgcccttgccggggacgccgtcgagggtgagcgtcttgaggaagaactcggaccggttggagttggtgacgacgacggcgccggggatcccctgcgactcgtcccactcgaacgccacccggaacaccgactcccccgccgccgtcgacttcatcgtcaccaccagctcctccaggtgcgccggcttccccagcttccccctccctccattgcctgtccatccacaaaaattagacaaaaaattggaaagagatagaaagaaaattttgaaaaaacagatccatcgatgaagtgggggacaaatcgacaggacgatcaatggaattgggtgtccttttcttgatttgatttaatcacatttaatcacatttgattgtagattgttgaggggttaagggacgtgtgttgacgttgaccgtcaatgctgcctcctcccatcactccactaattaatgttcccttcctttcttctctacggaagtagcattgaatgcgtgacaacaaccaaaccgcacacttcaaatttgtactactactatacgctttttttccgaggaaaagcttgcaaacaacgcttgaagactgcaaataccggtttgtaattaagctattagcgagagcaattaaacggaaaccccagccagagaaaacgcggctgtttctcctgttcaggaaacgaatcaaccaaccaaccaatcacgccgaggcaaaagctttggagcggaaacacgcacacaccaaaaaaaaaaaaacacgaaacgaaacgcacgcacgatgagcgttttgctttggccggcgagcggcggcggcggcggcggtgcttacttgggtcgcgggcggtggcgctgacgaggcggaaggcgacgccctccttgtggccgaggatgttgtggacgccgtcgaggagggag

SEQ ID NO: 1487 - DNA, 4284 bp, Oryza sativa
tcctgcagccctgatggagagagagacgaagccgcggtgggattttatagcgacgcggccacggccaccagccgcggcggctttgtggtgcccgcgcatcgccgtcgcgagtcaccaaagcggaggagttcgtaacagggaaactattggatagtaccatcctaccgacatcccttgttgttggtatgcacacttaaataattattaaacttttcctcgcaaaaaaaatattaaactttttatgaaaagatagattaatataaatcgcttcacagacattcaaatttaaatttaacttcaacatattataaaaaaattaactataaatatgcattaattattgtttaatttaccttttttaaatggtataacttaaaatttgatatatcatatgttaatatatcttctcaaaattttaattttaccattgttttttaattatttaagtgtgtaaacaattataaatatctcctattaaaatccactctagttcataatagtttttgtaaacgttgtgtttttgggatcgattcgcgagaggctggccgctggcgcgcgcgggcgggcgggctgtggcacatgggcggtgtaccggtcggcggtcgctgccatccgccgcgcttgatgccaacaattgccgggttgactgtccaaatggtggaaccaaaccatggaatgatcgaatgatcaaaacgagggaaatactcggggtgtttcgccgcacaccagcataaacacccgtgtgccgtgtgtgcgtgtgatggataaggataaatgcatcgcaaagttcaaaagagaatttgaacccggaaaggaattgaattcgggtactattcagaatgttgaattttgctgggttcgtacaacgtcagtgtcccgtcagctggttaattcattcttacaaatatccgatgcatcaaacctggcattacctcattaggcgcgctgtggacacggtgctttggcttcttgcgaattttgaatattttacgaacttgtataaaatgcctgctccttccaaggcattcaactccatggaaaagtaaaactcaatatcttgtatgcaatttatgcatgtttcagtctattgtttggttgtttaccatatctacttgagtaaactaacgaagaatcggcacaaactcattagcatgcgtcaccttacccttttctattagaaaaaaaaatgattacacatgcgtttaattcaaaggatgcgacagcaccacctcgagaacgagccacagctactccctcgtaaaaaaaaagacaaactttggatttccgtatccaacgtttgactgttcgtcttatttaaaaaaattataaaaaattaaaaagataagtcacatataaagtattaatcatgttttatcatcaacaataatggaaatactaattataaaaaaatttcatataatacgaacagttaaatattagacacggaaattaaggatttgtctttttttgacggagggagtaaccgtcatcattgttaacacgccattgtgtttttggaggcgagcaagagagatcggatcgatggagactggaagttccgggcctaattaagctacgtgcatgacaagctaagctcatggccgtggactcgatcgatcggaccgaccgatcgcgactaggccggggaggattacgtacaggcgttactcgaatccatgggcgcgcgtcttgactcttgactagcgagggtatacatacaagtgaccgcgccctctctcacgcgcacaaaattaacggtgcacgtcaggtgtggctacgtgccgagggtgagggaccccaccacaaagggttcgacgaattcatgaatatatactgccctttttatggggaaattttctcgaatgccttagaaatttcggccaatgtatgcgcttatattttgctcactttctgataaacgtttggaatttgattttgatttacgttacgtactcattttgccggttgagctttagttgttcgtttaaaaaaaatccattttacccttaagtacggaagaattatagaaattcatggagtacattgttggtacttggtagtgtataagtttattgtatagtatgactttatattcatgagtttgttgtgcggaatattatttatgataaaaatgcatgtcttatattataaaaccactttaaaaattagttgtgcctttaaaaagtaatagaaaggttaaatatttatttttctatttttcatattaaaaagagtaatgtggtataattttttatgatacatacaataggtttgtctaatactaagactttgtttggcgcctcttgttgtggctgcaagcgattgaagaaatgtaagttttatttctatagtagctggttgtacaactatagtcataacttctgaataagttctaaggttgtgttcgaatataaaggtctggaacctactctccaacatgaaaaataaggtggcttattagcatataattaagtattagctataaaaacctgaaaattaatataatttagcttttaaaacatctttcttatagaatttgttgtaaagaacatattcataagattaacgtgctcacgaaaaataagcaagtagaagtttaccactcatcatatgtttttgtaagtgtttctgttagcacaagctcaagtgctcgcttgcttcagcctttagagacgaatgacaataccagcgactagtctactcctcgaaaaaaaaactgcaaattgcttacgatatttcgtatataagatgtattttttaaaaaagcacgtgccatccctttgctgctcatctgaatttggacttaatctcacctgttgagaaacttgagatcatgtggccctgtggcctttgtttacttcgttgacgtactgcagtttattcatccaaaccatagcccgtacctcattggatggtctgtttgtactttaagacgaatacatatacgcagcttaagttgagattaggacaccggacacacctaaacaagacatgtgatttggaaagaaaattgagtacgaaaggagctactccctccgtcccataatataatataagggattttgagtttttacttgcactgtttgaccactcattttattaaaaaaatttaaaattattatttaatttttttacttactttattatccaaaatactttaagcacaacttttcgttttttatatttaatttttttaataaaacgaggtaaaaacttaaaatccttttattatgggatattatgggatggagggagtagcttattagctgccactttgtctaatcatgcaatcatgcttatgtctatcatcagattgtatatatggtatgtactcattcctagctaccgcacgcacgctacgcacgctaacacgtgaaacactagttaatccactgtccacactaaattatgtccctggaaaagatatatagacagctcggccgggcaggatagaaaatttcactatgatgcgcatggattaagtaccatttaatagtacgtagctttagaagatgagcatcaagtagtaataaaaagcggtagccttttgtccctttcttatttggtgcgaaaagatcaggttcttcgaagactagaagtatcataaatcttttttaagacgagacgcattttcacatacaacattacacatgtacaccttattcacacatttataagcaattcttttcgcacactcaaaagacggaaaattgaggtaactctttagtctcactaaattaaatttatattggaagcttatttgcttatgtaatatttatgatcggcatcaggatttaaaccttagtgatggagtcattccctcattatgatccggtactaaatatggcatgttttactattttcagattaaagtattttataatggtctttgctggtaaaaaaataaatctaaaccaatcatcctctcttacttactgaattatattttttttgagaattgtacaattgaggctcttgtaaccctgttaaatcctgaaaaataaatcctaaaaaaatcgcttccattaggagttggacctaggacctcaggtgctactgagactcttgtaaccactaggttacaggccctttcacttttatttactgaattatgtcttataccaccacttaactaccggttgtagattttttttattaatgacagaagttaaaaataaatagttgtggtcaataaaatagggagcatataatgtacacacaattttttttgtacacaccgtgcacacgaactaacaaattttactaaaaattttagaaaaaaat

SEQ ID NO: 1488 - DNA, 1513 bp, Oryza sativa
tttccatttatttagctcatctgtggtttgtttatacatgtacccttttcatccaatgaccattgtttatccaaatccttcatccgatggctaatatatttataatgatgtggcacgttctcgtgtaagaaagcctgctgctttcattatataagataagataagattacacttacgtgttaaatattaacctcgaattaattatattttggccataacaaaaatattctttttacaatttaagagtataaatctatcagaatttttttctccccatatataagtaatgaatttgaattgtgactttagacatagatataacactactaagggtagatgtacattttttagagtttttttttcatattttttagttggtgtatatggtgtgcacacaagaaaatttgtatgtataggatacgttttccaataaaaaatgctcgatttattgaccaaagttataatatgaatagtcatcggtgatatagatgtattatttatttattttttttcaattttgtatggaataagctgagcgcgatttctctaggtgtgtgatcgacagcgaaaccttgaaactgtcgatgattcctctttgttccaccgtgcaacacaccaccggaccgcagcagattgcaagttgcaactgcagcatccttaatcaactcaataaaaaaaaagcgtgcgcatgttatcctagcgtactaaagtactaaccttaaacaaggctgcgtttgaatgtaccatgacctttgaattatctctcatttttcgttagcatgttaaatggcacatttcgtgaaatgatctatataaaaattgagatcatctatttttaacattatattaattaatatttaattaattatatgactcattggaacggccccgttaacatccgtgcatgacgtgcatggagtcatgtctgctgctgtgctgcaccctaaaatgcacaggtagaagcacaagaagttacgtacaactgcgggggattggttggcattacatcccagaccgggcaaatcggcaaattgatacagcgttgtgaacgtgggagggcgaacatcaggcagggtaagctcagaactcgggaagtttcagaacgtgaaccacgcgagagggagtgagtgagggacggtcggaccaccagaaaggcagcgctgatgggaagaatctgggactttgtgcaaagttgtgtgaagctaccgcgagaccgcgggacggagctgggacaatcagtacacgatctgcctttccagcggccgggcacttcagatctagtcgctgtgctagtactgcttgtcaccagccggcaaaccaaaactttttgctcactcacagaaatgtggttgattagacccctttgctgttaaagaagatgagagtgcatgttgctttctttggcgtcgacaaaggaacgaagtctcttcttgacatgaagacacccagggcatcttttgaaacacgggattaaaaaaaaagaaagtataaaaagcacaaaatgtaaaacaca

SEQ ID NO: 1489 - DNA, 4986 bp, Oryza sativa
ccttgtatagtatgtgctaatgcatggaaatgcagtagtacaagacttaaacgctggggtttgttgataaaaaaaggtgatataaaaggcttttaaaaagattcaagtattttttaaaaatctataatagttaacattaattaatgatgcgataattgagtgtgttctccggcaaccaaaatgacaactcacctcacaatcttcaggggcttttggctcttttaaggatagcatggcaattgaatgccaatttatcgagaaagagagatgacacaactcaataagatttttttatgtgtccctataattttgttaacacctcaccattcttaaaaatgcttgattatggggagtaattaaattgcatgtgcggtacacagaaatatcatacatgtgcaattagtacataaactaataaaaatatttattctagtgcataaacttgtctagtacatatgaatcaagtcttcaacgatatattataactaattaggatgtctcacacacatataaggccatgagacatgttgtattcgttgcatactccctttatattttacgttttttattcgtataataaacattacttatttcatgtttgatcaagcatatgtatacgtaggtaacatcatatcatgttgacataggagtctacgtaatattccaattagcgttcaacttagtgatattagttatgacttgctttttcccccctttatttgcacataccaaacaagtttatatatatataaaaaataatttacaagttattactattctaaattacacatatctcgcaagttcaccgacactgttcaatacgtggaattgcttaataaaccggtcaaagttcaaaagtatttagagtaaactttaaaattttagcaaaatttatttgaaactgatcgttttttaatcgataactgctcggttaagttatggatgaagccactaggcagcgtttttgatagaaacaaataagctagagggcatgcagagtaaccttttatccttttatggatgaaaccacatccatcagtaacatttcctcttctttcccaactcacctcttttttcacgcacatatttttcaaactactaaacgttgcatttttttacaaaagttttctatataaaatatcttaaaaattatattaatctattttttaaaaaatagctaatacttaattaatcatgtgtaatgagtcaccctattttacgtgctcgtgggatttgttccaacaccacacgccgacagcagccttaagggaggcaggatcatgccactcattccttaccacatttagttatttttccataaagattcgcgattcactcaatgcgtgtaagattccctgacatagatctgtggatctggggcaaattgaggttagcccatatcatcttgtttagaggatctcaagttctcaactgcttcatgactctggaacagagtttatacccaatgcgatcctgttcctcagaatacgaaacagagtggcctatacgcaaaacagagtttgcaccaactgatcttcacgattggcaaaatgggaggaaacgaaccaacgaaccaacccaaatttctgtacacctgcttggatggaaaaataactatcgaggaagaactcggttagttcaagtcacctttcttccgatggtttgacctgggccgtgcctgtgcagtgctggttcatcacggagaggcccttttttcattgggccatgcttgggccacgcacctgacccacgcgtgccggcaaggcacggcgagcaggccgtgccggtccgtcacggcccatctaaaaaacgaacgatatcgctaaacatctgtcgataaatttctctcaatttcaaaagtcttttcagccaactgattttccttaagatcctttttttttgcgaaatattaagatgtgagagagagagaacgcgcgcgcaattagccggaaacccagccggagaaaatacggcgatgtttatagtaaggaaacgaatcaatccacggcacagtccaaacactgaaacacacacacacacacacacaaaaaaaaaaaaaccgaaaggaagcaggcaagcagcaccgcgcgttttggccggcgccggcgtttcgcctcctgatcgactaaagagaggaggagaggtgcagcgccgccaccccctcccgatctccaaatcctcgacgacatcgccgcctccaccacccgatcctccaaaccatcgactatagatgtcacaccggagcgtcccaggcggccgccgccaccttccccgcatctacgggccaagaaacttcaaggacgaatactccagaggcgacacgaaagccgagagtgtgccggttcttgccaagatcgcgaggtgctacgaccactgtcggttgaagtgtctcgaggaggagttcatctccagcggcggcttctgcttcggcctcctctcccacctccaacatcgtcgtcaacagcgtcatcacgtcctcttcccggcgtccggaagtcggcggcggcggcggaggagagcatgccgcggacatgttccagcggtcgctggatgggctcgtcgccttcctgacctgcctcttcccctacctccccgaggtggaggcacttcgctacctcgacgccgccggggcggacgccctcgtcgccgcccgactcatcgtcaaccggcgcggaatggagcagtcgttcgtggtcgactccggcgccaccgtgatcaccgccgagatagccctccggtgcgccgccgtcgccgcccgccacccctgaaagaaaactcaatctagaggtaatgtcgtcgatgcgacggttcgtgttaattcagcactgaatcgtgcgatcatttacagatatatatgcgccatagatgggaggaaccggatctcctatacatgctctaacaaccttatcaggttaacaaactaccggcctcctcatcttgcgcatacagagattacaggagattgcattatctctaacaaccccgaccctcgactgctcgtgttagggtggaagctcgtctcgccggtgacctgaaaatgctcatcacgcccaacaaatctcgagtcaaggcgctactagacaacaccatgatgaaccacgccacagtgaaagatgatgaaattctccatctgaagcaatcctgggagctcgccgaatctcggcttgatcaccacaacacaaaaaccaaactggcaaaatcatgggagcgactcgcaaaatctctgctcctacgtgcaaagcctcaaccagttctccctcatgtccgggcggccaagaagcgaatgctcttcgcaacgatccgcggcttctacctgcaggcgatggcgaggctgccggccgacgagctgcgcgctcggtatcaccgcagcatgctcaaggccggccactgctacggcccgctggaccccgtctccaacatcatcgtcaacaccatctggtacgatcaggcggccttctcgcagagcaagccgtgtacactgcagatgatcagcaccaaatgcctgatgcgaatcgtggcccgatctttctatggcctcctgtccttcctgtgcactcgttacccggactgctcacctgaccaagcgatggggtggctgcagatggccaacgctgacttgcggattgttgatcctgcccttggttatatgtccaataagattacgagaacagacaacatcagcatgagcttctgttgtaacttgccactgcaggttgggattggatgtttgtgtttcagagctgaggcatcaagaagatcggttacccgtctgccggtgtccacgaagcttatgctgctgcggctgctgctgctttccacccagcgccgcttgcgcagcaagagcttctcgcatcacctgacaacctggctaagcttgggtttgtatatctgcatgcgttgcagcacggtgacaggctctgctctgacgatgtcaccttgatttccttgttgtttcgcaagcgtcacttcgagttgcgacatcaacagcagccagagcctaaaaggttatgcaatgatgcctacattgcgctttgtcaccggcgtttcaagttttggctacatcatgacctagtctgcaagaacgtggaagttgcattggccacattcaaccttgacaaggtttggtttcttcaagttgacccccctctatttttgttgtatatgcttagcctcaaatgtccaattaactctcttcgattgtgtctttagttgaaggtgcacaaatataggcttcattttatctgtggtgtcaatgagtgcgtatctggcctggagtacggcccggtcagaagcaatagcccatggaggatttacaaatataatcactctcatatcaactttctggcgatttgcgatgacccccaatctgccaatgatcctgcaacgctcttctttgctgaatgtagcaactatagcgttcatgaggagtcttggtgcatccctgtggtttcgccgcatcgagatactggtatgctctggtcttgaccttacgatcgaaaaacctttcaatatccatctcaatatttcccttccaagtagatttgtctatgctatcgtaatcaatttcatatcagtatatatctctagttgaaaactcaccgacatagcagaggaccaaaggttaagcaaaaatagtgatgtgatgcccagaaaagaaaaaagaatgctgctaaaatctgtccaatagaaagattatattagatctgtctatggtaaatagatgctaacgtgtgatagattacttatgcaggatgcttcatagatgacataggtgatactctctctgtcctgtttcaaaagggcacagtttcttgatctgtccagttttaaagggagtacggatactattcactgtctgattttattatttttgtttctttaattgtagatcaaatttagtcatacatgtttgtgtatagacttatggacaaggattttctacacctagatgtcatggcacccatcatttgcatgtgattcaaatag

SEQ ID NO: 1490 - DNA, 8089 bp, Oryza sativa
tctatacataaacatgcatgactaaatttgatctacaactagagaaacaaaaacaataaaatcagacagtgaatagtacacgtaccacgcagataaaatttgttatttttgtttcttcatatgttgatcaaatttagaccttcatgtttgtatagtgtcttatattatcataatctatcttatcaaattttataaaattttaatataaccttttaaattacatgcatacatgtagaaaatactttccatagacttatatcatcacaatcgatgctactaaactttttcaattttttctataactatttgaatcgtatgcaaatgatgggtgccatggcatctaggcgtacaaaatccttggcatttaggtgttattttcactttaatttgttatttttgttgcaacttatagaagttgaatttggtcttgcatgtttgtggagtgatatatttcgtattaatctatgttgtcaatttttttaattttttaataactatttagatgacatgcaaataacgagggaatgtcccctcaagggatgaaaatccacgtccgatttctgttctcaatatggagtgtgcaaatgtgacagaaggaattctactcgcgttaataatcaattgtcactaccatactattattagtttataacgtgttgtcatttttgtatgtatggcagaattagtccgttgcatttactgtgagagcaaggggactaggattgtgcatcctggtgagaagagcttccatggacgtgacacggaatttgagaaggtgatgcgtggagaacgactctttcctggattacagagaggatcctacagcaacattcggctcgctgaaagaaccgatgcagattgggtggataatctggaggaagattgcatctacatcactgcctgcgcagcggataatgatagaagagtgaacccgctcaattacccgcctatgtatcgagagcgtgtgctaccgtgctgcgaagcagcaagtgatcgttcctagttatcagttttttttttcatatatttttcttcacaacattataaggtggcacactgattcggtatccacacaacgctaatctctctacatgctcccgtgctgaaggatcaattattcgtaatcgtaggtacatattcagattaagatcgggagctcagatttcagatcgagatgctgttggggatgcccttggcggtgatgccggcggcggcgccggtgacgtcggaggtgttggggtaaagcagcatgtatgggaactcggctgggccattgcggttcttgagccccgcgtcgccgttcatgcccaccaccttcccttcgatctccaccagccggtcgctgaaccgccggaacgcctccagcgccctggcgtccgacgtccacgccggcgtgtcgcgctgcccgaggtacacctcgtcggaggagtgcttggacaggacctcgatcagcgagatgccgatgatggtctggagctggctggtgatggtgcggatgaaggcccgctccgggtcgcgccccagctcgccgtacgcctccgtcccgggctccggcatccgccgccggctcaccgtcggccggttcgggaggtaaccggcgtacgggtactggccgaagttgaccgccgcgtgcagcgccgacgcgatccagatgatggtggtgcacgcgtcgcggagctccgacacggcgtccatcctgggccaccacgccgcgcccttgaggtcgccgtgcccgacctcccgcacctccgcccaccacgcctgcagctccgcgtcgcctcggagcacgccgtcgtcggtgtagtagatcgccaggtactcgcccacccactgctcgatcgcgtgccagatctccagcccgtccgccgcgtacgggtagtccttgatcagcagccgcaccttgtacgggctcgtcgcgtcctccaccgccactcccctgcaaaaaaaattcacacgattttgcactaaattgtacattcttcccactgatgccttacaaaaatcaatggagatgtgtaatactactaccttttgatgagatcggcggggaggccctgctcggtgaagttccagttcttgtacaccatggacgacatccagagcgcgtacttgccggggaagacggtcatctcgaagatgccgccggcgttgatgagcgtctgccgcgccagggcgttgatggtcatcgtgtcgcggtagtgcgggctcagcagcttgtgcaccgggtgcgtcacgctgagctgccggttcgtcgcgatcacgaacggctccatcacagcgtgcgtgttcagcctgatcaaccaacaacaacaaccgatgagtacaaatctccgtcgatgaagcgatcgattgctctggttttgaacgtaccagtggctgatcagttggtgccagccggagtcgttgacggcgacgtaggccttggcgagctgccacacccaggcctcgacgccggtggacgccggcgtgtacacggtgctcttggcggcggtgacgtcgccctggatcataggctcgctcagctcgatggcgagcggcgccagcgtgccgtcccctcgcaggaagaagagcgtcctggtcgcgtagatgaagttgccctccaggccgttgacgtcgatcaggaacggcatgaaccggtcgtggtggtccagaatgtacagccggttgctgtccagcgcctgcaaatcgcgacacagtaaatttccacacactattgccatttgccagcaacaattcaggtttgcaagtcacgattgatagcaaaatctgcacgtacgaaaccaacctgctgcacggtgaggccctcgaggttgctcccgatgtgcgccgccgtgatcatgctggtgtggtcgccgaacttgctaggatcgagactacttttcggagggaattcctgcgggatcaacatcgagttaaatttgccacatttcacgttgcagcagccgtgttcactatcaatttggcatgaacgcatcactgatcactcaccgtgagacgcgtgatcatcatcgggttcacgccggcgagcacctcccgcgcgaactcctcgtctgtcctccacgcctccttgtcctctgcatacatagccaaacattacatcgatcgtcagttttcacctaaagattctgatgaaaagtctctacgatgacaggttgcgctcacgtttgataatctgaggcatggggagcttgaggatatagtcgccggcggcagggaggaggtccttgacgagctggagcgggaatcgcttgcggagctcctccagcgcggggacatcggggagcttgaggccaccctcgtacaggtcgaggatgtcctggaacgagtcgaactcgccgggggtggtgtccacgtacgtgcggatcgccggcacgatcccctccgcgatcgccttgatcgagtagcccaggaagtccgccatcttcaggtgcccgaaccgctcgtcccgcggcacgtagatctgctccaccagcgacagcctactctccgagtccggatctgcacgcacgcatacgtgtacaaaaaacatcagtcaaagtcaaagtcaacggtcaaccacacaaaccgggcccaccgtcagtgagacattgcagctgaacatggaccagttctggtgtttcactatgacaggtgggcctaactgggaggtatgtgagtgaaggtgccacattctagtgtaaaaatgtataaaaaactttttagaccttaaaatgtttttttaagaatcgtaaaatttttggttgggggatgcgtaccggtggtggtgggtttgcggccggtgcggccgcggcgagggtagggggtgtcgggggagccgccgaggatggggcgagggttgccggagtcgggggagccgaggtcgttgtagacatcgtagcggtagacgcggtcgtgctcctcgtaggggccctgctggtcgtcgccgcgcaggttgcggagctcgtcgtcgcggtacggcttcagcgccgccggcatctggctcggcaggtaggcctgcgcgtcgccgcagaaaatatatcacaaagttaattatagcacgtactcgtattaatacgcatcgctaattactcctacttaattggttagttgattgcccaaatcagtcccttgatacggcaccggccttggacacctggctgcacgctgaacaagaggcaggcaactatctgttcactttaaaacttttaccgtgtcatgtgttcgcaaagtaaaatcgagtgctgtgtcgttgatcttgttgaaaaagcttctcggggccatgaaacaatgccgtctaaatgggtgtgaactgtgaactgtggcaactatgatgagttgatgactcacgtgaactcacatgccttcctgagtccaaggactattccagatttctagtactatagccacttttatgttgttatcatcaggaagcatatccattgtagagctgcttcttttttttgaacagtgctactaaatccacttcacctaccacataaacaacttacataaagtccattcacttctcacctaaccaaatatcttccctatggacgcctaccaaacgacgtgaatcaagcaacttactacataaagcatctacgaactggccaaacaaagaagaacggcaaatggttactgtaatagtgtaatttacatgcagggtagcataatacagtatgcagcagagaagaactcacatcgttggcgaagaagacgcggtcgtaacggtacttgtcggcggggtagacccaggagttggcgaggaagacgacggcgccggcgcggccggggacgtcgtcgagggtgatggtcttgaggaagaactcgttgctgtggtggttcttgacgatgatggcccccggcacgccgagcttgtcgacgtcccagtcgaacgtcacgccgaaccgcgactcccccgtcgtcagcgacggcaggctgctcgtcagccactgctccaggctcgcctccgcccccaccttcccccggttgccgttgtctgcacgccgatgagaggatcatgcccaatccgttcccgttaattagtccaaaccaacgactaatcatgccccagctgttaattatactacgtgtcaccacctcgcgacaccagctatagtttcaggcatctagttcaaagtgaggtactacttcttctttttttttttactttttagcttttgtactttgggttagcatctggtactcctgccctggttgtctttttcctcgacgttggtctcttctttccatgtcccatcaaaagaggaccgagctagttaggcaatggccgcccatacagtgtttaagtttgtatggacaaaaatgaacaagagaggtaaatcgaccaagagaagagatgcaagggggtgacagggggggggggggggggtgtgctcacttgggtcgacggcggtggagctgatgagctggcaggtgacgcccttgccgaggaactcgccgaggccgtcgatgacggtggcgccgaagtcgttgaggtcgaggacgttcttgcgcatgagcaccaccgtgcccttgagccgcgactgcttcgacgaccccgtgatggtgtcgatgatccctcccagcatcttcgcctcttctggatgtctcgagctctcgacctgggtttgccgtggactgatgaactgatcactttaatcagtacgtttcgctctgaatcgagttgcagtgagcgtgagctcgctgggtatttatagccacaagagggtgtaactgggaacagtacaatagggccgtgactgaagattgactggtgagtgctagtgggggatactctgcttaaaatttattatctcaaatcatttggcacaatttaatattcttgagagcgagagttcggtttatcatcttactgaaattctttagattaaactttttgataggtaagtgaattaagcactcgtttcaaaattattatgggtgcgtttagttcacgctaaaattagaagtttggttgaaattgaaaccatgtgacgaaaaagttaaaagtttgtgtgtgtaggaaagttttgatgtgatcgaaaagttgaaagtttgaagaaaaaatttaaaactaaactcggcctatgtcgaaattattgacatagttttggtaataccaaacattatcgtcacatctctacgactctatcagcccaaaatttaaacaacatcagagatttcggtacccaaatcttagtaattatactttattttttaaatataacattattaacttttaaacatgatatttcatcatttgctttgttttataaaaaaaagttatataagcattatttatgttgtttctactttttataaatacatatatgtatttttattttgtttttacatactttatcattaaagatatttcaagtatgacttatatgttcatatatttatatcaaatttttaaacaagatggaaaaataaatgtcttgtctagaaatgaatgacataatttctgctactatagaaatgaattggagttgtcatacttccctcttgtcctcctagcgagtctgtgccctccatccaagtgagtaatactccatccgtcctataatataagggattttgggtgaatgtgacatatgctagtatgctgaatctggatattgtgggacagagagagtacgttattgtattcttaatcacctcctagtctatcgtttgttgtatcgttttgactttttttctaattaaacttcttttagtttgatcaagtttataaaaaaaattacaatattttgacacaaaacaaatatattatcaaaatatattaatttctatatgttattaaatatttctatattaaatttaaagaattttaattataaaaaaggtaaaaataatttataatataaaacggaagaaggctaattacgaccggtcacgtacgggtgcattaaaaaggaaaacagaaggaatacgttatcaaaccaaaccaccccccacactggtgctactggccttaattaggactagggccatggcatcggccacgtttgcgatagcttaaaatcgatttgaatatttgggaagacgcgagcggcgtgggaaacgtccgcgtgcaccgtgcagctcgtctcattcgtctcggtttcccctgctcctccaaatcgcgacgtcgacgtgcaccgatgcacggtgtgccggggcggctcgtgttgtgcgtgattttatttcataataatgctgactccaaactcctaactgctcaagtccagctatatctgatttgcattgttgacataacaacttttcgttagaggggaatacatttatgtgcatataagtttttcctgtttacatcgcgtacaccaagaaataaattatactaaaaatgttagaaaaacccatacatataattttaaggaatttgctatattcttttagtacttagtacttgccagactcattatattttagttgtaataaaaaaaaaaaaagtttcgacagatttgaaagtaaaaaatatgttagaatttcatccctccctatttataataaatttgtaggtatgactttatacatatttgtaaaactactgaaagattatatacattgttttagaattttttaatcatattttttaattgatgtatatgatacttataaaaaataattatgtgtataggatatatctctgattagagatactagcaaacaaattagcggaggtgaaatttcagtatcaattttagaccgatataggtatcgtcttcatcatcgatctttgtcatcgtgaattatccgaagccatcgtttctcttattcgcgatataacagagagcctcgtaattaattcttcctcaccaccaggatctgtttgatgttagaaaagggtaacgatcgagctcttgattctgaattgaaccacgtgtactcccaaaagctaggggagaataaaaaggaaaaacagaacaatatctgcagtacgactctgaatttcgtgtcagcaaacaagagagagagggggaactgtggccatgcgattcacacgtccatttgtgatttgtgtgcctcgacttccgatctctcacgtcagtccgtgatttgtaagaccaggtacaatagcagataatagtaaactattagccaa

SEQ ID NO: 1491 - DNA, 9342 bp, Oryza sativa
aagaccaagaccacctgcatccaggttttttacttcatctaatctttctcaatgcataaaatgggttctttctcagtgcatgttgattgcattagtaaatctggctataaaaacttatggtgttgtatgacatgcaacagcagattataccccctcatcagcacacatgctctctctctctctctctctctctctctctcacacacacacacacacacacacgatctgaaaagaacaaaaggttgctactgtgacagttttgcagagtttagttcttctagttccattatcatgtatcagaagacactttagaaactagataacaggtgtagtaatcatagagagtaaaactcaagacatgtcactatggtttcaaacagattaaagcattggcaaacaaatagattagatttcagagcctagtatgaaattttagttcacatctgaccatttcttttcagaatcctagagcatctggactttacagaagatagagaaaacaaatgaactgtaaatagcacattgttacctaacatcgaattagggaggaagtaactttggtcatggccagagcatgttggaagaattaacaggcacaacctattggtgagcagaacgatgtcaagatttactaactaattttgttaattgctagtacaaagaaccaatttattgccaagaacccacacgtcttgccaaatttaagtatttaatattcatcaacaaatcacgtgtttatgatgcgaaatattgaatcatgcttagatggtcacatacttgtgaaatttgaattgtgaaacatccttaactccagctcccagtcccagacacaatattcctgttgacctgctactgaaaataagcaagaactgaattaagtacctgaaaaaaattacttgtacaacactagaacttaaatagagctagaggtagaattaaatacataactgaattagcatgacaacaaatcaatgctaccttacgaacagatgtatgaataagtcatggatcttgatatggaaatatggaagagttagtactattgtaaactacagttatgagtcatgacattgcaaatcctaaacatattcaatattctttgtgcggcactgaccagcaagtagttttttttagacaattatcagcaagacatggagcatgacctggatatgcatgcaaatggaaatgaggaacaagaaattcaactgggtaaaagttcattactctttgatcagttacaaacatgtttacattcttgattttaggactgaataaatctacacaatctgattaacacacattaacttaccatgtaaatttttttgtagacaatgacaatgaattgcaacatgagctggaagccttggaggatgatcttcgggactatggcgtgtatacagatactgtcaatgttgtctttgatagagaggagttgtcagactcagaagaagaagaagatgcagatgcaaattcaaatccagatgcaaatggaaatgaggaaaacagttctagagaattgacaaacacacaaaggcaaagaatttatgaattgttgcttgcaaaaagtaaggatggaaaactagaaaaagacaccacccgtgcagttgctcaagtgttcaatgtcagcatccgtacagtccagcgtatttggaagagagcaaagctttgcatcgcacatggagtacaagttaatgttgactcgaggaagtgttacaattgtggccgcaaaaaggttgtaatagacttgtcggttgtatcagctattccattgcgccaaagaagcactatacggtcacttgctgaagccctaggtgtgtcaaaaagcacattgcataggttgttcaaagaagggcatctacgacgtcactctaactcactaaagccttatttgaaggaggcaaacaaaaaagaaaggctgcagtggtgtgttggtatgctagatcatcgtacgttaccaaacgaccccaagtttattgaaatggaaaacattgtccacatagatgaaaaatggttcaatgccaccaaaaaggacagaactttctacctgcatccccttgaggaggaaccctatagacctgtccaaaataagaatgcaattgagaaagtaatgtttctatcaacagttgcgaggcctaggtatgatgctgaaggcaattgtacttttgatggtaagataggcatttggccttttgttagaaaggtaacacaaccttcttatacaagtgttatttacttctgttttttatgtttaaacctagcctatttgatgtactaacaggaacccgcacaaaggagaagccgtaatagagagagggggacacttgtaacaaagacaattaaggttgatagagacactatgagatcatttataatctctaaagttctcccagctattagagcatgttggcctctagaagatgcaagaagaacaatatttattcaacaagacaatgctagaactcatgtaccaattgacgatgagcagttcagtgttgcagtagctcaaatggggcttgatattcgcctcgtgaatcaaccttccaattcccccgatatgaattggctagatcttggcttctttgcatcacttcagtccttaactgctaatagggtgtctaaaaacctggaagaacttattaaaaatggtccaaaaggattttatgactaccatcccaagacctttaataaaagggtcctgacccttccaaactggtgcctttgaataattgaaccctatggaagggattagttccagattccttcccatgaacaaagcgaggctagaggcacttggcattcttcctaaagcccttcgctgtgatcgtcagttgtatgagaaagtcatacaacttctaggcaactaattgtgcacttgtgtcataatatgtacttttgtcatctatgtacatgtgtcgtctatgtaattgtggaaactaaatatataatatgtttgcttgtttgaatgttttatcctaggttctattaacaagttgattgtccatatgcacaataaaaaaacaagcactagtatttcatagagatgcatgacatttcaataagatgttgaataaccatatattccaaaagatgtcaccaaacagaaccacataatatataacatgataggatgccactatgcagctgactaattatgagttcgtattttggactaacaacaagaagtacgtagacggcacatgtcacgcccagaaattctcgaaccagaatttctaagctgaatgtgcattgaatccctgtccaggaccagccagggtacacaaacgacaattgttgacatacggatccacgtcttacaaaaatagaaaagattacaaatgccgcggaaaaaataaaagcgagctaaaccgggaagcttgacttcagcagcgggcgacggcactccacaggcaatccttgacggcagcgacgaaaccaaatttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaacaccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatgtcatatggtaaacaataaatggctgagtaataggacccattccacatgatattgtaaaagaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccactggtcagcggcacgggggaaaggaggggcggcggcgccacgtggcggccgaaccgacggccccgatctacccaagggtagatcggacggcggcgggacctcgcggccggggcgcgcgggcgcggcgcgagacggcggcgaccatggcgccggcggcgcggcgcccacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaaggggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggtcggagtagcaaaagcggcggcggcgggtggttgcacggcgcggaggcgatggggagctcgggagagatcggcgaaatgggaaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgattttcaattggttaaaattatttccaaggctctgaaaattccactaaaaatcctgttaataatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttccccgatcagacacgatcttcttaggtacaccatgtaaacacataattcttgccagatagagttctgctaatttcttccctgagtaggtggtgtgcaccggaatgaagtgggccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggttgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccacttggtaactgactccacatttgctggatccacagctactccttgagcattcacgatgtgaccgagaaactgaacttccttaagccagaagtcgcacttgctgaacttggcatatagctggtgctcttttaacttttcaagtaccagtcgaagatgctgctcatgttcttcctcggacttggagtagattagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactgga

SEQ ID NO: 1492 - DNA, 1243 bp, Oryza sativa
catctaggtacttggatgcgagaagaatgaggttggctggaaaaatcaacccttgaatttcactgggacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaagggctgcacccctagggctgctgctgttgtagcccttagggcctccaacatcgcggcccctacagtttccgcctccatcatcacctccacaacccgatctctcgccaaagccagcgccgtagccatccctacggcctccaccgccatagcccctaggttcgccgccactgcaacccctagggtttccgccattgctgctgatggcgctctcagtgttgccgcggccgttgagcatgttgtcgcacaccggatatggcttgctcgtctgggggtgggggaggggggatggatggggattggtgcggtgtgctgatgggagggagaagcggggtgctggtgtggaagacgcggcgtggaaggagaagaaaacgagagacgagcgatggggaagaagagaatacgagaggagaggataaggtagcgcttcagagcaaaaatcgtttggagaagaaagagttcgctagtactgttttagatggccccacttcttttttttatttacccttttttttatgtgtgcttgtctaggagtttgtagtgcctgccaggctgccaggctgccagcgtcaagaattatgggacaaatggttaggagcagaacgtcctcctttctgggacggagggagtagacattatagtccatatgtaccatgaagaaattttatgttt

SEQ ID NO: 1493 - DNA, 24395 bp, Oryza sativa
gattccccctttttaatccccggtgggggtacttacccgaacttaggaatcctagggccttaccccggcctgacatggaatcaaccgggactaaaaatgaactttagtcccggtgggagttaccaaccgggactaaagatcttcctcttattaaccgggactaaaaatcatttttagtcccggtttttaatggaaccgggactattgtggatttgggtcgaccgaccaaagatggtttctctaccagtgggacgcaggcgatgatggcggccatggcagctgtggcagacgaggcggacgcacgcgacggcgagtcggcaactgctgtggtggatgacggcgaacgcatgcgacagcgacgaatgcagtggaccatagtggcggccatggcggatgatgatggataggcgacagccacgacgatggctgcggaggacggggcgatggtcacagcggacgccgccgccgccgacggtcgcagcgaatgaggcggacgccggtgatgacgccaaccttggcggaggaggcggacgcacacaacggttacaacggcagtggacgacgacgatgggcacggtggcgattgcgacgaacttagacacggatgatcggtacaaggggccccagaaccttgggcggagcgtgcagctgggcgacaaattagtcgcccgctcgcgctcgcgcttgacccctctctcctccacgtaatcgcaaaatccgagctggcgttcttatcgtcgattattgtacccgctctaacaggtgggaccatatattaatattatagtaagcaactattgtataaattgactattagattagctataaataaattggagctagtagtggactatactattaaacttcagttctgatctcttgctgcatacttgatcatgtggttaattagcgttgccgagatgcgtagcccggttggcctaataaacgtaaaagcctatatttaaattttcaaaattttcaaaattgaaattgcagatggttttaagatattttcaatatactttttttctagtattgacttataagtcgatacgaacaaatatataaaaagttgtacctataaattaactctttattttctgtttaagcttattaggaaatatggacaaccaatgaggctccaaatgatgttcggaagggtaactttaccatccttaaaaaagtatatcgggagataccatactttctagtgtaaaaatttagtatctccggatacttagtacttcgatgtaccaaaaactaaaaactttagtgtaaaatttatatacctcgaggtactttttaaagtaacataaaatttctcttttcggaagctttcccggccgttacccgacggggttagtatgatttcaaaattcaaatcaaaccatggctaatgacggtatataacatttaagttcttgtagagtataatgacggtcaataacatttaaccatagctaaagtttttctctgctactagttataggtccacgcgttcaacattttctttattcactttagtggaggatttggatcaaatggattgttggtttttaaaatgattggttttcttgagaagtcaaagtcagttttatttttttttagagtggacggtttttatggaagaataatctggtgcgcatagtacatacttcctccgtcccataaaaaatcagcatagtaatgtaccacatcctagcactacaaatttagatatacgtatgttcaaattcgatgtattagaacgtatcacatccatttttttttacgaagcgagtactccatatatcaacatatgctaaatatgcgcatggaggagtcggattatagcaggtacaatagcaggctataaaccaactgcaaacatattttaaggagataaataagaagagagaagagcagtggactataaatttgtagtcagctgtagcacgaactttaagacgtagtgtgtgtaacaggtaggagcaggtattaatagtgtagtatgtaactattgtatggatgagctattagaatggctataaatgaattggagctagtagttagctatactgttaaacttgctcttagctccgatttttgcgacccttgtcacaatcacagttgatcgagtaccaaactttccattcgtggattccgttggtggcgttttttccgagggtagttggattcatccacaggatgatgcagacgtgtcagctgctactatcgtattggcaggcagtacaatcaacacttatccagacattgtagcacacaagtactcctgctcctaccacaacaaaaaaaaaattaaacaaatatttatccagattcatcctcagaagttaattttttatgggacggtatgtatattttacaccttcaataaaaatcattttttatttataaacctttatcttataaacatgaaaaataccatatcaaaatcatagctagaattgattttataagatcataactatcacaggttggaatgacaagcacatcaatgtagaatcaaatgctggctctagacacgtactcccactgtcaaaaaaaaaaaccaaatcccagtgttgtggaagacggaatacggatgtcggacggggagagtaccgccaaacgattaatcggaatacggatgattagtcggaatatgacggaaatttaacgttttgcaaatataagtacatagttaataatagtttgtccttttagaggtaattaaatccatatgaacacattctagtttcctagtatatatatttaaatagaacaaccataacatgacattaacttaacatacacgtactaaagttaataatgcaaaaaatatcataatgcatatttatgcattaactagtggtaggttcagtttataatgcctgccattgctgctataacaaattatatataataataccatgataatttgcattacacgttattgaaatcttatactagtattagtgcatttgaaaaatatttggtcttcaaagagattaatatagtagtacatgcatgctgtacaggagtacgagagaagacaactaacaggataggctattgtgcgtgggctgggcccagtgaatttgatcatgcccgattatatactgccaatacggccgattagtcggaaaaacgctggattaatcggtaataacaggaattacgcgtttttggacgactaatgaggaccgttttgccaaaatgtgacggactgcttaccgtcaccgttttaacgggcgtcatagcggccgtatcaaccgtcttccacgacactgcccaatcctgagtttaaaactggacaccgttttttttcgagacggagggagtatgccttaggctgtattcttaactcaaagttcccaaccttcgtctctcatttctcacatgcaaatttcccgaattattaaccgatatattcttttaaaaaaatgtataaaaagttgctataaaaagccatattaaattatttttaaaatttctttagctaatacttcatttatcatattttaactatcgttccattaggttaggcgctcctaaccccttcggaatttctttagctaatacttcttccgtttcacaatgtaagactttctagtattgctcatattcatatatatgctaatgaatttagttacatatgaaacggatgaagtacttcatttatcatattttaattatcgttccattaggttaggcgctcctaagggcaagtactataagcctctacatgttgcccctaaatttgccacataaaattaggtgatgagttggaggagagaagttaggagagagagaatgagccacctctcatgaaaggggcaacctccacataatctctaagaaaaatataagatgatgtgagagtaaactaatattggggtttgtgtactagaggtggcatgttgtacttgttacctcttaattaatgagaatatgacatgatttaaattagatctggtactcacctccattataaaacttaccctaaccccttcggaagaacgcgacctttaataagctcaaggaaacaaacccaggcaattcggccgttcagttcttaaaggcccatccactatacgtgccaggctatgtaagccgtaatccgggctttcgacgcgttgaagtcactagttagcccataagtatacgggccttgggtcaccctaaccttggcaacccagccggacgaggatacagacccagcgtacgtaagacgtacctaaacaattcttacaaacttgtatgaaccgtttgatttagttaactaaaatttttaaaaaaacaagatttaatcacatcatgatacgtcaggatttgtaaaatgtttgtacaagaaagtttgcatatatcttttccctgccgtggaaattactactccatgaaaagagctaggctaggaccaaactatttttttttctgctttctacttaaaagctcagctggtttctatagactagctatactgtgggtgacatgtcttcactgtcatgcatatctatatccaaaagtcagaatgaaacttatatatagacgtaatttaagacggtaaaatcccgcttatatatagaccagcttaaagaaataatagcggatgctctgaccgtctatatgtgataaaataagcagacaaacaaaggccatctagaagagagacatactttttcgaactgaaaaacccttttcaaaagatcatggaagtaaaccggcaatgcagacaaaataaggcgtgtttacgagcgtagaggaattaggcctcgttctttttctaattaagatgagattctatctcaatttgtgttagcacgcctttaaaatggttgaacggtacaacgttactttaaaatatcaaataaatctatttattaataagttgtaataattaaaatttagttaatcacgcgcgctgatgacttttttgcatgtcccttatttaatcttaattttaatcttactctaaacacaagtgatacttgttctttgcgtctcagcttattacaagagttacatatgaaaagataaaactgctttcgtaacatgaaaataatctaggactattatagcatattctcgtaccctgcggctccgactagctggccagcggcctagcgttgtactctatccatcagctgtactaaaaaaaaactatttttacgtgcgattaaaattaatttttcacatatagctgccagtaacgtaaacaatcatcgttccaccgtcatcgaatataactcagataacacaaaatcaacaaaaataccttgggaagcggatcacggtttcagaagtcaacgttcaaatatcatatccacgccatgttagtttgcgtgcatatgtaatctagtgaccaaaatctgcattctactattgcgttcaccgcctataaataccgttgcctagcgctgtcacaaatccaacacaaattccatctcagcattttctccagtttttctcctactcttaactcgcttgatcagcgtcaaatctaacagacagatccatcgatggctgcttccgaattccgatccggccgtcgtgccgtcgcgctcgtcgtcgtgatctgcgccgtcctgctgctgtcctccgccgtggagcgggcggcggcgcaggtgccctgcagcaagtgcgaccacgcgtgcaagaagtcgtgcaagggctacggccgcgactcgtcgtgcagcctcccctgcggcgacccatccaacaaggccggctgcgagagctgcctggacgcctactacctgaagtgcctcaactactgtggccagtcctgccgtgtgacctgcaccagcggctgaaaaaaaccgttcacgcttcaattcgtctctgagctcacggcgccggccgccgtcgtgaagccttttgatgtgtcacgtaaatgtatgtactgtctcgatcatatgtagttctgttactttctccgtttcatgcatattgcaagttatttttgttttgtcctatttcagagtactccttcgtcccaaaaaaactcaattaaggaggggtcacatcccgacccctcctaggatgataggatgatgaatctggataaagggtagtctagattcatagtcctaggaggagatattgagttttttttttagaacggatggagtagtttgtcactactagtactctagtagttcaaataagctagcgtgtggtgatgcacgcagcaacgcgctggctcggctcgagcttaactacagagcttgatttttaagtaaaacaatatatatttcaaagataatcttttaaaaataattaatttctagttcatcatattaatagaagaggaaaaaaagaataaaataaatatatgatgtcaatataagacatacaaataatatatttgatctcctaatttattaaataacaacaaaaaatcatatattattaggctcgttggaagctcgagctcggctcgataaagctcgcgagcttagggagaggctcgggctcggctcgtttggagctcgagccgagcttgaatcgagtctagaacgagccaagctcgagcagctccagttttcgagttttttgacagccctacggccgggtcggctgcaagatgtgttgggggcggtaagcgatgtatcaatggcttaatgctttgtttcgttaattgaaactcttatcgacgtcttcgattttctcactgctgcgtaagcgaaactggctacattctttggtgagctcgattctccgattatccttgtaaaatttaattaatcacacttcgagcgctatttatatgggggaagttttaccgtgcttagtgctgaccgtttatcacatccgatcaatccaatattggctaatatttacctttgcctttttaaagtgggtcaattggatctatattattacaaatatgtcattctagagaaatatcattactattcgtctattcgtatccatatcattcgaacacgaacaaaattaaaaccatgctatcgccatcacattttctatcacatatccttttctttccttctcattttcttttcttctcctccccgccagcaagattcgagaggctgattcaagcgtccatgggatggggtcaacgacaacgacggctcttcctccttctttcccctccaccacaaccaccgctgctccaagtatagatgcgctgccggctagggggagggaccaccaaccatgggcgctagcgtcgactcggactctaggaggggcactatggccttgctatcgaggacgaacttagccttggaagagacgttggcagtgttgaatgcttggggaagataccgaggtcgatggaggttaagcatgagctacccatgaaggaagacgggtacggtgctagaagcggctcagatcctcaccggcgagctccgcctcccctctcgtccatgaccctccgcttctcaccggcgagctccttcgaggcgcggggtaggagtagcaagcgggaatggcttctccaagtctccgagaggcgaggggtgggcttagggttgggggaggccggagccggtgaagtccgcccaggcatttcatgtggatttggctgccggcgacccaggattggtggaagggtggatagtgggggagagagagtaaggaggatctggcgatgttgtggatcgacggtggagggtgatagcaacgacgatggagttgcagcgcaatggccctgatgcggtgacaatgatggtgcggaggattcaacggtgagggaggcgataggggaggcaacagccaaggctgcctttgcccggtcgctcctccctgtgtccccacactttttttatcagaatgtccccacacttcattgtgggggcggcattggcatcgacatcgctgttgtggttggctagctgagaggggaagggaaagagaggaggagaagaataaattgggggaagaagatgaaaaatatgatagcgatgacatgccaacgtctctctgtgatgtgtgtaggcccatgcacatgtatgcgtctatgggtacatgctgccatctaagcaaccaaccaactatgtgatatggcgctatcagctgccgcaacggtcgtgtcttcatctctaaggaggtgctcgatcacaacaacaatcctagctagcctggccatcaaagcactagtacaataacgattttttcatgcggtcgaaattggtttttgcgtgcggatgtttcacccgtctagtacgaggtgtctgcgaaaatcatccgctccgttcccaccaccatggctgatgccgccaccgcactcgcctccgccgccgcttccgccactctaacccgatgtctccgtctccgccgccctagccgagaccgccgctgccgccgtcgccgggagataagaggagtgggaggaggaggcggatagggagagggaggagtgggtgtgggggcgaagagggagatgggaggagagagtgggtgtggggtgatctgagagggtgatgggatctgagagtcggtgtggggcggcgacgacacgcgcgattaaaaggtgggtggctattttcgtgtacgggccacttagcatctattttcgcgtgcggacctattaagtggcctgcttgttaaaattaatttttttcgtgcagtcgtcttaaagagccgcgcgtgaaaatggaacatgatttttttgcagacgcgactatttacgtttcgtatgcaatctaaaaatgacttatgtccagaaaaatcatatcatttatgtagtagcgacctcggcaagctttcgagagctcggagcgcatgatgagctttgagcgcaagggcagtgcctcaccgctgatgacatgggtcacactctctggcgctcacacctcggccactcccactgcacgaaatgtgactatcaacaaagctcttccctgctgtcgaagttactactgcatgaaaaaaagctagtctaggactgaagtaatagtttttttttttcgtgctgcttaaaaactctggtttctatagaatacacattgggtggcgtgtcttcactgtcatgcatatctatatccaaaagtcagaatctaacttcttggtcatgcatggctcatctaagacgtaatttaggacggtcaaataccactaatatatgtagaacagcttaagatcaaagaattaaagcgggtgctctgaccatatagatatatgcgataaacggacagacaaagaagtgatcaagacatagttctacacattgaaaaaccgcggccctttgaaaaaaccacggaagaaaaccaataatagccacgaacatagttcaataagagggacataagttacgcttaaaagtggttgatttggtgctagccttctctttggatgtgtgtagacgctgtcggtgcgtggtggttaaattttttctttcctggcgaatgtctcctaaggcaatagttttgtaatttctttctgctctattcaatgaatgatcgtgttgtctgtaactgatcgttttaaaaaaataatagcgaccaaatgaggaatgtttacaaacgtaggggattactcaatctttgtgccttgcttacaatatttttttaaaattacactttacaacataaacactcacaatgcacgcatactcaccctatgaatgcacgtacgtaaaccctacccttatgagcatcttcgataactgagccggcaaatcttggagattgacgaagtcaccacaggcgcctcgctatcgacgggtacatcgtctaccactgaaaacataataattacatataagataaagagtgaatttcacaaaaccacagttattggagtatccgttacataaaaccctggttactgtgatttgtttcacgaagccccatgttttgagccaaatgttttaagaaacctcatattcatgtaaaatactcatattttattattacataagattgttttctacatcaattcacattagttggctaaaaggacatattcttctcgtctacttcattttttttctcaattttgtgctgaaaaagattaacataatacatgttaattataatataataataggttaaatatacacataaatgatcaacgcttgttaaaaagcaactaatgttatatatgtactaaaaagtatctcatacattctctaagataaaagtgcttacagataaatatataagacaaataaacaaattgcaaaactgggcgttttgtgttacagaatccccaaaacacgggttttctttttgaaattttctctaagataaaagtgcttatagaatcatagcaggaagataatccgggagtattatagcatctgtacttctcacctcctaattaaccctgcaccaccgtaattaaacaataatcgctccactgttatcaaatagaattcatataacacaaaatcatcaacaaatatacattgggaagtggagcacggtttaagaagtccacgttcaaatatcatcatatccgtggcacgccatgtttgctttgcatctgcaatccagtgacaaaaacctgcaagttgaagtatcgcgtttactgcctataaatagcgctggtaatctgccacaaatccaacacatacgcatatctgcatcccctgttcttctctcctgtgacttgcttgatccacatcaaatccaacgacaacaccaacagaccaaataatggctgctgcttccggccgccgccgtgccgcggccttcgccgtcgtgatctgcgccgccctgctgctgctgtcctccgccgtggagcgggcggcggcgcaggtgccctgcagccagtgcgaccaggcgtgcaaggaatcgtgcaagggctacgggcgcgactcgtcgtcgtgcagcgccccctgcggcgacccctccaacaaggacggatgcgagagctgcctggaggcgtactactccaaatgcgtcaactactgtggcccgtcctgccatgtcacctgcaccagcggctgaaaagcccagccggccgtcgtcttgggccttgtttggatactccgtaataataattagccctcccaaattttactatttaagagtattaaatataaattactgataaaactcatttcataatctctggactaattttatattcgtcttgcaaattagcttggtggttataaaataagttttatcagtaatttatatttaatacttctaaatagcaagattttagagggctaattattagcccggaggatcctaaggccttgatgtgtgtcatgaggatgcaccgtgcatgtacacgtactgttagtattgtatactagcaatagttagtactgctatttcgaataagctagctggcgtggatgtacagtatatggctatatgccgaccggctctgtatttcatatatggtggtcaatgcttcctttcgttgttaccaaggtcttttaagacagtggtatggtcacgaagagaggtactctgtctggttttattttaattaacgtttcggataatggcactgtttacaaaatattaccttaattttctattataatatacataataaataaatgcatgtttatttttattatagtgttttgaaacacaaatctatatatctatatatgttattctagtttctttaaactttattaatggtcaaagttataaaagtttgactttaaccttgtccaaaacgttaattattatataaccggagggagtactcctaaaacctatcaacaaatatttaaaactgttttaagacaaatctaaccctatgatttttcaacgataaatttatatctcgagaattttacggattaatctgtttgataggtggactactgtattactccctccgtttcaaaatgtttgacaccattaactttttagcacatgtttgaccattcgtcttattaaaaaaatttgtggaatatgtaaaactatatatgtacataaaagtatatttaacaataaatcaaatgatataaaaagaataaataattacttaaattttttgaataagacgaatggtcaaacacgtactaaaaagtcaacggtgtcaaacattttgaaacagagggagtatcatactagtaccaaggaacctttggttttagttaaactttgtcactccctccataaaaaatataaaacttattttgtttcgttaggatatgaacctttgacaaatgcatatgattttgtgatatttatgttgttagattcgtatttaaagtacgaagaaggtgttcaaggccaagtttggttctatttgacacagttatagctcccaacttcaacttaattagaatcggagttgtgccaaacaattcagatcctctgtttttgggagtgtagttagcagagttattcctaaaaaatatactagggggtagagctgggttgttgctgctccacaactccactccaccacaaaggacccactaccctttaattttaagagaatccactcagtgccactgagtttatcgcacttctataatgtaccactgactttatcaagttcaattatataccatcgagttttctttaacatctactgtgtgccatcacagtccagttaacatctgttacctctctaaaaagacctatttgcccctaactcattgtacatggtattttttttgtccagggaaatatgtcatcgacggtggaggtgaggtcggcggctggtcgcggtgacactgggacaggtggttgcggcgaaggggatagaagcgccaggacgccggtggcgaaggtgtagtcggtcaccggttgcagccacgctgctggcatcgttacttgggcggacggtagcgatggcggcgccaggtcatcattggggagactggcgaccggcggcgtgtagacgagaagtcggccgaccggcggcgcgtcgacgggcagtcggtgggccaattgcgcgtcgaccgggagtcggcgggccgccgacgcgtcaaggggagtccggcgaccggcacatcgatggggagtcggcgccgtctcgctgggagactgggaaagatcgatttgggggtggacggtgtgctagggttttcaggttttcagtcaactgattttcttggatggatatattagtcaaagggtattttagtcattaacaaaaaattcaatacagcaaacagatgcaaactaatggctcatggacggcgatggcacgcagtagaggttaaagaaaacatgatagtatataattgaacttgacaaagtcagtggtaaattgtagaagtgtgattagctcaatggtagtgagtggattctcacttattttttttatcatatttatgtaaaaatgccactaactaccctaaaccacctcacctctccatcccgtaacccacacctcaccttggagcagcaggcgaacaagtttggcttccggcggcgcgcggttggccggcgagtgggcggacggccggcgcgcgcacgggcgggcggcccacagccggtgacgcgcgcgcggcggctaggagacgcatggccggcggctgctaaggcaatgagcaggtaaaatccgctcaaccccttttccattttatttgatttcagatctggaccaatagagaaatagggtgattttgcattatatgttgtgggtgattcttttaaggagatatgccacttttttatcactgtgatgttccatatgaaattatagtattgttaccgttgccaccatgatcaagattcaagacccatgatctacatgtacatgtactctttaaaaataaaagatctacatgtactaggtttggtacttatggtactaagcatgatagcgaggtaccacccttggtacctgtgagagcatcccagcagatattgtaaccgatcctccatcccggttttggcgtgtagaggcgaaaaaacgccctccagcggatgcgctaacccacacgctaaaattagcggatgcgccatagtaagagagaagaggtaaaaatagtgtttctctctcctcacgccatttcacccccaacacctccggatcgagatcccgcccccatccagacatcggcaaccacctcccctctggcgagccttcccctctatcgccattgtccccaaccggcgtaggtgagttccccatccctgttttttgctttttttcagcgatttgtggagcgagccttaccagatttggggcgccgtctccatgcgccttcctcctccggcgtgcgcgcctttcgtctgttgccgtctccccgcgcgtggtcaccgccctgcgcccgccaaccgccgccgcccctcgcttgccgctgtggccctacgcccacgagccgccgccgccgccctgcgcccgtgagccaccgccgcgcctcccttgccgccgtcgcccagcgccacccctgagcagcccgccgccgccgcccctcaccatctcccccgtccctttgcctgcctctccctgtttggaaaagaagagctctttgagagcatagaagaacagataaaacgaaagtttggaacagaagagctcttttcagtatagaaaatataattgacacttgacactttatttatacaccacattttaaatatatcagttaaaaagatttccgttaaaatctaattgaaatattatcacgataaataagtagttcaaaaaatatatctcttaaaatacaaatgtaaggttagttggaagatattcttaaaatacaaatgtaaggttagttggaagatattactaaaatatagaatgatgggatatggatgagaaatattttttggatgatactttatacgggcatttggagaatcaaatatagatcatctactggggatgctataagtaacaagaccggtattcacgtggtagcaagcctagctaatatccatctcgtatcataccgttcggaatggagaattccgtttaatagcagtcaacattcatttgtccctgctcatagagcttgagctaggagtacaccctcctcaccctagtgcgtaggtcagtgtacctagagccggcgccttaggtcttgttgagttcgcggaaagaaatattttgtgtgtcacatcgaacgtttgaccggatatcggaaggggttttcgggcacaaatgaaaaaactaatttcataactcgtctggaaaccgcgagacgaatttattaagcataattaatctatcgttagcacatgtgggttactgtagcacttatggctaatcatggactaattagagcaagtttaatagtatagccaactgctagctccaatttatctatagccaatctaatatctcattcatataatagctacatactacactattaatacctggtcctacctggcatacatacactgcgttttggagttcgtgctacagctggctacaaatctgtagcccactcctcttctctctccttatttatcttcttaaaatatatttgcagctggcttatagcctgctattgtacctgctcttaggctcaaaagattcgtctcacgattttcatgcaaaccatgcaattagtttttcattttatctatatttaatgttccatgcatgggtctaaaaatttgatgtgacgtttctgggaaaaaaatttagagaactaaacaagcccttattgtcgtcacgagtttgccgctatattgggatggggcgacctgattcaagttttggttgggtgtctttcttatatatgtagagtttctattttagataagctactaaagtattttttagaccgtgtaatatacggattagcgactagctagtaatattgctcaatagtcagtcctaagtcaaacctataggatctagctccaaaagagttgggtagtcggccaatcaacacatgcatatcgatttaactaaatcagaagctctgactttataaagaaaataaaatggcgcaaggtcacgtttgaagtcaacacttaccatgccttatctgatgcatgacgtgcacatgcgttgagtataaatatatccatactgataactagaaacaatgttgcatttgccatatcccatatgcctataaatagaaatagagagatacagtaactctcggccaatcaattcatcagagctagttaattaagggcatgttcaatttgataccattttcaatcttatcaaattttggtaaagttataaaaaaaagctaaatttagtttgctgccaaattttggtaactatataagaaatcctgccaaaattttagcaactcgccgaaattttggcatagttgccaaaatttcaacaatgccaaaatttattaatgttttttttatatcaaagtgaacaggccctaactcaaactcacagttgcctcctcctctcctatggcctctggcgccgtcgccgtttgcatcgtacgtggtgctggtcctgctgcagtcctccgccgtggagcgggcggaggcgcaggccgccgggccgcaggcggcgccgatggcctgcagccagtgcgaccagatgtgcaactcctcttgcgagggcgccggcagcgagccgtgcagctacgcctgcggctcgtgccagggctgcatgcaggcctacttctacaggtgcctgccccgctgcggcgactactgccgttccaactgcgtttaattagcagctggatgccacaactggagagacgggcgcgcgcttgcttttgttgcatttgagtgttattatgttatttaattatcgctatcttggtcctcggtagttatatttatactccctccttccttaaatatttgacgtcgttgacttttttaaacatgtttgaccattcgtcttatttaaaaacttttgtgaaatgtgtaaaactatatgtatatataaaaatatatttaacaataaatcaaatgatagaaaaagaattaataattacttaaattttttgaataagacaagcagtcaaatattttaaaaaaaagtcaacggcgtcaaatattttgtgatggagggagtatttttagaagttgtgtttgatcgatttgtgactctttattaggagtatatttgtagaagccattgatcctttgggtctatgcatagcagccttgcacgtaggtagctttgttgacactgtttctatttggttagaaacaaaatcaatgaactcagaagcaaatatttttttaattatcttcttataactgagaaacaacaaagctaaaacgctactttctccgtttcatattataagactttttagcattgtccatatttatatagatgttaatgaatctagacacatatatgaagtaaaaaatactagaaagtcttataatataaaacggagggagtaaaagactagtttcgatcttctgctgcctaacgagccataccacacaaaaaatggaataagccaatctcgataggcagtccgaactcctacaaccctcattcatgtttcatccatctttgattggttcgtttgccaccttgtcttaaccattggctggatccaatggatccaaattcagcaactcatgacccccccccccccctgtgcctttgctcgccgaagtcatccaggcaagggatgcagaggagacaccccacgccacaatttagccttgcacgaacagatccgaacacgagcaaggcagatccagcgacactttctaaggtgaaattggatcgggaacggtcggatccaggggcggatccaacgtgggtgcagggggacttgagtcccccctacaaccacaagatcgatggatacccccagagcacccccttcaatttttttcaccacgaataataaactaaaggttcttagatggctggatgttaaagaaactgcgtaattgagccccttccccccaattttttgttcctggattcgcccctggtcggatctcgacaacgccatgtcctaacacttctttttagagaatggtttttttttacctgacctctacatccaaccagatatatgatgctatttaaattggtaacttagccccgcaaacaacccaatctaaaattcactcctatggagatttaaactcaagaccttgtggtgctactcatgtcactgcaactactaggctacatgccctttcgcaagttcgaaacccactaggctaagtgccctaacccatattttcctttcaagttcggaaccggtatgaataacatatcattcatccgatatcctatcctatattatatttttagaattaaattcgggaacagatatctatttgtataatatatagggagacaattaaagtgttaaaagagatacattaaggaaaaaattatacaatattacatgtgagttcgtaaaatattgattaaccaatcttatattatatccgtaggtgaatttataatagatttacatttttagataatggaatcaaacatcctggcctttactcagaagagctatagccaattattacagtctagcaataaaaaaagagtgtagtttaatgaaacattgaaaaacccaccgaaccaaaagaaatacccaaccaaagatacggagtacacatttattgaagtatactccctctgtcccaaaatacatcaacttctggaattcaaactttgtcccaaaataaattaacttctaccttctcatccattatcggttcgtaaatcgaaaaattgtattccttcaataccccttatctacctatctaccaatactaatttgctattaatgatgggtattttggtcctttatcctcttctttaatcatgcattgggaagctaggagttgtctctttacgagacagagggagtatttgtgaatctccatctataattagcaaaaagttaaataaccatcgtttcaagcttccaacatgcaactcttctcgtattttaacctatatatccttacatatttgaattcgaaatcgaatggtaccagtatatcattttctcaaacataccatattctttccgcgagccataggtcagatgagccgtcgagaaatgccgtaccgttttcatccagtagaacttaggttgagaatagctcatcattgtcctgacgatgccgctccaggcccagtttgggcgaggcgacgttatcgacgtatccgaaagaggaaacccatcgcaagtccaaccgtacgtgcacgagaggctgcacgcgacgtcgcgtcctcgcgttcgtcggcggcgagcggccatctgctccgatgaagccgtgacaactgacaaagacggagggacagcctggcattggttattcatccactcgctctgacgctctccatagatcagggttttaaatatcccgctatagctgccgctatctcccgctataattgtttgagaagggttagctatttgctctcatgtacaatttagccgctatagctccatttagtccgttatagctgtcgctatagctgtttgagaagctaatcgctaaatggcttagcccgctatttaaaacattgctatagatgggccgttagtttgcctgattgcaggcggccgggggttcggaggcgtgtcttcgtcatcaactcatcatcccgcatctgaccaaaccaatacagcttcttatgtttgtgtttacttaaaccgatatatgcttatctgtagtcgtatgttagctaggatggtcaaacaatcatcatgtacgaatctgattaaaccaggtctagatgctctgacttgcaatatattgagcatcgacttgccattgtaaactccttaattagtcaacattttaccacgatcggagcatacgcacgctacccccacatgcacgcatgctgatcatgcacagcacatctcggtacccggtggtcgcctgtactcgcgtactgcctataaataggcagccgatcgatcaagcagcttaatataaactcctcggtcacttgcaaatcttctctatcttataagttctgaacaatggcaggcggcgcctcttctcctagggtggtcgcctgcgtcgtggtggcgctgctcctcctgtccttcgccgtggagccgctggaggcggtggccgcggcggcggcgccggcgacggcgacgaagccgatccggtgccggaagtgcgaccacgcgtgcaagaagtcgtgcaagggctacggccgcaactcggactgcagcgtcccctgcggcgacccatccaacaaggccggctgcaagagctgcctccaggcctactactcgaagtgcctcaactactgtggccaggcctgccgcgccgtctgcatcaactgatcaatttctaccggctaaattcgtccgaaactgggtgcatccatatgtgttgtgacttgtgtagacgacagtgttgattactgggtgtgatcaaataagggaggctctgtgctgccagccagtacgaatatgcatgtttaatttgcaaatggagatgctcacacactaattgcttggttagtgttccgttcaagctagatttgtgcaattattagctatgtgctgaagtgatatggaaagttgtgcacgcttgttaaccgttccacttatgtactgttctgttttacttatttacatatttatgttcagattcgtagctagaattaggtttattttgcacggagtggtatatcatggaacattgcctaatcacattgcatgtaagtggtaggttcacatgttagagagaaccaggcccggacgtccaggcttatgggccgtaagcccaggtctaaactgttactacctagtttcggcccatttatctcctggattcggcggagcaaacgagcgagaatacaaagcccagttcgatcgggagacaaatcggttcctccggctccgatgaccccgcggcggcgccggccggcggcggcgatatggcggtttcgtggggggcttgagcgtgtcgaccaccggtgtgccctcgccgccgtggaccgagacgacggcggctccctcttctctgcttccccaggttcagtatctccccactccttcccttcccctcccctctcatcccctttaaattttgcaatgtccacgtagttagatgctctctctgcttgcacgtagactagatggatttgtgcgcaatgcgatggatagtgaccgtgttgttgtctagtaagagcttctgacatgtgtcgaaggtggtgttttgctgaatgctacaacctatgtgagcaaaagagcaaaatgtcgatgcgggttgccatggaactaattaggcgcgcgcgatatatagctgtatggcaaattggcaatcaaatcacttcgtagcccttgttttcctgccttgtggttaatttctgattccgctactggttatgctagatttacaagtaagaatcgatctgtgactgaatgagatataatcattacatttgaggaaatttgaagaattttattgctgcaaatttgaccacagaagctgcctccctaacatcataggagtaaagctgcataattaatcatccatattgcagcattgcctcttcatttgagcttgctatgtgaagctgcttaaaaatgggacaaacactacaacagtaactttattattagcactaaaactttattcttgcataatttgtagcaaatagtactatgcagcttcattgcttgtgccctagggcctaagataacagccacaaacctacaccaactcagcagcgcgtgacgcgtgcagcagtctcatattgagatgctattggggatgcccctggcagtgatcccctcagccgcccccttattgtctgacgtgttggggaacatcagtgtgtaggggaaattggctggaccgacccggttcttgagcagggggtccttgttcatgttcaacactttgctctcaatctccaccagctgcctgctgaacctcttgaatgcttccagtgccttggggtctgatgtccactctggcgtgtcacgctgcccaagatagatctcatccgctgagtgctttgatagaatctcaatgagcgagacaccgagaatggtttggaattggctggtgatggtgcggatgaagaacttctctgggttctcgtccagctctgtgtactccttggaacccggctcgggcatcggccgccggcttatggtcggacggtttggaagatagcccgcgtatgggtactgcccgaaattgacggctgcgtggagtgctgatgcaatccagatgattgtggtgcaggccttggtgagctcaggcaagctctgcatcttgggccaccagtccgcgtccttgagatcaccatgcccgacttcccgcacctccttccaccatgcttgcagctccacatctccctggaggacaccatcgtttgggtagtagatggcacagtactcagtgacccactgctcgattgcttgccagatcgccaggccatctgttgcataagggtagtccttgatcagtagcttcaccttggatgggcttgatgggtccttgatggcaatgcctctgcattacaaaattaggatgttattcaaagttatgttattgttggttcttgttgtgatgtggctctcggtgtttaattacctctttattagatcatccggaaggccctgttccgtgaagttccagttcttgtaaactgctgaagacattgccagagcatgtttgccaggaaagacagtttgttcgaaaatgccaccgccgttgatgagtgtctggcgtgccaatgcattgattgtcatcgtgtcgcgatagtgtggctggaggagcttgtacacagggtgtgtcacactgagctggcggtttgtagcgatcacgaagggctccatcacagcatgtgtgttgagcctacaagagtttacatcaatgatgaggttagcttactgctttcaggaaagaactacagtttgccactgccagtacgtaccagtggctgataagctggtgccaaccggagtcattaacagcaacataagccttggccagctgccacacccaagactcaatgccacttgatgcaggtgtatggaccttgctctttgcagatgttaggttgccctcgatgtgtggcaagctcagttcaattgctagtggcttcagggtatcatcatcacgtaagaacaacagggtccttgtggcataggtgaagataccatcaaggctgttaatgtcaatgaggaatggcatgaaatgatcatgatgatccagaatgtagagcctgttgctatccagtgcctgtgcagagccataattgacaacaaatcaactttggcagtttgtcaaatgactatcgattgcactgtaaatgaaatggatcactgcctaacctgttgcacgctgaggccttcgaggttcttctcaatgtgagctggggtgattgtgctagtctggtcaccgtacttgctaggatcaagagtactttttggtgggaattcctatgaacagagaattatacattagcatcagcttgttttgttcatgcttgctaggagcacaaaacatcaaagactatgtaatgttggatagttcaccgtgagacgcctgatgaccatgggattcagaccagcaagaatctctcgtgcaaattcctcatctgtcctccaagcaacctcgttctctgcaacaatgcatagtacaacagttcgctaattgtccactgctcatcgactatggcaattgacacaatggctaaatcatggtacctttgatgatatcaggtttggggaacttgagcaggtagctgcctccaaccggaagcaggtccttgataagttggacagggaagctcttgcgcagctcctctagtgctgggatgctgggaagcttcaggcctcccctgtagagcttcaagatgtcctcgaacgagtcaaattcaccaggtgtgagatcaacatatgtgcgaatggcaggcaagatgccctgaacaattgccttgatcgagtacccagcaaagtctgacatcttgaggtgcgcgaagcgctcatcgcttggcacgtaaatttgttccagcagtgataatctgctctccgagtttgggtctgcagccatggatattcacgcaaattagatcttactagtttatgaacttgtctgtcaagaagtgctctctagatgcacagaaccaagaggaacactgtaccttttttggtcggaattcggccagtacggccacgacgcgggtaggggtgcttctgcgagccacctaggacagggcgtgggttgtccctgtctggttcaccgaggtcattgtaaacatcgtaccggtagatgcggtcatgctcttgatacggcccttgcctgtcctcccctctgaggtacctcagctcgtcttcacggtatggcctcagtgcttctggcatttggctgggaaggtaagactgcatccaatggaagataaaactgtaggaattaatatccagattccagaactagagaagtcctcactttgcatcacagacttcattctcttaattattggcataatagatgcatctgatgcactcttgcagttgccacaaactttccatttgtgtctagtcattaattttggtgttcgtgatttcacagaaactgttgctccctattactacttcactttggatgttctgcatg

SEQ ID NO: 1494 - DNA, 7803 bp, Oryza sativa
ctttccaacagggtagatccaggaattggcaacaaacacaatagtgtcccagccagggacatcatggagggtgatggtcttgaggaagaacttggtactggggtggttcttgatgatgatggcccctggcacaccatgcttgtccatctcccagttgaacctcactgtgagcttggactccccttgtgataccgatggtaaatctgtcaacccctgctccagattcgcctctgatccaactatccccctgccctcattgtctgcacatagcatataagacaataggttagtcacttcatttgtgtcactggccgttttcaccttgtttccgttcaatctgtgctgagtactgagtactgatccttgattctttctacatagcaaacatgtacaaactcatgcaaagtaagcgaggaagaaatggagaaagatcagtactttggtcggcaacagtggcgctgacaagctggcaggtgatgctgtttccaaagacctcatggacgttgtcgaggagccaggcagtgaagtcccttggatccaataattttcggctcatcagcacagccaagcctttgatcttatttccatttttccctgtcagcttgtccttgaacccttccaacattctgtgatacttgtagccgtgacaaaagaagctatgttggtggtggtgtgtgtatgttgccgttgcaatggatggggaagaacttagcaatgcagctgagtttttatagaagggggagagggaggttcgcgatgtcagtgtgcccatgagtattggctactaatgcgactatgcaagtggatactatgtcaagtggaagaccgaaccccaaggcatcaactagcccattcacttggacaacacactgtaagttgctttcttttagtcgagaattgtagagatatttctcctgttttgaaactttgaagagtatcacattttagcttgaaaattttttagggtgtaaattcgaagtctaagagatcgagctggtcatccttgtctcacagccttgtcaaaatattaatacttattcccttgttgatagaaccaggcaagggttcgacatttttgagtcgtatgagctgggttcatattggcattgaaatgaaccatctgtatgtgaaccttaccaactcttggctcttgaggtgtgctgccaaaaatattcgaacagttttcatgggtgtgatacacattggcctcctgcctagtactagtatatttctacattatcctttttattatgaggtttcacccttagtgatcctatagaagttatggcattacattagtatcaactgtcatttacagtaaggtgttaattattccctattggcctcttggctttacttgctgacaggtccacttcagctgcacagtatactggataagcactgaacgaagactgtattaacttattagcagtttgaaacgtatttgatgcccgtgccaagcaactaaacaagaggccttcgaattgtcattgacgaagacctgagctacgggcctaaggtgtgtccatgttttactccagtttggatcatgtgaccggcatcttggatcttgccaattgcagtcccagaaattcaggtaggagcaaatgaaatgaggagcatatgcaaattgggactatctttaggacacgtttgcaggcaggattatttttgccgtttatatgggaaatcgagctgatttgaattagattcctgtatttggtttcatgtacttgagttgaatgcgcttaaatgcgtccgatttccataggcttcagtagagcgtgtttaatgttctttctacctccaattttagcaactctttgattctgtgcgcatgcagcatatttcttccaaggaagtacacctatcatgaaagattcgttgtaaaaatatgaactaaaatcgaaccttccaatcattaataggacttctccagatttgaccactaacatggcaacacataataagattaagtagaacggccatgtaacgctttgaagcaaatgtaacacgtgcctttttcattagcatgaaaaatactattcgaacatagaagtcgccgagagttctcaagccccacggtacatattggcgaaacccatatttcaggacatagacaagaaaagtttaacaaaagctcaatggacaatttcacgataaagatggacaccagccgaaaatgccatgatcataacatgagtaattcgtcatacttatatatgtaaagaaagcaattgctatggatttcatcaagttcatcacaccgagaaaaaaaaagatgatacattacatatgttcacaaattcacattattacatgtacagagggtaaaccacatatatattgttcaagcggccaaacaggtagtagtgatcttccaataacctgcatcattatgccatgcccttatcttcccattgaccttacatgattacatctagtggcctgtttgttgccgctcccaccttaggtcctcagagtactccatcatggctgcccttggatcaccgtctgtgacagataagtagtacgcagcggcaaatgccatgcccttatcttcccattgaccttacatctagtggcctgtttgttgcctctcccaccttaggtcctcagagtactccatcatggctgcccttggatcaccgtctgtgacagataagtagtacgcagcggttctgtcatcggtatgcaagcttcgcttgactgactccaaaatccttctgcttcgtcgttctgcagcagcagtgttcgtcgaggattctgcttttccactagggcgtccctggggataaaagactgcaacctctcttctagcgttataatccatctcaatgtagcatgtgctaccctgaagaatttcaggattgctgatcggtatcagaagcctctccctcaagtagatcccatggtcgctcatcatgttgttgaaacgttttatatcggtcacctgcttgcaattcatagagcaccaaagagtgaagaacgttgctcacacaagcaaagtgcatctttgtggaacaaaggagacaagtgtgcagaatggtatagataaacagaattcacaaatgtacaaagtaaagttatgtatggttttcaaagttcagctgcatcaactattaaagagagtattccagcaaaattcacaccacacaaatggctatatctataatcaactctacacggcaacagatagaatctagcagctgaaggtgcataggcattgtgcagcaatccctaaataatcttctttgaacaagagtgaatctcatgaatttgcaactatcattaacagtttagcacatagcaggaatcgtccaacttttgcacagtcaaaaattagtggtgagctccacaatactgagaatggccaaaggtgtcaaacgccaggtcctagattatttaaaccttaaaaaatgtattgaattgtcgtgcttgttcttatggctacacattatcagcgtctcagtgactagtaacctttgttcatttcattccagatgacctcccttctcagcaaccactcagaatattctaagctccagtgtctccatctttggataaaaagacatgttactgttgtttaaaactatcggttgtcaaaattaagtgctgcttggatcttccacggggtaattaggggcaaatctatatgagaatcatacccttttgtgtataacaagaaggataactaggcgcaaatatgcatagagctagcgatagagccataatcgagcatcagacgggccgatggttagtacctggatggagtacttgagcgcgatgccggggacggtgtccccgcggcggacggtgtgcgagagcgcgaaccgggcgagggacgcggcgcgccagaaggccctcgtctccggctcgccgacgacgcggcgcaccccccagggcgacgcgaaggcggcctccagcacggcgcggtcggaggcgaccccgcgccacagccggcagacgcacgccgccctcgcgaggtcgggcggcggcagcctctgcaggaccgcgcgcaggaggtcccccgggaagtcgttgctccccccctccatcgcagccggggtacgatcggggcaaaggcaaagacggatcggagctcacctcgggcgagaggaggatggctgtggctgggggcgatcgtgcgcggcgccagctccgccgctaccgcggccggtggaggatcggaggagaggagggagatcgcgaggtgaggcggctcgcgtgcggtggcgcggccgtggcggagtctgggatgatatgtggtgtggtgttgacgagtggtgtgcgtgcacggcgcagcagccgccgcgtttgcttaacgatccaatttttatctgaaaaacaaaaaacataaatacgacggtagtagtattttaacggaatagctaacgcgggcctagaaaaccatgactaaatttagtccctctcacatgtttctgtgagagggactaaagtttagccctactttagtccctccaaccaaacaccacctaatagctaatcttataataacagtagtctacttataaataatttgttcgagaagtttaatattttgaaaagcagacggttgacaaatcagcttttgagaatttgaaaaactatgttttcctagctttggacttttagcttatttttaagattctaccattacaacttctcaaaatctaaattaaaggctgaactatttgagaagtttctaattctggaagaaattgaaactagaaatttctacaaaaagatcccgaatcttataactatgattaccacaagtagatcgtaaatcttatacctatgtattgtaccgatactaagggtctgtttagtcggtgaaatgaaaatttttggatgtcacatcagacgtttgaccagatatcggaaggggttttcggacacgaatgaaaaaactaatttcatactccctccgtttcacaatgtaagttattctagcatttctcacattcatattaatgctaatgaatctagacatatcccacattcatattaatgctaatgaatctagacatatatatctatctagattcattaacatcaatacgaatgtgggaaatgctagaatgacttacattgtgaaacggaggaagtaactcgcatggaaaccgcgagacgaatcttttgaacctaattaagccgtcattaacatatgtggattactgtaacacttatggctaatcatggattaattagcctcaaaaaatttgtctcgcgatttacatgcaaagtgtgcaattattttttggggcaattgtgtttcagtccttgatttacaattcaattgtgattttacccttactttttagggtttgtgattttgcccctgcttttatgaaatgaagcacccgtctgcctctggttttgacataagtttggtgggcctgaaatttccgaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcgcgcggcggagtcgggcgcgggcagggaggtgcggcggcggcagcgtcgcggctggcgcgcgcgcagggaggtgcggcgctcgcgcggctgcacgcgcagggacggcctttggaggcgccgcgacgaggatgacggcgaggaagaggacattgccgtcgacgagagggactcgctcgggctgccgttgccggtggtgagcaactgctcctcgtcggagtgtgagtacatggccgagtcagaggctgagctggcgaagacggaggagaagtgcgcgtcggcgtcgtcagcgtcggagtacgaaaagacgtcgcagtcgagcacggggagcgtcgccttccatggcgcttccgacgccggaggagacgggcataaggtgagtgttagtgctgcttctattattctgcgtttagttagttgggatttgggatggcataaatacaatggtgatcgatcacgatgcccatgcatgctgtgggccaaaatcatccatgcaactgttcgtttatcaagactaaatctctatcacgagcaaaagtgcaaatatttgtcactttttatctccttttttctaatcattaggcattagtgttcgttttgctctagaaattatcattgaatgccaaaacatttcaggggtatatttgtccattcaccataaatttaacaccggtaccattagttaacaaagtaggggcagacggctacttcatttaaaaaagtaggggcaaaatcacaaaccctaaaaagtagggataaaatcacaattgaatcgtaaagcaaggatagaaacacaattgccccttattttttttatctatttttaatgctccatacatatgtttaaaaattcgtgtgatgttttttaaaaagtttttaggaactaaacagggcctaatctggttcatgtctggtaccatagtaatagaactggtacctaccataccgtgctgaagttacgttaatgtaattccgttcaacggtacggcgttatgtggtatgaaaatgctcctcttcgaacgttcaatcaaatgaaaaacgtcggatgcctacgaccagctcagttcttacatgctaatttctcctttctttatgttgatgccagggaaatgctgcaaatcagcagtctggtggattggacgaacccttatcgtactgtaatatacatgcacatgcctagttgtttcttttcattctttcctcctctctttaaatattttttctcctaaattacttatccgatctatggaccgatcacaccgttgtattcgttgcaattaaatatttacaataagatattacatgattatattatgtcaaaagaaaaacatgtgtttcaaaccattaaaacaaaatgtttcatacgtgttagtgatatgtttcaatatgtgtcttgtttcacaaaattcctgaaactacctgctactactctctctccacctcatgcatgcatacatgcatatgttttagcaagcttcaaaatgatttttccctcaaattacctattcaatttatgatccgatcactacattgtatttgttgtaattaaatctttacaacaagatatcgcttgattatattttgataaaagaaaaacatgtgtttcaattcgttaatacttgttgtttcatatgtgacagcggcatgtttcaacgtgtatcttcaccatatttcataaaatatctaaatgttccaattgctgattttctttttcaccatatatatagcatcatgttttacttgttggttaactgcaatatttaaccgttcgatttttttttcaatttaaaaatgtttcacctaatatagtcatgatgtttcattctgtaatgatcaaatgttaccgtgaattgaaacattctttcgctattcgctgaaacattattttcatataagatgaaacagcatccgataaaacattttcgatctacttaatgaaacaattccgatatacttggcgcaacagcgtgcaacagtaaaataattcaataataagctaattttttttatcggattatattcatgtgtggacttgttttaaaattttaattgcaatgaatttaatggtgtaatcggatcatgttttggataaatattttaagagaaaaaatagtctaaaatttgtttaatccatgcatgatggatggctggcgcacctgtgcatggatcgaactgtcgcgcgagacgtccgatttttcgtttcgcgccgtacgtc

SEQ ID NO: 1495 - DNA, 1342 bp, Oryza sativa
acgtcaaagtggggccagttagaacggcccattaggcccggagaagcgcctatctgaagtccaacacccgtccaggcaccggctctccgccgctcgaagcttctctcttctcaccggaatctcgagagcacagcgccgccccgacgacgagatccctcaccggcgccgccgccgccgcggccaggaggccgaggggccatgacgaccatccgccggttctgctgcgacgacctcctccgcttctcctccgtcaacctcgaccacctcaccgagaccgtgcgtccgccctaaaccctcgccgtctcctttttcttctcttgatttcgagcttacccgtcggtatgctcgtcgcagttcaacatgtccttctacatgacgtacatggctcgctggcccgactacttccacgccgccgtcagccccggggaccgcgtcatgggatacagtacgtgttcttgcccttgggggcggctgggtctgtgctagctgttgctagtgattctgcgtctttgtttgtcagattcgctgaaattgtagagtaaaccctgcatttcctctggaaaacatgagaatttagggatcttttgggcgttacagtgcccgattggaatgtggttcgcaggaaatttatgatttgtggaggttccagtggagtctaatgtaatcttggtagtactatttatttgccgattaggacttattatttgcctctttgggaagggtggaacactatgacctgaattgggagcaggcgagcatgttgttcatagtagtgttaagagtaacccttttagtgctgaatgcagtattctatagtggagtattgagatgattcacctgtctgaatagatgagcactgtgcaatattctagtggatatgtataatttttaaaatttatatattttccaagtaatacaaagttcacctgcaaaaggctatggggtcagttgaccccaaatctgcatttccaccattgtgtaatgttatgtctgcaatatttcttcctcctccacattctcctagtttagtttatgtctttgtggccattcatttatttggatgtctgttgcagtcatgggtaaggttgaaggacaaggtgaatcttggcatggacatgttacagcagtgtctgttgccacagaatttcggaggcagaagctagccaaaaaacttatgaaccttttggaggaaatcagtgacaagatgtaagtatctcaactatgactatccctatgattgaaccttcacgccgatttggtgattgtaaactatactgactattattgaattttgtgcttattgtgcataaacaactgttcatttgatatatcatgttcttca

SEQ ID NO: 1496 - DNA, 15711 bp, Oryza sativa
  unsure (1)..(15711): unsure at all n locations
cccatgtaagctgtagtagttctcctgttaattgatataggccataattgtcctggcccaagtattaaggaggtgataaaattccccgcaaaaaaaaaaaggaggtgataaaattgagaatgcttactaggaatttagttctgttatgtaccatctcatgattgtttttggaggatgagggaatacttagtagtttgtatgggttttaacgaaagctgcatactgaggaaagataataagcaggggcatggttgggaagctcattccatcgacatgcaggcattataaaatcagaaaatatctcaaatatataccttaaattttcaattgaggactgattatcatatcagattatcagctatgatcataagcattgcaagctagaaattgtagtatggtaagacggtaatgtattactgttctggcctactagttctgtgaacaatttccattcagtaggattctgtagagtttaactgggtatttccttccactaagcacataccttagataaagaattggattcttgaattaaaaatatcagcctgttccattgctctattgtggtatacttgtttttgctaatgtcccatttatttcgactttatgattccataactgttgttgtcatgttatttattatagattctaatattacgctaaaaatggttatcctttcagggataaggcctactttgtggatctcttcgtaagagcatctaacatgccagcaataaggatgtatgaaaaggtaagcttcatacaaatttcatgatcatctagcactctaactcactgatttatatgattacacatttatatatgaatactgaataacaaacgcttgatctttcaaactagtttcttctactgcccctaaacagaattgttttagtgaaaaaaaaaatcatgtatgaaggtttcagcatagagtttattcttgaaaatttgaatccaaaatgacattatttctagtgagcttatcaaattatgttcctggtttccatagcttggctatgtggtttatcgaagggtgctccgctattactcaggggaagaagatggccttggtaagcacttccacagtgccaaatcatcactttgtgtcatattcaaattcattgttctaatggcgttgctcacttctgtccttgtttttgcttagatatgaggaaagctttgtcacaagacgttgaaaagaagtccatcataccactgaagagaccaataacaccggatgaacttgaatatgattgaagttaacttctagttacttccagtgttttgtttgctgttaacttctatggtgatttgccaagtgtcttttgtctccagtagtatcatctagtgatcgtgctgttttcttttctgcatcctgataagattcaacataactctgaaggtgattctatcgttttggaatggaatgcagcacttagtaagtagtctatcttggaatgaggtgctatcttgtaaccataccgttattttcttgtatcgaggagttccacgtctgtatcattagcctccacacgattagaaaccagatgagaccttagtatagataaaatgtgaatgggccaagtctgatattctgcagatgtggagttttgaccttggtagcgggcgtaacgcgagatcacaacttcacatacgttagcactgcagagaggagtaagaaaattcatcaaacatttaatataaaattgccaaatttcttaagatttcttctcaaagttacatcaacccttggaatactgataaacatacgtgaagaacttgcactcgtgtttgtttgagctatgaacgtcgataggaaaaatcatcgatgtatgtaagtcgtcctctaattggccttaaatatgactgtagccggtagctcccatatccggctctcattttatcgtgctcaaaattccactaatatattgacaatagctagaaaaagaatatccattggacagcagcggggaccgtatttaatcttgttagggcaaaaaaagattttggaattcctacaccctccaggcctttatacagtccaatcaaccagtgtctttcttattagggaataacaaaattggtattgccctaaacaacgaatttgataggatacgtgcttcctgaagtccccctatttgtatatgagagcatcacgccctggtcctacgccgatgtaatggactgggataccaaccagctcttctatcctctccacgtacaaacgagcagtctctgggagatcgctgtagtttcgtacagaggaaatgtcgtcctcccacccaggtagaacctcatatttgacctataccaacagagagaacataagaattttcatcaattaccaagagtcacattgagtgatttagtgctctcatatgctgcctgtaaaattatggcatggaatatgagtaaatggaacaggatcaactgctcttcctcaccttaattttctccagaagatcaaggtctgcagggaatgattcaatttctttaccatcttcagtacaatatgcaattcccagctttacttccttgaggccagttaacacgtcgagtttggtcagatttaaagatgagaaaccgtttatttggcagcagtacttgagtgcaactatatcaagccagccacagcgcctcggtcgacctgtcgttgtcccaaactccattccagaagcgcggagcaaatcaccagtcttacccaacagctctgttgggaatgggccagaacctaccctggttgtgtaagcttttacctgcacatggaaatattaagttttgtagggagaggaaaagtatggattgttaagaagtttaaagatagctgtaccgaccactccaatgagatcaccgatacttctaggagcaataccaaggccagtgcaaataccaccagctgagggactcgaggaagtaacaaatgggtaagtaccaaagtcaatgtctaacatggtggcttgaccaccttcaaccaatattttcttattctgcaagattgattgattcatgaagtgcacggtatcagtaatataaggtcctagacgctcggcaaacttttcgtacttctcaacctcctctttaagggtcttggtactgtattcaaatccttcaaagcgcagagctgcatctctcagcaaggtattgagtttagcaccaaatgtatccatatgccgcagatcactgactctaagtccattccttataactttgtttgaatagcatggcccaattcccctctttgttgttcctataagggaatttccaagctctacctctctgagcccgtcaacagtttgatgaaagtcaaacaaaagatgggcacgatctgatactaaaattcttccttcacaggaaattccatttgattctaacccatcaatttctttgaagaacccaggaagatgaactactgctccattaccaactacacacattgtcttctcattgaggatacctgatggaacaagatgtaatgaaaacttctttccctctgaattatatatagtatgcccagcattagctccaccctaataacataaaacattctacaagttaaaacaatatatatatatatatatatatatatatatgatcaaatcctattggacaaaactaagtctagtcttattgccaccttaagaaaactgaacttcataaaggtgtgcaaaaacctataaaaattagtcaatacaacaagtgcagagagaacagtaggagaaatgagcactatgtaatcaaggttttccatgaagcaggataatcattttttttaacccataagaactgcttgtgtaaagtgaaaaggcaatatccttgccataaaggaaatgcaccattagttatcaatactgcattactgcctcgactagataaccggaagggttatcggtattttaagatgttttataattctattttgttagtacgaaagattcgacattaaaaaaatgaacatatagaaggaatatccattgtggttatgggtttagaaaaattgggaatagacaaaatgctttctgcagatatattaaactgatgcttagaatagttcagctatccttattcgttaatgatgatacagccataaaaattatcatcataaaaattaaagatatattcaagaatgagaaaacagcaaggctctcgagtctcatcaagaatacgttgagatcggaagggcttcacacaattcaagaaaactggggaccaatggtacaagtacaacccatgctgatatcagtacttatcatcaaaaccaagcaagaaccaaaatggaagggagccttggactactaagcttccttcgtaacacggaatttctcctgttctgctagagttgaatttcccatgtataaaacgactttctgtgatagtgttgcgatcaaaggagtacaaagtagcagtagcttacagtagtacggtaaaggcagtctgcgtggatggcgccggaagataaacacccttcaagtaacgatcataaagcaaactaacgcaaattactactcccctctgtcagaaaaaaaccaacctagtacggaacgtgagacatcctactatgttggtttttttggacagagggagtacatctcagctaaaggatcgcctctggaaactcaccagcgccaacgtgagaactcgtactatcctaccacaaggaaccaattaatcgaacaccttccggacaaactgacaaagcaaagaggagcagagagcgggtgtgtttggttgcaagccacactttgccacagtttgccacgcctaaggttaggcagatttgacaggtgtttggttgtagcaacagttgtggcaagattcccctctaacaaattgggtcccacgtgtcaatggctcaaaaaagtgtggcaagattcagattcccttagacttagtaagttgtggctaacaatttgatcacctcaccttagacaaggtgtgacaacttttattagcaagtaatggtaaagtgtggctgggaaccaaacagccccacccagcaaaagaagcgcgcgcgacggcgcgagacggaccgacctggcagcgtgcgacgatgtcgaagcgctgcgcgaggatgtcgacgagctttcccttcccctcgtcgccccactgcgtgcccagcaccccggccacctggctcagcgactccagccgcccctgcgcggccgccgactccggggccgtggccacggatgccgccaccctcagcgcccggcgcgagcgcggcgccaccgcgcatggcgccggtggcctcgcggcggcggcggggaggaaggagagggaggcggcggcggcggcggcggggtccaggcacggaggggagaatggcatggcggcgacggtggagggaaatcgaggagagaatggcggctggtggtgggccctccccgcctgctgctgggtttggaggcgacggtcgtggatgtgcccgttcgttatcttctctgttcgattctcccgtcgcgagatcggacggctcggatgtttcagaaatgattttcttcaattgtgtgttccaaatcttcaaaaattcgttttggtcgagttttgggggaaagtaagttgttgaatttcaggagatttggtgaaattcgtcatatcgcccgggctcgcatttcaaacaatgactttcagaacgcgtggtttgcttatttgcgttgtactttgggagcaacagtttgaacacagatttaaatttctcgtttaaatgtgaatcgcgctgcttgtaaattttcttaattttgatttgctttcattctagccgttaaatttctggagctaagatcgccatctactcatcatgttgcattttgcagcatcaccaaccggccaacagatatcaggccctaaactcctgattaagaattatgtagctagatgagcacttgagcagcaaccgcgtcaaaatttggaagagtaatagctactaatcatcagggaacacactttggacactaggtaaatagctcaaaattttctactgaggtatctgggcatattcttaaagcccatgtaaaacacctaaacatcaaaatggagctgcttatcatgcataagaatacgtaggtgtgcagatcatggcagcaactccacagaagcagcgaccgatgaacaatttgtcaaaacagatacagcatggagcaaatgaagttcgagcctcagcgacctttggccgaagcactggaatcagcattctttttccttttcttcagcaagttcaccttgtcctttttcctttcctggttaatctgtagttgcaaagggtaacagattagtttagctcaaagccacttaaatttacgctgaaacagggaaatgcttgtggcatctacaaggcatatgttataaaatttggcaatgtggctaaaatttcaatggatgacatggctgcaacaatgaacggatgtgaaacagcaagcaagcagaaagtgacaaatacatgcaaggcataagagcgcagacctcaattgcttgaagaaggcctctctgcttgcgagacataagggtcttggaaatgtcagcagcatccttctcggcttgtttatgagagtcctccatatgatcgtcagcttctttagtatcacttttgtccacaacatctggttggttatctgccgtcctatttgagaaggtctttccttcgtattccatcctcagctcatcgtggtactgcttctctagcatctccaactttagaagagaaaaaggcaaaatgagacaacagagaatgctttctgtacaagaagcaaataagatgacagcagaaaggactaatgttttgtactacatggtgttgaatttaccttcctcttcttgtcagcaatttcattagactctgatcgatcaataattgcctctaccagtgaattttccatatcttcgtcccctaaacttggcagaggcaacacctggctttgagcagcagcttgcagcctcttaatggtctctgcatactcaggaatgtaaccctctgcatcattgtccacaaagggagataaatgtggtggaggcaccctgagaccaaaaaaaaaaggaatattgatggcaaaaattaggacaaacataagtataaaaaattagatcaacttttatgcatctttatagttcatttttgcaaactgtgcaagggcagacagtaaaaaaaggctgtcaatttaactaaatgttaaattatacatgaactatatttcagtaaagttgtttccacctaagaaccatcaatatgtgcaaccaaaatgtgaaaacagcatgccacaaattaaggtattgcagtacagtgatttttaattaagttggaagtgggacaaacattgggctctcaactacaggagtgcaaatattatataatcagcacttaacaactattaaagggatatctccatatgatgttaacagcaagcaattgtcattagtgaaggctgcccccaactaaggttggaaataaacacaaatatccacccacaaattttagcaaacatatgtagaagcaacacacaaggccacacaaataatcaataaaaattacatatataatacatgtgccatgaggtatacctcccgacaatataaccttctgtcggcaatatgatgcgagcattcacgcaatcatatatccactgtggttgaacatactccctagagaggaaaacgtggctttgggtcggtctatcaacaatctgcaaaataatgagtgatatcagtaatctgcaaaataccgtaactacaagataaaactacattagagataaattggaaacaaatggctgagctaattgttatatatgattatttgatatttaaacagtattttatatttaacaaaagggtaacaataattttatccatcaatttgggcaacctctggtgtaatcttacagaaagataaatatacctgatgagtgatgtcttcatctgtctcatcaaaaggagctccttctccttcccatgaaacggtaccaccaaatgctggaatgataaataagagagattccctaggcacctgaaagtggaaaacaagacagataataagataagtatattgaagatgatctaattgaacaaacatacccccagggatatccccagggtacataagtttccactggcctacctcacgacttaggtagaacttcaggtttttgaataaactcctgcattctttggcatcagcgtcgtctgcatcagcagcagtagattcttgtacaagatgcatcagcgctccaggttcattagttgggagctggtgttgaagttgtgccaatctgagttcagactcatctgtttttgagctctctttattgtcttcaccctctttgtcttcaattagtccagcaggttctgaatttccaggtactcttccagaagacatgtaccggcacaacgcatagagctctaataggagaaaaacagtgttgtcaaccaaaaagatcccgaaaaagaagaaattaaaaaataaagggaaattattagctatttgagaaggataaaacgtaggttcaccaacaaaactacaataagcaccaacacttaccagaagctaaagcttccaaacgaggatccagaacaggaggataatttacatttatcgaatggtaaagcttgaagtttataaatcccagaagtgtctgcaggtagtatagaacagtcaaaaaattgaaagaaccattgtaccaaacactgttgagatcggcattttttttatatatactaagtgatcaatcttgaaaagttattgctaggtatcgtaacattatatctgaacattttcagcatgatcataggtctgtcaggtgtacatggttatagccagactgcaacataatttatttacaatagtcatatcttccatgcaacagaatattaaatattaaacagagattccaaaacaaaacaagcatatatggcttcagacctacaattgaaacaatagcagcaatcatagaagattgtagcctgcaaattcttgcaagacagaacacacaagagccaagattgttgcactcaaagaaatgtgcttgcatttacccccatgatatttccttttattttaccgcgtgcaatcgcattttattgtggatcaaattttcgtaacagttccagtactatttggatagaagtggtgctatattgctgaataaagcaggaaatacatagtaattaggaaattaggacagatcatcgtcattgtcacctcatagaattccaaaaaggtaagcatcacattgaagtcaacgtcatcagttaaaacttgctgaagagcatgtggagttagccaggtgatcttttgaccttgaacttcagcctgcaaaaagtagttatattatataaatatatatactatagcatgcacagttacagtgattttaaaggcaaggactgcaagtagacataactacacaagcttacttgataatatatgcccttgacggatataaatgtctttcgcagggaatgagttcgagatatatatgcttgccattcatggctcaacctacaaagtacaaacatgtcccccaaattaataaaaggtattagcaacgccaaacaaagtcaggtacagcaattcattatagcagcaataaagatggggcaaatgtcatagacttgtagcatgatgaacaaatgaactaggaaactacaagagccccttggctgggagtgttgtgtgtgaatttgagggaggggattcatttacaacagagcatacctgcggcaattatgaatccgctgaacttgcacacgttcaccttcaacagcaggcaacgcagcaaaaagatgcaccattgttaggcaatcatccaagtcacgaagagcatcaacaaaagttggatatctgtaaagcaaaaatatggggatgatttatagaaacaaatacggtatggatgtcatcagcaaatcactttaaacctggtacctttcaagaataagcctgtcaagtttgtaagttggtggtcggttcaataatctgtctgcaagatctttatttttcttagcaaacgcctttttgaccttcttcctgtggaccttgatttctctgaagtcaaacaacaatgaaatgtcattaagagtggagacatcacaaaccaagaatagcatggtcttataactcacactttttaatgcaaagacaacatgcaccacactgtatcaactaaagttctaatgaaactctagattatatataaagcatgaattatgattcccttgtcaacgatcaagtaattgtgagcaactagtctatctgccattctgccaaccatcaaaatatcattgatgaagcaccgaggagaataattcacatggcctagctaatggctctctgaaaacctacattataattatttcctcaattgtattcagtaataaaatacaagtttctatcttgcttgccattttctccgctgcataaactgtgacagaaacaaattgcacaattgcagcaaacaaatcaaataacaagaacacaacacaaaccgatcactagcacaattaagatattttcatattgcctatctcagtggcctaataacaaataagaaaattgaaagcattgttatctcattaaaaattaaatatgtctgcagctaaattttgtgatagtgatacattatatgcccttaattgcacagagaaatgtgcaatcaaccaaaaaggcatgcaattcaaatgctcagtgagtgaatactgaatacttctgtagccgccaaaaaaaaacacagatggtagaccttttgcaagaaaacttaagtacctaaacttctcaatcaagggatcatgggccaggaaggcaatatccttcatgtggtagtaggtcttgtggttcccttccaccttcttctttggatcccggggaaagacgcccttgagaatgcatagcttcctgcaacggattgcaaaattttaagcagtcagaaaaaaaaaatcctacatcgcttgcagtataaaagctatacgtaacgcagagaatagtgaaggtaatcctaatggccaataggcgtatcgaacaaattaattagcttaatggagtgtacagcttaaagcttcagcgtaaaatgtgtaaaatttcccagacagctttgttagctccaacaaaaccaataaaaatagccacaactacactcgttaatagctccaaaatgacccaacatatcattagtcagtactcagtagtagcagctgggagattagaggatgacctgaaggttgcgaggctaatctgcaggtacttcaccgccttggtcctggtgatgtacttcgccgcgttcccctccttcttcttgccctagagcatccacgaaagcagcggtgagaggctccgcgtacaacaaggagaggggtattcggggggaggaggcgggaggaagacggggtgaattaccgcaggccggtagtgcttcggcatggcggcggcggcggcggcggcgtggctcctcggggaaggggagcgggggaaaggagaggccgaagaggggaggtgggtttttagggttttggtttatattgcggcggatggctttggggccttgggttgggctgaaaggctggaacccggcgcggcgctcactgagaagaggtgaagactggagacttgggaggtgggagccggcctgtcagcgtctgcttaacgcttagtacatattcttctcgtaaaaggggattgttcagtcgattttagagagagatgtactccctccgtctctataaaaaaacagacacgctaaaaaagttacgacagttttcccttaaaaatatatcggtttgtggtgcattgaattgacgttaagattagtgctaaaataatagtatgctaaggccgggagtccagcatagcaaacatcttttcttgaaaaaaaaagagacacttctcatatatttatacaaatttacatagtagttacatcccacttacacaccacttacatatataattttagaatttacatatgtaattttaggacttacatatgtaattttgagacttacattgtaaatacactaaaatttcatatgcaattttagggacttataatgtaaacacataccgactattttttcatgaaaaatatggcgccataaatatagctactctcaaaaaaaaaaacctataactatatgtaacatcctacctccgtcccaaaatgtaagcatatagaatctggacacatatgtgtccagattgctatattttggggcggatggagtattctagtatgaatatatgcatacctttgtctatattcattgtactggaatatggcagatctaattctaagtttatttttgtgggacaaagatagtaagagtttgtatcactattttgcaggtaacgtggagtagattttcggtcattcagaagtacattttctctaagcttgtagatttcggtcatctaactcttttataccatgaaggtgacgtgatataccaacaagatcagtgtactttaataccatatcgccgttttcttgaatttgcccttgaagtaatccttacatgagctttttaaaaccatatatgcatatttttgtctatctcgaaccgctagtaacaactagaaaccaaattacgataatatagtcactgctttaaccagttgctacttgtttgttgcaacgaatgaaccagtcacattatgcgggcaactctgtaacgagcaactaacaaccccataagaaacaaacacaaacacctccttgttcgagtaatagactgctttgttatctccgaaattacgtgagaaaaagaacctcggatttattctatgttatagtttttttactcggagttatcaagctccgaccagtaatatattatatacgatctagtatcaataattaacaataaaaaaccataaactgggcatattcggctgcaaggtacagcgttgccttgcagccaaaccgcggcatattctttgtttgttgtatggtgtaacagatggctagttatatagtagcactgtacttggcagccgaacaagtgttggtcgaccaacttctgttggtcaaaaccaacaagtgtttatagaccgaggagtcaccacagcaaagaatggcttacgtcaaaatacgtactctatccgggtgtttttaatacatgacgtcattgacttttagttttatatttgatcatctgtcgtattcaatatatttcaaataggataaaatacaaagtcatgaatataatacacaatacatctaataacaaaataatcacaaaaaaaaaacgataacacagtttttttagaaacatggtatgaacgcagcactcacgacattcacccactcactcgtatgagcaccttctaaacgttggacgacatatattgagattaaccaagtcaccacaaacgtttttaccatcgatgataaaaaaaagcaatatatatttcaataatacgaatctcatatgtacaccaaaaaaaatggtgtcataaaaaaactgaagaaggtacatctttttacatgctatctactcaagaaggtacatctttttgacatgctatttactccctctgttttcaggtcataagtcaaactgtttcaaatttaactaaatttatagacaaaatagtaatatttactataggtgtgtttagttcacgctaaaattggaagtttggttgaaattagaacgatgtgatggaaaagttggaagtttgtgtatgtagaaaagttttgatatgatggaaaagttggaagtttaaagaaaaagtttgaaactaaacccagcctatactaaattagtttcatcaaatcaataattaaatatattttcataataaatttgtcttgtgttgaaaattttactattactttttttctacaaacttaattaactttaaagtagtttaactttttctaaagttaaaatgtcttataacctgaaacggagggagtagtacatttgtattcaaggtaatacaatacgaaggtaatattaaaaggtttgaaaatgataaagaaaagaagggggaaaaaaggtttctcttgggttggacaaggccttatcaaacccggcctgaactatactaccgcacaacacacaaaacgtcgacgactaatgacgtcatcatccgggaccccacctgccagcgagctaactaaaaatccaaggaagcaaaacgaaaccgcgcgccgccaaccttttcgcggcttcactttgtttttcttttgtcttcgtttttttcccgcggcgcgattacgaaaagagctcttcccgccggcgccaccgcccgccgaccaaaactcctccataaacccctctctccccgccattccccacctctctctcccctcccctcccctcccttcgcgcctcctcatccgcctctctctctcctccccctccgatggcgacgcggccgcggtcctccccgtcgttcttcggcggcctccgggcacgcgagctcggcggcggcagggtgccactgccacgcgcctccgcggcgcggctcccctacctcgcggacctctcctcctaccccggcggccgcgggagcggggtcatcgccgtcgagcacgccggcgaccccgccatacctttcgccatctccttctgcaaggtgagcgagcctgggatcttttgtccccccttcgttttcatgcgttttttttcccgattccgacatcgaaagggttaagatttgatgggaactgattgttcgatgaaccctcgcatttttttttcatttcaggcggagcagatctctcaccttctggcggtagctgatgaggacgggtatgttggcatctacgacacccgccggcgcctcccatccagctcatcgtcattggggaaatcaggttcgattggatcccccctctttgatctagttttcgcactgttcgattcagttcgtggatgtctggggccacgcactgggtgtcatgttcgattcgttccggtctgaaaccgtgacattctcgcagctgaaacgaagatgtccgattgggttgcccacaacaatgccatctttgatgtgtgctggatcaaggtaacacctgttactctcaatcattgaaacatgttagagttagtggtataaaagccaatcctcactcacttgtatcatcttctttttggcgttgtttatttaggacggttcccaattactgactgcatcaggcgatcagactgtaagtatcgcaataagatcatttttcagaagtagaatagaattgtttgtttgttctgcattacaattcatattaatgtgatggtggactgccttttgatcattgggattgtttgttctgtatcaggtgaaaatatggtctgtggaaaacaagaaatgccttggtgttctgtcagggcacaccgggagtgtgaagtcgctgtcatgccattcttcaaacccaggttggtgttatgttgggaaacaaaaaatcaattcttcgtatatttgtgcctgtaaaatttgccaggaacttgtattcaagaacttattcactgcagagctcattgttactggatcaagggatggttcttttgctctttgggatctaagaatcgacccaaaaacccctaatggtcaccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcagga

SEQ ID NO: 1497 - DNA, 1781 bp, Oryza sativa
tttcagtaaaaaagagagagagattgatttcccaataatagtagaagtggatggatatgggagaacggcaacagcttgataaccaaatttgacactctctctgatttttcaatggattgtgaaaatactccatatagcaatcctattttccataggaactttaaaaataagcactgtcagcacacataacaactgcaaactaaccatatacttgttatggtggctgggaatatttcgtgatgtatgaaagtatgaaccactgcaatagatggcattcatttatataaatttaaaatatagttgtttgcagagaactttgttttgtatgactactatcattttcttcgcctgtagatgaatcctgcaacttgtaagtgcattttgtcctactctgtgcttttaaccataagataaaccttaatcagaaatcccaactactgatttccttcagaagtgcataaaaacttgtgagtgggttcggttgcattgagaaattgacttctaatgcgacttgcatgcagcagaactgcccaaacttctgccacactgtttggacttcaagtttgctaattttctttttcatttacttgctagggaatacttgatcctgcattttccaagcctcagaaacccatgaaaggatgcgtatgccttcaaaaagttgccaagcccatctctggtactttcaccactgctggtatgatcttggagatgattaaagacgtggaacaagccatttctagccgcaagggccgaagcggcacagcagcaggagacgttgcttttcccaaagggaaggagaacctagcttctgtccttaagcgatacaagcgtaggctctcgaacaagacatctgcaggacaatagcgtggcagcgagctttcttttgtttcttgtttgtatagggttcttggggctgctccacaaagttctgtttttttgtgctcctcaaaccttgggttttttcgatgcacacgatctccagagtgcctgagagcttcttgatctttggtcatttttgcacatgttgtttatgaagtggccaagggtgaatggtataccttgtttattcatcttatcagcgagatctcaacagtagatgatatttgctggagcagcaacattgtaaagttctttttccagatgaacattctgaagtccgctggcttggctttctgaaatctccactagactcgttgttcctttcggctttcgctgttaggttgttactgagaattttctgttggtcagctaagcttgagttctggtccttctggactagacacagtggcacacgatgcagcggatacccatgtgcacggcttatgtccacttgtctgatgttaatttttcatcgtgcttgcttgttactgtagttgttactgccttactggtatcatccaggagtcatattttcgttgtttgcatctctataaccttttccagggaaatgcattgttgcagtctttctgaacatatacttgatgaattcttgagtttccatgtactacgatttattgactgtaattggatggatcctgatcagctaggaaaagctcaggatcagcagagagtacagtggacggttcactgtacagtacacacgatctatctcgctttcgacaggcaggattggtcagggtccataaaattcaggcttctgtgcagctgagctatagtgtcttggacaagggcccccacatttgcatcattgcacgtgccacaatcaatacccccaggctttgctaaagatgctttcaaggatgcaccaacttgggggc

SEQ ID NO: 1498 - DNA, 2288 bp, Oryza sativa
gtggcatggatccaattaaccctttaatcaatgactaattagaaaacagtatccccatctataatatataataggactaggatacaacttgtatcctctgagtgtatacttagttgacacctaatatttggtaaccatatatatcattttaaaaagaagaattatagtgtttgctctaccacccttgatcacatctaggcgatgatgctctatagggatgatttcaagggcggatccaaaaaatgtatagagggagggtttatctcctttctcctccaatccccctgctcttccttctctccctcttcttccccctcccacccccctttcttaatggtgatccagcgggatagagggacttgagtcctccagcacccacgttggatctgttcctgggtagtgttttgtccgtcaccaaacattgctacattacagttttaacatatcacagtgtgttagctatatgtttgctttattgtcacacttatgacattgcaactcgatttttaggctagttgtgccacacagaacgtacttttatgtttttttttcacagtttatctaatttcagttgtggcaagacgccaaccaaacatccaagaagaattcaccacgtttgtgcggacatcaggcacggcgtcctgaaaggacggcctgaattgttcatcaccgggaggcaaggacgatgatgcggcttgctggtaggcattggttgtgtgcccctgctgttgcctgttactcctcatagcctgtcggtactattgcactgggcactggctgctagtctgctacagtgcggcacgatctcctccccgatcttagctacagtaattacccatgaaacattgatatctcgtacaagtctgccccaaaacagccggttcatcattatgggtgccttttctgtccatccatgtttagaagagtcctgcatatgaatcaatatcatcccacttccaaaaacaaacacatgttttatagttattttatatatttaagagcggagtgtatattcggtcctaagcttgtatgggtgtatcatcgagacccctaaacattttcaagtttctatattgatcttcgacatcatataggtccaaacatgttccaatttgctttgtacattgacatggcatgcaacaatattttctacgtattagtgtgacccacgtaacattcatataggaaaaaaaacatattttcttctctctaccttaaaatttttaaaaatgattttttattttctttgtcttttctcctctctatctaacatgagaaaatatgtttttaaattttatttttattttagtgggtcctactaatacgtaggcgccaccgtggcatgtcatgtcaacactaaggatatgtttggtagcaagttttcccaactcatctttctcgtgttccgcgcgtacgcttttcaaactgctaaacagtacattttttacaaaaagtttttatacgaaagttgcttagaaaaactacattgatccatttttgaagaaaaaatagctaatacttaattaatcgtgtgttaatggaccgctccgttttccgtgcacagaatacttgttcccaactaatcctaatgaacacagcctaagagcgggttgatgcccgtttagatctatatggcactaagacaaattcaaagacacgaacatgtgttttgagaatttgagaatttagggttctagataacacacctgtacaaatttagagcccgcaagtgtacttaactaaaatatatacactcttgttcatatcaatatatctattaattattttattataattataaagacaactcgaaaaggaaacaacgtatttgctatgaaggcttgaaaattaccatattaatcgaaaaaaatctaagccatcattagatcgtagcgagacataagtagacactattataactacataaaaacaaaagaaaaaaaatgaacattaaatttaatcatactttcaatatctaattatacttttatatgtaagagttgcataacaaattcaattcaataaatttgtgcgccgcagtttttatttaagtttcgctcacgattaggcggaccagcgagggcgtgaaaagctacgagaaggaaaaaaaaaagagctactagtagtactaataaatcaaagagatgatggcataattaagcagcgtgagctgtgacgtgagctgctctgaatctctgattttatcataaaccacaatcccgggcccacccgtcatggaccatcaaataaccgatctccctggcccatgggccccgccctatcagcac

SEQ ID NO: 1499 - DNA, 3801 bp, Oryza sativa
tcctgcagccctcccctcgctctaatcttcttcccctcaacccgctccaaaattcccccgcctcccactccaaaaccgaaaaaaatcccgcgcggccgcgtgaagccgtgaatctactcctcccttcctccgcgcccgcgcgtcgccatgaatccgcaggcggagggcgatgcggcggcggcggcggcggtgctgggggcggacccggcggggctgacggcgctgctgggggacctgacgtcgccggcgaacgaggcgaggtcgagggcggaggggatgttccacgcgctcagggcgtcccacccggacgcgctcgcgctccgcctcgcgcacctgctgctctccccggcgcacccctccgcgcccatggcggccgtgctcctgcgccgcctcatctccccggggtcgcaggcgttcgtctacccggggctctcccccgccacgcagtcctcgctccgcgcgctcctcctctccgcggcgtccgcgacggggctctccaagtccatctcgaagaagctctccgacgccgtcgccgagctcgcgtccttcctgctgccgtccaacgcgtggcccgacctcctcaccttcctctacaagtccatcgcctccccatcctcgcctccggcgctgcaggagtcggcgctcaacatcctagcccggctggcctcccatctcgccgcgggcttccccaacctccacgccctcctcctctccgcgctctcgcacccgtcgtccgcagatgtccgcgtcgcggggctcaacgccgctatcagcctcatacagtctctcccctctgccgccgaccgtgaccagtttcaggatctcctcccagccatgatgcgcgccctcgctgaatcgctcaactgtgggaacgagggctctgcacaggaggcgcttgagatgatgatcgagcttgcaggtgcagaaccacggtttctccgccgccagctgcctgacgtggttggttctatgttgcaaattgctgaagcccctggattagaggatggtacgcgacaccttgctgtcgagtttgttgttacccttgctgaggcaagggagcgcgcgcccgggatgatgagaaagctgccacggtatgtgggccggctatttgcggtgctcatgacaatgctgctcgatgtccaggatgaacctgcgtggcatgcagcggtgtcggaagaagaggatgctggggagactgggagctatgttttcgcacaggaatgtcttgatcggcttgcgattgctgttggtgggaatacgattttacctgtggcagctgagttgctcccatcattttttgcttctgaagagtggaagagacgacatgcggcactggttacgatagcgcagattgcagagggctgtgctagagtaatgattaagaatctggagcaggtagttggtatggtgctgaattccttccgggatccttatcctcgggtgagatgggcagctatcaatgcaattgggcagctttcgacggacctggggcctgagttgcaaaataaactgcaccatgttgtcctgcctgcattggcttcatccatggatgatttccagaacccgcgcgtacaggcaagttattattgaggatttacacttaagtcatctgctgcacttctttcaatattcgttatcgtattttatagtgtaaactataaagcattggtggccctgtaacccacaagtatcaggctcagaggaacttggaagttaaaaagatattatcttgacatatatgcattctaaggaatgagtagaaattgctggaaactaaaaattatatttaaagagaagttcgtagactgattaaggtctaatgctcaaagctgtcgtacttttaatagaatagtacatggaaattttctcaattatattacatatgtatcagtaaggaatgggtctatttaacccctcaactatcgtgttggtctaatttcaactctccagttatgcaagtatgcaaccttgtaaaacacaattcttgaatatcaatacccaacaatctacaaccctcaacctcaccctagttgtttgatgtttgaagtaccatacaatgtgagtgattatgctagcctatgtgcacaggttattgtcgtgatcaagtttcatgatgcaatgatttagagaggtttgatgagactgctattaatgcctaaattgtttgtagtgtgtcctcatctgagatcacaactggttacacgtttttttagttagtggccattagtttgtgccacttgctttttctttgacatatacttacaattgacttgtcattaatacccatcaagttatcagctagacatgctctaatcattgttttatattccgaatgagttcaggcacacgcagcttctgcgattctaaacttcagcgaaaactgcaggcctgatattttgacaccatacttggatgggatagttgggaaactactgtcattgcttcaggtaatccttgcatttgatcatggagccttcattttgtgcagcataaacatgaaccttttcggaaattttgtttgttttctgatagactggaaaccaaatggtgcaagaaggtgctttaactgctttagcatcagctgcagattcttctcaggtacaagaggaaatatttttgaaggttttcgggccagcattcttgctcaaagttttgcaatcttattgtttcaggaacacttccaaaaatattatgatgcagtcatgccatatctcaagtctatactcatgaatgcaactgacaaatcaaatagaatgttgcgggccaaatcgatggaatgcattagcttagttggtatggctgttggaaagcaaaaatttaaggatgatgctaagcaggtaataatttgctagttgctctgatacattgtaatacgtttgaagaaaatgtcaaagcacactgtataaatgttatttatgacttgttctgattgtattgctgatgggcttatttgaatgctgtttgctgaattcgttgtttctttggctaacatatttctcttgctaggtgatggaagttttgatgacattgcaaggatctcagatggaggctgatgaccctataacaagttacatgctgcaagtatgttgtagcttaaatactattgccattttatgccatcactagtttgcttcagttttgcttattctaattgcattttctaggcatgggcgagattgtgtaaatgccttggtcaggacttcttaccatacatgaatgttgttatgcctcctctgctccagtctgctcagcttaaaccagatgtgagtgtcacatctgctgggccagaagatgaaaatggtgaatctgatgatgaggggtacgtttttgttacgctggcaacttaccataatgttgtcacattcccatgatagaatattgaaattgatgaattgttatcattgtaggcatgatattagtttgttgccctgtttcaaatttgcatgtatttgtcagatccataacagagcatttaatttgaatgttgatatcctgttgttgtctgattctatgatcttatgatatctgtaaaattttgtgttttacctggctgcctgcataaaatgcagtgttgagactattacgctaggagacaagagaattggcatccgaaccagtctgctggaggaaaaagcaacggcatgtaatatgctatgttgttatgctgatgagctcaaggaagggtttttcccatggattgatcaggttatgttacgattttttgtgaactctatgtgtacacgcacgcgcctatgtgaagagctccagctgaaccttgaatctgtacaggttgcaactact

SEQ ID NO: 1500 - DNA, 405 bp, Oryza sativa
agggaggagaagatggacagcgggagagaggcgagatggacgggcaccgccgccaccgtccttgctgtgccgccgccgccgaccttgctgtgctcgacgccgggcagaagaagggagaacgaagagggagacggaaacggggacggtgtttgagaggagacataaaaagggacgggagtggcatggtttcaattttaaaaatttgaagtggcatccagccgataatgcgaatatgtgtggcatttttttgatttgccacatttgcagtggcatggatctaattaacccttgattaaaagtttttttttaaaaaaaacacagtacagatgcaaacacccatatacgcgcagctcatccttgtgaaagtgtacatacgcaccctatccctatgagcaatttcgaaga

SEQ ID NO: 1501 - DNA, 714 bp, Oryza sativa
aatgtcttaacaaaggtaaataggcatggctaaataaaacagtgataacgcgggaatgtaaataaagcggtaatgcattaatttaaattaaaataattttataaactgggattcaatatgctcaaggatgatgtgacttgccttgctcagagagaacggccttccgaaccttcggcgacgaccacgaaccacgcttcgggaacctccggaacgatgaaagctacgcgaagcacacaagcaaagctacaagcctataaagaagtaataacaacacataaaaagaaagcacacagttctttaggttataacaaacattaagagacttgaacgggtcgattcggagctcgtatgaccaagatatgatcatctgaagtttaatgctgttatatggagatttgcggattattataattaagctttgtaattataaaacatgtgtaagcgctagcctggaaaagacaggagggctgcgccgttgacatgcggaccccacatgtcaacctaaaggaccgcggtagaccgagtacacagagacggtccacgggtcgacggaagcagatcccgtgtgtcaaccgaggcgagtgggcaacaaacggactccactagacaccacaccggctgcacccgtagaaaccacgctgctaccgagcgggcacattaacacggtcaccacacgcacaagcgaacgactaccgacaccggtacacgggtacc

SEQ ID NO: 1502 - DNA, 720 bp, Oryza sativa
ctagggttacataaatttatggcagcatattcaggattttattccaatagcgagtttgaagtttgtgcatcatgtttcgtgtctatgctaagttcacaccaatggtaagtttgaagtatggttcatctcttttctatcgagggtactacatgatgttgtttggagattgaagatttttatggaggacactacggaacgggtgcccgatttttggagaaaaaaattgggccccctaagcatgcatgcaatcttttcttctgggaaacctccacatgcatgcacgcagtcatttcttctcttccacatgtgaggtacatgcaaacttctcccatccccttgtctcttctcccatactcttaattagcaaattataaaccattttttcttatgaaatacttatccaatttgtgattcaattgcaccattgaatttgttgcaattaaatctttacaaagagatctcacatgattatattttggagaaataaaacatatgtaattatattactaattgaaacatttttattataagtgggacattgatttgtgacctctaaaacaatacaaaatatacattgaaatattgaaagaacaatacgtgcaagatcctaaatgatctagtgaaacatctgctgaaatgtccaaaaaataccacgtgtaaaatttcaaatgagctagtaaaatacccagtgaaacatcacaaaatacatgctgaaacatc

SEQ ID NO: 1503 - DNA, 153 bp, Oryza sativa
aaagcagaaaaactccggagtgatagcattggactatgtccaaacggctagaaatctggcagatcagtttaccaaggggctaccacgtaatgtgatagacagtgcatcgagggaaatgggcttgatacccacctaagttgcataatagtggaa

SEQ ID NO: 1504 - DNA, 165 bp, Oryza sativa
gatccgtggggcacgccttgttgaggtcggtggagtcaacgcacattctccattttccgttggccttccgcaccatgactggattggctagccactctggatgaagtacttctctgatgaaaccagctttgagaagtttgtcgagctcttctcgtatggcttgtt

SEQ ID NO: 1505 - DNA, 1010 bp, Oryza sativa
ccagattaggtttattcaaatgtagcattgtatgtattttgataatatgttgtcatgtgttgaaaacattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttattttaatttaataattccctcaataagaagaaaaattatcctcagtcaatttcttgaccattgttctacaatcttacttataaccaaattttacttataaccaaatatgacttatgactttatagtaataaaatcccgtaggctgcagcaacgtgttggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaataatatactatcaatgacgactaatttggcagcatacatgcgtgcatgggccagtt

SEQ ID NO: 1506 - DNA, 270 bp, Oryza sativa
cagttccacataaacatcacgtcagtacaaaccaccctcaaaactactaaaggagtcatttttgaatggttttaattattgaaggggtcgatttacctagttttacggttgagggatgcgaatgagatttgacatatatttaagggagtcaaaatggacttttttcgaaaacaaattgcggcagccatggcgtcgactgaggagccagcgcatgccggagggggccgccgtatagacatgggaaggttcaacatgaaggaatgacagtag

SEQ ID NO: 1507 - DNA, 1453 bp, Oryza sativa
ttagtttcagttgaccagatgtctctagaacttctgcatcaacaccaagatcgatctttaatctaaattttttacaacctgttttcaccaggctcatactattgggacaagccttggccttgctggggggcgatgcgaagcctttctcgaggctctggagagcctacccacagatgccagcttcagcgctgccctgatcttgacccacttgcgtggggacaatggcaccgcaactctttcgttgctagaaaactgagaaatgaaattctgtatgagctgatcacatgagctggagtcaaagctgtttgttcttgatggctggaatggagcggcaatttgctgtgaggtttggtcattgcttgataggttgagcaggttactgaaattctcgcctgcagatgccatccttagtaattagcatcaagatgaatgaatcagatgtagccaaaaaaaaatcagcatagagtaattactgttgcttggaggcactaagtgaggttgcatcaaagccacaacttcatctgtatggaggaaattatctggagaaaagccctgtcaacacaaatacaaaatggattagttctgttgaatgaaaagcacaagtaatgtcaaatttttactcttcgatttctatctagacaaaatacatagatttttacataaaaaaaggttcttaccttgtatgattcttcaggtgaatgagatcgctcattatgtgcatactggccaattcgtgtggcagcatgatcagcctggatgctgctatgagcgtttggattaaaatatgttttttcggtattaggtatacacagaggagtgattcttggtctgggtatgaatgttccttgatttgaatgatgtgggataaaattgcccatgcccaactgttggctaaactgcacgttggaggtttgaccctgcacaaatcttgacatatccactgaagcctgctagaaaattgatgaaactatcttagactaacatgcatatgtattttattatgtactgtattttgtatatttcaaaatatcttccttacattagaggcttcttggaatgaagaaaagttctccgttgattcaaatggttgaccagccagggctgaattgtattgacctgtaaacaattggaatagatgaccaaaaatccccaaaaaagtaattatcgctagtgattgaaattctcagaacaagatattaccacaagttgggatctgctgtttaggaataaagtcagtcaacatagaagttcccccacaatggaacctatgaagcggtacaggatagttgttgaccatcttatggtcatactgaataccacttatattcgcataagccaattgcttcattgtttcaactgcactctgtgaacaaaaaacaccaaattattaggaaaatagtgaaaaatctcctgttgaaggaagtgaggaaacagtacctgctctatttcgtcg

SEQ ID NO: 1508 - DNA, 820 bp, Oryza sativa
taattattagcgtatgattaagaaaattagtcattcaccaatgattaattattattaattatttaaaattaaaaaataaattaatatagttttctaaaggaacttctctaaagaaaattttttttaaaagaaacatatcgtttagcagttcgagaaacatgtgcgcggaaaacaaggaagttttcttccctttctcggaacgaacacagtctgtgttcggcataagctggtcgagaggaaaggtaccccagtttttgcatacttcccgaatggtttaattgtgtgtttttaaaaaaaattatatatgaaagtttctttaaaaatcatattactctattttttaaatttaaaataattaatactcaattaatcgtatgctaatggttcaccttattttgtgtatcttctcaatcagcttctctcaaacatttgcttaagaaagtggggaatgacaactcgcagttgcctcaaatatgacaccgctctagtacatcaatgaactctcgaagttatatataaataacattttcaatatacgatgagttgtatgtgaatggattagaaaactggggtggttcaaagtgacacaaaagataaaagatatgtttacctagtccaaagtgaaaaatgttaggtaaaggatggttcaaacggaaaaattttctgtttataaatataaatgtgtgtgtttttatttggtgcagagtctaaaacgttgtacttcaatcgttaaaataaaagataaatgagtcgtaccgtgaagccattgctgtaaccctacgccaactagtcaaccctagtggtctttagggggaaaaaa

SEQ ID NO: 1509 - DNA, 417 bp, Oryza sativa
aaataaataaaatgttatcgcaaccatattaacaataattaaattttaatacgatggaatgagaattaactttaattaaaaattcaaatgaattatataaacaaaatatgagtgatattaaattaggtgaatcttcaattagaataatataaatatggggtaaaacttcatttatacaaaaaattaagaatttcggaatgaaattcatatgagaaacactctaaaatcggtttattggaaaagtgcattgttcattgcccgccacgtgttcgacctggtccccaacctttcccctcccctgccacgcgcgccgctccgcctcccctctgccgcgtcgctcgccgtcgcatcaccgtcgtcgtcgcgtcgagccccgtgccgagccgcgcccgtcccgctgccgcgccggtccccgtc

SEQ ID NO: 1510 - DNA, 884 bp, Oryza sativa
cccagttcatccaagggatccgtgaatatccctgaagatgtatgctttgaggttgaagttgtaccaagaacatcaaatgggtcacttgccatgctagctggcttagacgttgacatggacacattcttatctttagttccaacagtctccctatgattcaaaaaaaaaaaggatgagggaatttatggtaacaaatctgtatatgattgacatattttagattaaaaagatccaaatcattctttaaacaaagcaatttcagaacctcgtagatattcttcttgcataactcactacatattccatcactataaagcgttatatttgaacctaaggtaatttgcaatcaaagttgtgcagcctatgaacctaccacatccggtcattaatgcatgctgaacattctctatgaactatgtgcaatttaaataaaccataataaacctagcatacactgtattatccacataacgcaatatagaggccaaagcaagtttgcctgagaaagtgcactggtatctttaggaaagtagggaatgcttataaaaagcatagcatatgttcctaggcgtttctaatagtaaaatcgaagtagagcccataaaattcacaagatgcccataagtttatccacaagatgccattgatattcaatggtcaacacagatcatacctaatggaaaatagcctataaattcaattaccaaatagatttgaagatataagccatcaatgaatttcctacctcaactggtataagttaccaattcaaacaatcgcacgtgcacattaacaagctaaaatctaagcaaatgcaacataaattagatatgggagtccataatttgtccaactcaactgaattatcacatggtttctcgttg

SEQ ID NO: 1511 - DNA, 525 bp, Oryza sativa
agaagccttgacaagcaaagataatatcactcgcactttatgaatcctttcgccggagacgaagaagatggccaacaccaatgcaagaagctcgccagagaagaactgggcggccggcgcaaccttcttcttcttgggctagaggacaagtctccaaacccgagcaaatcagcggaactcctagttgtaggcgttgaaggggaacccagcaagtacaagagaccccgatcgatgagaatgccggtgaagtcctccatggccgcaagccgggacaagaagagcgaaaatgccggtggccttcttgagccgcacaacgaacgtgattaacccgactatgggagagacccaactaagctaaagctatacctattaaaggagaagccggacaccctcccctcttactggcgaccggagagccgccggattccgaaaggaagaggacatgaagaagcactagtatgaaatcgtccatctatgacgttttgctcgtgacgctatataatttcgtattgaacagagcatatc

SEQ ID NO: 1512 - DNA, 645 bp, Oryza sativa
atctgcgtaagggtgaggaaccaattttaagtctgttttcacgcaccggatttttcggaatatttccaaaacaaaacaaatccgaattttctcggatttttcagaatatttccaaaataaaacaaatccgaatttcacacagcaaaacataactgcaaaagcaggctgcatctattcgatgcgtacgtcgcgcgccgcctgcccggcccggcaagcgagcaagcgcgtgtgttccccctcttctctccatctcacatacttcaagtggctaggagggcatcctccctaaggagatccctctctcctagaataagtaaggtggtactaaactcgctatgcatgccatcgcatgtggtggacttttctgatttttcaaagaattaaacttcgagtgggctaaggcccatctattaattccaacaatatgttccttacaacctacataatgtttgagcttgggactggtattgaaaactttggcttgagccaatatggatattgatttgtatttatataaaaaatgacatttatctcattagattttgttctcactttttgccaatattaataaaattttcattcataccctggtgttctcaccccgaagcaaagtctccactgggtcaagggatagcgagttcgata

SEQ ID NO: 1513 - DNA, 544 bp, Oryza sativa
aaatgtgagctcaagcgaacattcccagctcgttacaggagctttccctcccattctcttctcctctatatcaccccgcaaccatgcctctcctccattgtttcctccaccgatggctccttccacgagtctcctctcctggtcctcctccgacgacgacgacggcgccggcgccggcggcgagctgtcccgccctcgcaggcggtggcgggcgcttgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggcatgttcctccccttctttggcaagatggttcagaaagtggtaatgattttcatccaacctactagtatttattacctttccttcagggagtggtaaaaaaagccatattttttgaagttttttacccaattgtgaatttacac

SEQ ID NO: 1514 - DNA, 683 bp, Oryza sativa
cacggtttacccttcaaataaattttctaaaaggataacatttatcaaaatttcgccaaaacatacatcatgtctctcatacaactactctctccgtttcataatgtaagactttctaacattgcctacattcatatagatgctaatgaatctagacattattatatatatagattcattaacatctatataaatgtggataatgctagaaagtcttacattgtgaaacggaggaattacaagataatctaaaaaaaagaaaaccatatagcacagtgcagttaatctaaaagtgcaatataatctaaaagtttgacgacataagtgcagttgcatatgaacacttgcttgcgtacgtgcatggttggtttgagcgctgtgaacgcgatttgtcaacttcaacttcaaattaggggactaaacgaggaacaaatcaagcccacgagacgacacatacagtaatccaaaatccaaagtcaatcacaaggccggccagatcatcaccgctgtcgtagtcgtcagtcgacgtaaatcgttctctccattttctgcaggctgcagcttcgcctcttcttccttttttgtagactgcagcctagatgaagtggacatgcatcaatagaacggacaagagcaaaagttttgaaattcgaaccattcttctgcaaaacacctcaagcttt

SEQ ID NO: 1515 - DNA, 359 bp, Oryza sativa
atagtgaaggtcgtcaaagaggcatctgatgctgccatcactagctgtggaaatgtttcgacatagccgaggaaattctcgtctgtaagcggacatcgtcgcaaggcgtcgaccccctcggtaatttattttgtcgttaaatcatgcagcaagaaggatttttccttactttgcgttgattgtctttcaagcctcggacgcgtctcccccacctccacgacgacaacgcattgtgacgattagcgagaagtaagtagatgaattcttgaatccccgcgcttcttattcgattgttgtctgactcgtggtcgtcctgtagggaggcgcgggcaaaggctgcgcgagccaagtccggatga

SEQ ID NO: 1516 - DNA, 690 bp, Oryza sativa
tccagtggcatgtagccgatatgacgaatagtagtgatattttatttaatttcataaagttggagtggcatggatccaattaacctaatttgtttaattgaaatggtatgtatttatttaaaagctttatgtgaagtttgagtggatctaacgatccccatgacatttgatgtcttcactggaaaaagcatttttcagacgcccaaaccatccgcatgtacctaaacgcctacaaaaatcatcaatttttctaggcggaccaagcacctgcctacgaaaatcattcacgggcaaaaacacaattttcccaggcgatagcggccccacctatagaaatagttttggtgcaaaaaaagaaaattcgccaccaaaccagcccgccctcgcgtttcacccacaaataaaaaattcttcatccattcaacaaaatacaatcacaaacatccattcatcaacacaatctatacatgaacacagatacagcggattcaaatccccacaacaccgatttgcattgcaacatcaatcaaaataaaaacaaataaaaaaacacagctctgtggcctcctccctgccgccctctactgctcagaggggagggccatgccgctgccgccggtggcctctccccaccgggcggatctgagaggaaagagggaagggaggccgccggcctccacccgtccccct

SEQ ID NO: 1517 - DNA, 579 bp, Oryza sativa
tgctctaataccttccaatcctatatacgtatctcaatataatttgcaccattttcatttccagatcagctcccaatcctatacatgtgtgctggtgaactgtaaaaccgtcatacagaaccccgaaaatatatcggtgtgaggatgtttatgattttggtctcactcatttcacctgcctcagtgtctgtatatatatctcttgagagtaaagttccaaagcatttatgcacgtaaatgcaaacaaggtttaaattcatcaattcaaacttgattcacatcaataaaataagagcatacatgcgatggccgatcagagcaaatgaggcgcgcgatggagaaaacaaaaataaaacataagtggggagatggaactgcgcggtgcggatgagggggcctcagccactgggccatccccagccatgcacctgggccttatccacagatcccctggcccattaggattggcctctgcatgtgaaatttaccattatagtgtaaaaatggcactaaatggctcttctgctgaagtttagccttcttttctgaacctgtttattacgtgggtgatacgaaaac

SEQ ID NO: 1518 - DNA, 765 bp, Oryza sativa
atcgatataaatatgagaaatgttagagcaatcatatgggggagtaccgtcttacagtacagtattagactcagtttattgttgatatagcagaggatccacatcccctattcttttttttagataatgacatcccctattcttctgaagcagaggatcaaatccttcaatctaaacagttactatttttatttttatttttatagagactagaaaaaatacctgtacgttgtaacgggtgaaggctatgttaatcttattattgctatactgtttagttaatgtgaaatttactgtggaaattcgcttagagatatattttttaagaaactagcaaaaatgtccgtgcgttgcaacgggtgaaaaaattctaacgataatttatttttttcatacataaccatgtcaatgataatgtttgtatagattgtttatagctaagacaatcaaaaagttggaacatcttcaatgtaatggcccaacctcaacgatgacaaccttaccgatgcctgctttacctaaaataattggattatccacgtgacagcatatatataatctaaaatactctttcaatcttattcttgcaaccaataataggattaatcagatactacattacctcgcatggtcaagtctacacaaaatagagtcactatgcactcttctctaaataacaattaaaaatatgtttatttttcagtattatttctatatcatatgttatcagaaatattagctatacttaacaaaaatagtctaata

SEQ ID NO: 1519 - DNA, 317 bp, Oryza sativa
tcgcccttcatcccgttcactggcggcggcgcctggttggtggccgtcaccacgacggtcttcccggaatcccccttgagctcgtagcacgcgccgcacccggcgccgttgtcgaacagggcggggctcaccgccgccgtcatcgcgccgtacccgtcggcgtccttgtacccgcacgcgccgccctccgtcgtgcccgacgcgtcgcgcccgccgtagaacgtcgcgtgcccgtccacccacggcccgcacttgtacctgccgtggttcacgtgcggcatcttggctccgccgccgccgccgccgccttcgccgtc

SEQ ID NO: 1520 - DNA, 1975 bp, Oryza sativa
  unsure (1)..(1975): unsure at all n locations
aggtccggaatacatccaaaagcagaaatagataaggcagcagaattcaggcagcggcatgccattgccacaggcaacgaccatactaagacctactggacgccttcgtcttcatctccctcntgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccatcccacacaagttaagaatttagagtctagccaagtgtaatacatgtcccggtgctcaataaccgtgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaggccctcatgcactctaggcgtacacagtttctagcagtgagaggagttttggcgctcccaagggggaaaactcacgcaagcctaacatcgcattctgtagttgaacccaatccacgctgtccccttttgggtatctccttgtagtcttgtagtcttgccaagtcagtctctagccatccgtatcgggtatccgccatttggccatccgtatcgggtatccgccagcagactgcttgttcgtccacacacctaagtgaaaccactatgcagggatactgcctccgctcggctatctactccgctaggtctatacccattcgagaagtacggctgtactgaggtcgtttcatgtttaacttcatggctcagtccttaactgaccagggacggcactagcctttaccggacaccacccaagtcctccagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattggggatcaacatgttcaaggaatagggatgacttgccttgctcgaggtcttgcgggtcttggccttcacctggatccgcggctccctcggtctctatagttacgtgcgaaaattgatttgaattcggttagaattcaaataaaaatccaagtaaatccaaatggaagtcaaatgcgaaagtcaattcctttttattaattttactatccgcgaactatggcaaaccccaattttggtttaaattattttgcggttacaatattttgttgtcgtatgttttaatttaatctaccctagcattatatccatatattaggttagaaatttcttatcgcgagctaaatgtcggacggaatcctaaaattatcttataatattatacgactcaatttagtctatgattaaatataatacacggctaacaccctagtaattaaatccgaatcgctaccgttgatcgattatttatagagatttcccag

SEQ ID NO: 1521 - DNA, 236 bp, Oryza sativa
tggcgaagaagaacctgatccagatcgccatcccgatcttcatcgagctgaagcgccttctcgagagcaagaacagcccgctcaccggctgcctgatggagtgcctgcggaccctgctcaaggactacaagaacgagttcgacgagatactggtggcggacaagcagctgcagaaggagctcctctacgacatgcagaagctcgacgtcgccggcaagggcaaggccaaggccgca

SEQ ID NO: 1522 - DNA, 944 bp, Oryza sativa
tttggaagtaaactcggccgtccatctccgatctataatactccttccgtccctaaatatttaacgtcgttgacttttttaaacatatttgaccgttcgtcttattaaaaacttttgtaaaatatgtaaaactttatatatacataaaagtatatttaacaatgaatcaaatgataggaaaaaaattaataattacttaatttttttgaataaaatgaatagtcaaatatgtttaaaaatatgtttaaaaagataaacggcgtaggtacggagggagtgccttcctttccaaggagccgaagccgacatcccgcctgccgccagtggctgcccgcttacacgtacgtttgtaggtgccctgtataggctgcaacctgcaatactgttaatggctttggatcacgttaatttagattgccagcagcccatggagtgatttggactgtacatgtatgaagttggttcagatgctgacgaacaagtaataatcacactttttctttgacgacctatgtcgacgggtgatacccgtagaccggatatagagggtattagggtacgttggtacaagcatctacgtagtacgacatcaagcaaacaaaaaataagaattatactggttcagaccccttgataggtaataaccctaatccagttgatgtgggattatatggtagaaaatacaggttacaaagggaacaagggaacttgtcggatccggcgagattatagtcgagttgtttcgactagctctcgatgacttggctcctcgtaggctctggcttcgtaggctgtataggttgtgttggctctgagatttgatcccttaaaccctccccggggggtcccttttatatcgcagatctggaggtctccacgtagaactcggagatacagaccctatacgatacgtcaacgacccaattctgcccgagtaggattct

SEQ ID NO: 1523 - DNA, 208 bp, Oryza sativa
gtacgagacgttgtgttgcgccttagcgatcgatacacctctccgtgggttgttgatcttgctggtgcagatcaaccctattcctgcaagcaaatcgaagaaacaagcaagaacaagataaaagcgatctgatattgcaaataggaatttaatacaaatgataagtgggggttcgaatacaagcagacggacggtgtagcggacacgc

SEQ ID NO: 1524 - DNA, 647 bp, Oryza sativa
agtggcgctttagctgcaaaatttatgtcaacattagacagataacacagaaaggggtaaatccttcagaaaaagaacttgagtgcttgactttcccaagaaaaaagaaaacgtgtggccacaatttttttcaaatttcaaataaaaaaaatcaagtaaaagataaaacagaacgcagggtaaacctttcaagatgttcccaaaaaggaagtctgccaaatgccttatcttctctgactcatcaactaaagatggcaggaaccgaaggaagagcacacctctccactttacatagtccctctaaataaaagaaaagtttcaataaaccatgatccaaacatgtggaagtgatattaagaaaattattagcacctgcagcaactttgagagtaggataaatgtttgcctcctcactacctcacagggatcacgcaacgattttgttatttttgacatataactgcagagtgaataaaaaggggaggtcagttagaagttgaactattttaatgttttccctgtttcccacgtgcagtttaactgataagatcttaatcaaacagtaaagcagttttacatcttttgcaactgaagctgtaacaaagataaacccaaattttgtgaatattgacagtatgtgctaattt

SEQ ID NO: 1525 - DNA, 356 bp, Oryza sativa
atattccgttagcactgtcattgttgtcgagagagagagagaaagtacatcgaccagtttatacgtcagcgaagctctccacgacgcaaagacaagatacccatagatccaaaagctgctttacgcagtcatcatgacatcaaggaagctacgccactactttcaagcccacagagtcacagttgtctcctctttccctcttggcgaagttgtgacaaacaaagacgttgtcggccgcattgcgaaatgggtagtcgagctgagccagtttgatgtccactttgtgccacgaacagccatcaagtcccaggtactcgccgacttcattgccgattggactatgccagataacaaat

SEQ ID NO: 1526 - DNA, 707 bp, Oryza sativa
tgaattgctccttcatctccggccccgactgtgtcgacagtggccatacacgaattgccaatatccaagccctggtatgccacctaaagctagacccagagataaaaaacagacgcaccttgtccacaaatcgccccctcacagcaaaaacagcctacgacttaagcttcttagggttataggatgaccttttcgctaagcccatttgggacaaccacgctcaagtcaaatgcaagatcttcctttgtactacacacaagaggcgcatcttcaccaatgagagacaagctcgatgtggattagtagcatccgcacgttgtcctttttgctcctctgttaaagatgtggagcacctcttcctacgctgcaccggagtggcaacaatatggcacacctttggcctggacgaacaacagatcgcctccctgccgcagcttgaaggtgtctgggacatccctccacccagacaacccgccactccacgagtctggcgctctatcctccttgccgtcatgtggaatatttggaaacgacacaacaacaaggtcttcaattctcttgatgaacctgctaagttagttctccggcgttgtgctagcgacattgacatttggtcccatcgatgtaaaaatgttaagagcaaacaatagctccgcaagtgggccttatacctctttgtaattaattcttaatttaattctccccct

SEQ ID NO: 1527 - DNA, 587 bp, Oryza sativa
atgttcaccttgattcagattaaagacaccattaaaagcactggctagatcaaattcttcataaaaataaatactccctagtcccatttccaatagagtaacatgactagggtggaatgcaatgtggcatggtagatttcagcgtagtgccatagtggatttacaaatcaagatgattaatgatttagtggtttttacaactaaattgcagcctagtcctgaccacaaacagagtacatgatttgttgctatgtaataaatctattgtactagactaaattttgcaattgatacattaaatgattacctcactaaggttcatgtcaaaattttcaatccgtgtgagcaagctgtgtgcaagttctgctgcaggttccacaggcagctccatggaaacatttgaaatagtttgcaagagtgaaacacgatccacagcccataatgcagaatttggttcccctttaggacgaactttgcctttatcttggccaacattatcaaggagtttccagtggtgtgagaggaatttccagttaactgatttaggtgcaaatgatgagacctcagaaagaagccaccatgccccg

SEQ ID NO: 1528 - DNA, 1186 bp, Oryza sativa
  unsure (1)..(1186): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcggacccatgtgttaattgaaatatcagtagacttgctctgaacagagagtacatcagccacctctcttataggcaccagagttacttttcttgaagcgaagatattgcgcacacctttgcaagcctgtaataaattttagttcccatcacatagcaggaatattacaatgtcaggtcaagcaccgtacctctttgacatgggcttctttatatgcttccacataaatgtaattcttcaggtgatctaatgcaagaacagatttaatctggagatctggcgtatcaatggacttctgcatcaaacaaatggctgtctcccgttcatgcccaatctgaaaatcataattggatatcagtgagcatcaaattatacagaaaacaaattgtggagcagaacattattcgatagaacctgcaacataccgcacatttcaccatccaaagctttggatccttcaccgatggcagaagagcttgctgttcaacctcagtcacaccatcgtcatcatccacaaaatgtgatgacggaattatatacctgtcgtgtattagcttcacaagtgcatccacgtcctcctcttcatccagcatagaagatggatgccgtctagagcttcttcccacatcttggtcagggtcgtcagctcgagtatcatcaataaagcctaccaaaacatgaaggaccatagctgacagcattaaaacacttgaacttgcttttggatattatatattcaacacaagatatattttgacaatgtgaatctgataataccaaaaggaaggtaacacatgttagtagtcagcacaagta

SEQ ID NO: 1529 - DNA, 7722 bp, Oryza sativa
taattatgacaaaaatcccggaatgaatataaacttttgcctccaactgaagttttcacatatcgctaaacagaaatctcgattcttattgccattagatgagactaaaccaccacaaacaaccatagaactgcaacaacatggaatcaatacgaaattgaccaccaaatttaatgaatctacacctggaccatttcgaacagagttgattatccagggtaaccgggaaggaactagcattgaaattgttggttcgctcaacttagcgcttaattaacaaacacaaattctacgtccaatgactcagctagcagaaaccgaaacgaaattgctgatttcgctgtgcttcgtaatttcggatttgggaaatcaatctaacgattctatcacggattcacagttcaaacaccagtgagaccaccaggaagcactcaccgtcctcgaactcgccatcctcctcctcctcctcttcatcgtcgacctgagccatatcgtcgatcaggatggacgccctcttcctcttgcgggcacggccgccgccgccacccacgtagtcctcgtcgtcatcctcctcctcctcctcatcctcatcctcactggccgcgtcgtcgatgaagctctctacgccggaccacttcccgccgccgccgcccccgcgtgaccgctttccgcccctctcctccacctccccctcctcctcctcctcttcctccgagtcgtacacctcctcttcatcctcctcctcgcggctgccgcgcgacattgcggaggctagggttccgcaccctactctcgcgagtcgtggcggcgtgggtgcgcgatgccgcggagcaaccgccgagagtcgagcgcctagtcgcgcgtggtctccctgcgcggactccgcgtgtgtgatgctgtgcgagaatgagggggaagcgtttcgatcgattgctcggaactcggaaggggaggcggggggtatttattggggcggcgagcaaccgcctcgtagccgtaggctcgaggagggcagaggtgctggctgggttgggccgggccgaagtcggtgcgcaaaacgggggaggaataagtctattatgactctctttatctctcttcttgattgaatcgcctctcaacagcaaaactgaatataatgtcttccccatcttgaaaaaccgatacaaatcaaactctttcgatgatttaggaagtggttcctgtagacgtgatatgttaattatagttgactcgctgaatcagctggttaaacccacctatcagccactctcctctctttattttcctctctcctctcctttccatctatctcctgaggtcggcagcacatatcccgccaaggagaccataagtaatcgatgttacacgccccgttggtggcgacgcaactgcagagccctggggtcaaccagccacatcggcagaaatcgttttccaaaccattgaataagtcgatttacactagttttaaaaatgagggagatgttatatgcagttttaggttgagggaggctatttaatcacgagcaagagcttagagaagtcaaatagacatattctgggtggacaggatcgagggattgggcacgatcgcacgagaacagatgcgtaaagagtaaagaccgcaacgggctaaaattattttgggccttctcggaaagtaaagaacgaaaagatgtgattgggcttcgagccttggcccatgtggcctgcatgctgcaacgcgatggcgattccaaagcaaacccatcgtctggtcgttgccgatgtggagatggaagatgctgtcgcaagcggcacgccggatatgcctttcgaacaaacaacggaagcaggcgcacagctagtcagctatctggtgcacaacacgtcaatacacccggtgagcaatttatatatatagttgttattatatgaactacaatatggtgagttgacaaaaagacccaatacattaattggttgatagataattttatcacggcaacgttggtagatcgatcatgaccaccctaaggtccaatacggaacgaaaatatgaaatatgtagttcaatttacatactacaaccagacaagtcaatgtattaatgggttgatgaattataagcattaatatatcaattattgccaaatttcatagaatgttaaagcttgatttcattgttgattttagggcctttttgtttacccctacaagtatgatttaccctcttaaatattttaaaccccgaactattaaatctggatgaatcatggcaacaaaaatatcagctcattatgcctacctaccagcctatctcgttattctttttcttccatgacgcaccaacccctccttggtgatgtcctagttctcgacgccccaacctactttcctaggcaatgccctagttctcaacgctccagcctccctccttggtagcgtgaagccatggagggaccttgataatagcatgtgaagttgtggtgtgaggacggttcaatgttttgccctctagatctataccacccgctcaagtttcacctcattgggtccccgtacaatgatggaggggatgtgtcttatggatgggatggtgaggttggcattgaagcacttgattcggtgaatgagaaggttgacatacttgatgcataggtgagcggacacgatttgatctccttgagcttgagctgtcggtgtcctcccatatgagcttgcccgccaccatccttcatgagcttacgagtcatcctctcactcgccctcccctcctttaaaatagcaccaacgaacttccctttcatcccctcctagacaagcatgtccgccaccgtcctccactaatttgcgccactatgcatcctctgtcactcccatccccataaatggtagatgggcttccccttcattccctcctagccagctcggaacgtggtcctccacaaggtcgtgttgttctttgttgctcccctccttcaaacaacattaggaggttttccctttctcccttttggccctctcgtcgctcgaattacctttctttcattgatcgaaaaaagtaagtggaaagaccaaggtggtggcaggaaacagaaagaggacaacagggaaggaggtcgtagacagcgacggccctatatttgatcgagcgagtaagaaagatagataagagggtaagaaaactaataaaatgcgtgattaggttgccatgtaatgaaatcgatgtcatatgtttgcaacgtaatattaaaactaccacttttttttacgcatgggaaggggtacggttttggttcgtgttgatttaatagctcggggattgtcaaatttccgatactctagtttaaggggatagataatacttttatgataatcgaggagataaatcaaatccttttctttttatcatggtctgttttttagatttggttcatacaaaattatatttttcccataagagcaggtacaatagctggatattagccagctataaacatattttaatgagataaacgatgagagagaagagcagcgggctacagatgtgtagccagctacagcacggactccaagacacaatgtatatatgacatgtgggaccatatattaatagtatagaaagcaactattatatgaattggctattagattgattatagatgaattggagttaatagtgaactatactattaaacttgctctaaactacttcatccgtttcacaatgtaagtgattctaacatttttcacattcataataatgttaattaatttagatagatatatatgtttaaatttattaacatcaatatgagagaaatgctagaataagggagtacttttaattagaccgttcatgtttccacggttagttccttggatcttgtctgaacggagtagctccagcttgttttctccaggaggccacgatcattgatttatctatgatcaatctgggcgtacaggccaataatttcacatgcaataaacccgttacacggtgctcgaggcgtcacgcggacgccgttcctcctttgcatgtggcgcctagaacctagagccctccgtgcacctgtccgaacacgaaacaccacacgtcatcgctgcagtaaacgccatcattgcagcacggtccacgtgtcaccatatcatcggtcgcacaccatcgccgcgtgaccgaacagccgcagttgatcccctgagtgccccactctggatttcgataattacgtatatgggtcactcgccttactccacgtcggatgctgcagatctcaccgacatatgggtccaatcttagtgggccccacacgtcacttgcataccagtggcgtcgggtaggccggcacgtagtatttgtctcccctttgcttcgacgcggggaaaccagaaatgcccgaagcggatgacgcggcacgctggcttgtgggagcacacaatctccgggcccacctgtcagccaccccccgggtttcgtgaaagtccgcgccatcaacgtcacccccacgccgaccgcacccgcctccggagaacaaatccgggcacgctgacaggtgggccctgctcgtgctcgggctccacatgtcatcgggatataaatatccgaaccgtctcatctcacctcggaagcaaagcccccgtaccggccgttcggatggttggttggcttgtggcgcggggccccgccgcgatccggtcgccgcctccaccaccacgccgcgtcaccggcggcggagcggcggagagctagccgcgcctctcgccggagcagcgcgaggcagggtggggggggggggaggctcgtggtggtggtatttgaggaggagccattggtgattgagcgccgcgtggtggtggagagggggaggtaggcggcgtatttaccccaccgggggtggccattaactctggccaccttggcatgcggataggcatcaccatgggatgcctctgacctctgcgcaggtattcgacgagatacctctgcaaatttttgcttgcgcctttgcctggattttgtggtggcctctgatctcccgtttgatgtggaattttttgcgtgttttcgcgtatgtggttcagggaggtggtggagtcggcgtgatggagagcggcgggaagcggcatttcttcccccttacgagcttgcaaatcgggtaagtctccttctgtgtgcgggggctctgttttgatctcgcggtggaaacgttcttttcattgcttttggtggaatgttccagtctcgtataatttgggtgctaatttgtgtggtccacaatgcaatgtagtcccgttgtgatataagtgaaaaaaacgagaagttacgagaaagttaactggataacttcgatgaacacggttgaagttagttacgcttgtttcccaaagggcagtggaaattgatcaaaactacaacagtcgtttattcgtttgtgttacttggtggaggaagttccagcatactgtttatgagaaaaagacaggaaagctcacttgtgggagtgggtagctgaattgtcttgtattgcttcattctagtagcatttattttgttacagaatactgtatatcttgatgagagatatgactaaagttagtaggagtagaaaggaaagctgttcttggaaatctttccaatttaaggtagtagatgtttccagtgtaaaggcacaggatcgatactatactggaacggttcaataattcagggtttgtcatttctccctacatattcatgcagagatgataaaacaaacttactataccatcacgttgttgtttgcaaaacaatctaggttttattcctaggtttagttgcctatcgtaggttgataattttgtgttttgtgcacattcatcataccttatcgactggaaatctggaattgtggctttactttacttctaggttcagtaggctgcaatacatgactccgtccgtacactggaggaaagaaaatgttaaatactgtgttcctgattaattttattttgatctgctattgtccacctggatcatatgatatcaaacagtgaacaatgtggcggttattttatcctttttctgtacatccattggactgcatttgttgtgcaaagtcgtatgaccttaagttgtattgcaattatcttaatttctgaggtgggcaattgtgttaagaattcttgcaaactgcaagttttgttttactcctcacagttttgcttgcatttactaacctcatgatcttaaagtgcaatgtaaatttggattttcatctatattacagttagttagtctgatataattattatatgcagggatttacaatcatatcttgctgaacttactatatttttgtgccctcatacgaagaagtttctcatattgcttgataaccggccatggctgcaagaccaggacacaaaacctgctcacctgtggcaattgatggtcacaaaggtatgctttactgttttacgagccacttgtaagcacacaaacgagtacttatgaatatttgttcattgcttacactttcatgtattgcccttgttacatcgattctggctcgtcttacttgttgacttcttgtcattttttgctccagtcaagactttcaccttttgcaaacactagaactaggagaaagggagatgaaactgggaagaaacttgtattctctaaagatcctagacatggttctcatttgtggaatccatcatccagatggtataccttaattgatgatgccatgcggaataaaaagcttcatgtgaataggctgaaggattctcgcctgctgaacaaggaactgcaccgaaccttatatggctttataatttttgaggtagactgggctgatgtgcgcggcatgaactatttcaatgaacttcaggtattgttttagactgaacatgatattcatagctattaatggatggtacatgcttattttgtttttatgttgttgtagactgatacttctatggcagtggaagctaaaacaatgaagagatgggaatttgagagtgtcaaccaagcttcatcattaatcacttcatggttttctggaaattactctgaatgccagctcctacaggattatttgaacagcatctctcctaaaggtaaaggcatgaatgtgctctccattcttctctgctgcatgtgcagaccacttatatgcttgctgtacaggaaatgtgttttatgacgctcagaattatttctcaacacctgaaggggacagtgagaatgtacagagtgatgatgacgattctggacctagtcaatgcatgagagagtcgtcaagttttacaagctcctcatacacaccacctccttgctctggaccttacaagagaagaaagataataagatctgatgctggaaataatatgtctgaagaatcatattctgaagttgtgacctcaccaacacattcatcatctccatcttcctcgtgctgcagtgatgatgattgtggcaagactctgctcgagcctagcacatataaggatgtgttgatcttattccggttcgatgaccacgatctccctttcagactaaaagaagtaatactttctgatgtgaggctgttaacattgctagagtatggccttccttcatgggtcatttttctccagtcatatccagtgttctgcaagacatatcgcccatggatgtgtcctcttgccagggcattgtatgtcttgatgtcaatagtgtactgttctcataggattttatga

SEQ ID NO: 1530 - DNA, 1116 bp, Oryza sativa
ccctgccgctatggaacctttgtgctgaaacagtaggacatctgagctcagttatcatgttggcgatggagacttcatgcagtgtagttatcagtacaatgcagatgattatatggcctttttggctggtcttcagtgttgtgcttaatgttggtatgttttctgcaacctctgagacgatatgtctgctactctgctcttcaatttgtattgacctcactatgataaactttttgtgttgattctgatatctttctcttttgtattaacttcagcaaattcagtcctgtaccctttcgtttggcttcttggagaaattctagctgcacctttccggcttgttgttgcgatagcaagttttgtggcagactcttttgtggacattgttggagttctgagggagacctggtctacattgagttccttatatcaagttggttctgcatccggatcgaccggacttgcatctgaaactaccatctgggggtcactatggaaagatcttctgtaccaggtaacaaaaatatgttgatgcggccagtaattatattaggaaataggatatatggaacttactttgactttctttttcagattttccgtgcgattcgaagcattctgtatggttttgttgccttcttttcaacatgcaacaggcatcggcttaggtaaccttccttctcatccgtatgtggtagtattttcaaggtcacatgaacattaaatatgaaatcaggtatatacagaaaacatctcgtattgactgtcgaattagaattttacctgattaatgcctcatctaacatgtcattctgttgtgaacttcactggtactctggtagtgatttagtaacatggtcgagtggttcaaaataaataacaggattatatagtgtttcaaagtttacattatcacttcatgtgtgctgtgtgttaactactacttcatgctgcagcatttacaaccacattcaagtatttctccgacgcctatctcgtgttttaactggtgcacagcataccacctcttgtgaaggcacacggaggtattctagtcaaaatcatcctgtaagtccttacttttttaaaaaagttacagtctatcatgattttttt

SEQ ID NO: 1531 - DNA, 11239 bp, Oryza sativa
tgcgcgggataaatagagatagccagtcgtgagctgaaaaaagtgtgaacaggaaacatttactaacacagaagcatacccggtcgactggacagaccttcaaaacaacttgcttggaattggaagagtcatgtacaggtttataccgaatgtttcatcacatagctttaatcatgtatcctatctgtaccagcgggcaagtagtgaaacaaaacgccgcaattgtacatacgcagaatctgttgtttgttcattctaatggcttgtatagcagcctagtaggtttggtgcatatcctcccgaaatgttcctctgaacaacaattttgtaattacatccgagtattagctaaatagctaagcatcaatttccataacacggttgtccaatcttttgtcttaactgtgtgtggtactcagtttcacattttaaaaacatcgttgataatcggtttcccatccagcatcacaaaggaatcgaaagtcaatactaatgggcctctacacagtaaattcagcatatatacgtttggtgggtcctcatatgtgtttgttgggtcctccagttttatcattccaaacttagatcaatcctcatcagttggaagggagagaataatctgatgtagcaagacgttttaaaaccgaattcttcagccagggtcacctttttatattcacctctctttcatcagatctcatctattcttcgccgttgtcatttcctgctgctgcacatggaggtggtgtagcatactagtagcatgcaattcaccctgccgcgtcaccaacggcacgtggggttggtgaaccggtccatgtgtgcaatagtgcaagatccaggcttgattccccatcctagccgaacggtgaaatggagcaaaaaaagaagataaggaaaacaaattgcagaaccagtgtcaccactgggggtgtgtttagtttactccaaaattagaaatttagttgaaattgaaacgatgtgacgtaaaagttaaaagtttatgtatgtaggaaagttttgatgtgatggaaaagttagaagtttgaagaaatagtttggaactaaacttggcctgagaccgggataatcctaagggccgagtttagttccaaattttttcttctaaatttcccaactttttcccattacattaaaacctttttcctataatacacaaacttctaacttttccattacatcattctaattttaaccaaactttcagttttaacgtgaaataaacgttactgccatttgtggccgtgaaattgttctgaactctgaaggtgggcactgaatcagcagcagtatcaatagtatcatatcggatgtatttgatgtcctcttccgtctgaatctattgactcttttgaagcgccgtgatctaaagtaggcagctcagagattactccctccgtctaaaaaaagacaaacactgggtttccgtgtctaaatttaactgttcgtcttatatgaaattttttatagttcgtatttttattgttgttagatgataaaacatgattaatattttatgcgtaacttatctttttaatttttttcataatttttttaaataagatggacggtcaaatgttgagcatgaaaaccagggtttgtcttttttttttagggcggagggagtatgtgatatgaatggtccatgagtgagctatagctcactggctcactgcaatcagtgtgaaaataaacgtttggttcacatgagcgcactctgtggtttcccagtcttggcctttggctgttgtcgccgcactactgtctactgctgcccgagctgcaggtgcagtacaaatccaagccccaatcatgaaccggttcatggtggtccagggatgacgtccagtgacgtagggtagccaagcatgttcatcattctgcccttcccggcctaatctttcgtgcgatgagtgaattccccagccacaccgacagaaatgcctctgggactcggatgcatgatgctccaagatccacatggctgacactgatcatagcgtgggagttcatcagatcaccatgctactctcgtctgcagcaatggccactcagtggttctcaagaggcagagagaaaaatattaatgctaatgataaaaaccttcgtgcaatgatgcaggatcccatgcatgcgcaggagcgataattctctatctgaaccagattaatcagcctgctttgaatgcaagcttctgccggtctggaatctactactgctattataggagagaagattgcagtgccacccttgccacatggtcgaagcgagaacgaagctgctagtagggaacatgaacacaactaacctgaaaattcttgacaaaaaataaaaaaactaacctgaaaatggtactagtgcagatccaaaggcctactactgcctctcctctcctttgcattatcgcgatggcacgatctcttatgtcaggtatcggaagcagaaaaatcctgtgtctttctgggtgtgttcagttgacgttaaaattgaaagtttgattgaaattgaaacaatgtgatgaaaaagttgaaagtttatgtgtgtaggaaagttttgatatgagggaaaaataaagagtttaaagaaaaggttgataactaaaccaggcctatgtctctaggacatttagcattgggccacgtttaagatgtggcaattaattatttgtcacttgctgtctatgatatatgggtccttatgtctctatgacatgtgggcccttatgcgtctatcacatatgggtctaggggcagattatttatcaccatccgtaagagtggcaaataattaattaatcctctgtctgttgggccacattcgggagcattggcactttggcagccagtgagtcaagcctgtgtgtttactactgtggccaccgacgagagagtgaggcagtgagacgggtggagacgagcggtggacgccgcgcgccgcggccggggagcaacgggcgttacggcgcacatggcgcgccccggtggaggacaagccggacgcagcagaggccgcttttccccccgttgcacagctgggatgtacgtcccctttaccaccagtcttcccccatcatttctcgccgcgcgggccctgatgcgttttcctgctggatttctatccgtttaccacttgatcgctcgctcgctcgatctgctctcctctgttcatcaccacgtccacttcatctgcaactgtgcctgcacgatcgaattggttgtttgccagaaactggctggctaatctaggggagaacgctacatgtgaagtgtggaacagctgagcgagcaagaacgacgaatcgacgacaccatgcgtgacagatgtactgaccgatctacgacgatcacggagaagaccgtgagtacacgccctgaggaattttcctaatcgtgtcgagctcaacaatagctgtgccgcagcacatctactgactactgttattactggtcttctcgtcttctgctgcaatgtgagctggggcaaacactgtagtttggacctagcgaggacatgctgcttccatccatcgagtagtagtagttgcagtatgtcttcgtctcgagcatgagcacgctagctcgactctacctactctaaccagcatgcgcggctgtccgttgttattagcggcttaaaaggcgtccaggcctttttccccactcgatccccatgtgtattcttgtccggacctcaaacataattaaccgaaggtgaagcttgaaaaaggctaacctgtcctcctgtccatttcttgcataatttacctctaaccatttcggctaccttcagatctagccatcaatcaatcaattaataagggcatttccaccccaataactagaatggtgttcatagcattaaataagttgctatctaggacaaaaaaataatatggcaagtgaataaaatgagaaaagagaaggaaaacatgtcttgcatgagacatggttcctacacaacatccaagacattatgtgagataagtagcattaaattaaagtatgaaatagtggtgtttgcattgtaagagtagtgtctagtattagtttcttgataatgtggagtttataaaaaccatatctagtgttatgggttgggactgtcctagctcatctaatcacagcaaacacggttacagctaattaatgaaccaacgtcaccaaagtaccaaaccgagctaaagcgttcaactgcagtgcaaatgtgcaaatgcaacggatgagttggtacactagtgctgtctcgcactggacactggtcatccgctccaaaaagatcctgtggtagctagtgtacctggctgcctttgtgtgcagtcatgcgttgctcgcctcatcgcctgtgtggccgagagactttactgaccaagcaattcaggtcggcagagtttgttacgtcctccaaggagaggaccatgcaattgcatgttgcgaaagcagaaaactggagagaccggggcacgctgtcggcgtcatgctacaagcgttcccttgcgtgtatgcatcgtccacctagtcacttggatgagagatttgaggggaacaaggctacaaaagtacaggtttgttatcgacaattatttggtctaagtgtagctgaaaacagtcgcgcgtatagcacgtttgattaatgctcagtcaccattttgtttcggtttacatgctaacaaaagtagggtatatcacgtcgttgaagtttacattttgtaacactcaatccagtagtccagtcaataaagaattttttttcattaaaaaggtgttttttttaacttattgtagtcacaggtggtgtttggatccagggacttaactttagtccatatatttagacactaatttagagtattaaatataaattacttacaaaactaattcaataaatgaaagctaatttgcgagacaaattttttatgtttaattaatccataattagagaatgtttactgtagcatcacatagactaatcatggattaattaggctcaatagattcgtctcgtgaattagtccaagattatggatggattttattaatagtctacgtttaatatttataattagtgttcaaacatccgatgtgatagggacttaaaaagtttagtcccatctaaacagggccacagtctatgtggagcatgttcaccgaacaccgataaatattgcaaagcccagaatgattttggtcccacatgccagaaactaccacacccacatttcggttcattttcagctcaggaaaatcgtccaacaatttcagctcaggaaattaaatcgtccgagaaaggaacaagtttggagccgttgggatgagagcaattaggtcacgcttaactacaagtacagtctcattcatcgacattgattagccagcaactaaccacttaaccccgagccagcccaagcgctccgtacgttcgttgggcccccgccgcgcaggcggagacaacggtcatccggcgcgccggtcgctctccctcgctcgcacggccgcaccacccacttcgccacgaacccgacgcgagcgcgacgtgcatctcccaacatccccgccatttcctccccacccaaaaccaacccgcccgcgtgcggctggcccactttacagcgcctcacctcccccaaccataaatccccgcccttttccccccctctccaccactcaccacgctctccactacacgactcgtcgccgtcttgctctgctgcctctcgcgcccgcgcagcagtgagcagcagcaagagcagcaaaatggctctacccgggcgcctccgcgccctcatcctcgccgtcgcattgccgctgctcttcctgtccgcttcaggtaacgagagatttggcaatgcaggtggtttagtggagagtagtgtggttgattgttgggttggtttggttacagaggcgggcacggtggggatcaactatgggagggtggcgaacgacctgcccaacccggcggcggtggtgcagctgatgaagcagcagggcatcgcgcaggtgaagctgtacgacaccgagccgaccgtgctgcgggcgctggccaacaccggcatcaaggtggtggtcgcgctgcccaacgagcagctgctcgccgcggcgtcgcgcccgtcgtacgcgctcgcctgggtgcgccgcaacgtcgcagcgtactacccggccacgcagatccagggcatcgccgtcgggaacgaggtgttcgcctcggccaagaacctcacggcgcagctcgtcccggcgatgaccaacgtgcacgccgcgctggcgaggctcagccttgacaagcccgtcaaggtgtcgtcccccatcgcgctcaccgcgctcgccggctcgtacccgccgtcggccggcgtgttccgggaggacctcgcccaggcggtcatgaagcccatgctcgacttcctcgcgcagaccggctcgtacctcatggtgaacgcgtacccgttcttcgcgtactctggcaatgccgacgtcatctccctcgactacgcgctgttccgccccaacgccggcgtgctcgactccgggagcggcctcaagtactacagcctcctcgacgcccagctcgacgccgtgttcaccgcggtgagcaagcttgggaactacaatgccgtgcgcgtcgtggtgtcggagaccgggtggccgtccaagggtgacgccaaggagaccggcgccgcggcggccaacgccgcggcctacaacggcaacctggtgcgccgcgtcctctccggcaacgccggaacgccgcgccgccccgacgccgacatggacgtgtacctcttcgctctcttcaacgagaaccagaagcccggaccgacctccgagcgcaactacggcgtgttctacccgaaccagcagaaggtctacgacgtcgagttcgtcctcggcggcaactccgctggcggcggcggcagcagcggcaaggacaacggcgggctcggctggcaggacaacggcggggtaaacgccggcaatgcgccggccggcgcaggcggcggcgtgaaggcgacgtcgaccggtgaggcgtggtgcgtggcgaacgccatggccggggaggagcggctgcagaaggcgctggactacgcgtgcgggccgggcggcgcggactgcaaggccatccagcccggcgcggcgtgcttcgagccgaacaccatggtcgcccacgcctcctacgccttcaacgactactaccagcgaaagggccgcaccattggcacctgcgacttcgccggcgccgcctacgtcgtcaaccaagcgccaagtgagtagtcttcgcgctcgtttgctcgtacaattacctcattgcattcgtactacttctacatgattccttgcgtttcgtagcgaaatgtacgtgttatacgaacgggtgtagggcttggtacacgctagtacacgttacacaacctggattgggccatcgtgttccggtaaaagtttgcgtaggaactactactacttgtacatggtgattcacagatgggtgggtcacagtacgggtgcaaatgaaaggcgctttgcatcggcatcgtacgggaatgattctcgcttcactgtagtcttcgcagccacacactggcatgtgccacacgattcacacccatggcttcctgcctgggttaaacacaccttggaaagacgcagccggcggttgcaacttgcaaaattgcgactgcaagcagccgctactgtgtctctgtgaccaacaaatcttcactgcggttttgaggtctcgttgcattggattcgagctgtaggtgttctgcttcttctgcattgcactgcggtagttaatgagtggctcagcaagttgtaaacccgcacaagtgcaattatgactgcgatgagatggggtcagcgtggctcgcagctcgacgtgatatgactcgtcctgtattctttactcccttcattcatggtgatgcgtgccgtggctggatgtcgcaggctcgcaacgtgtgactgattgccactatcgtgtcgtgtaccttttgcagttcgtactcctactacctgcatcaatttttttacagtattcctccacttgttattccctcggttaccgccagtatacgcgtctcctcctttggaccagcactacaattggtctcttgttcacatgatagcagcgatttaccagttttttaatcgcgtaataccaccctgttgtatgattctttctttttgaaccgtgatcttactgggtgattgtctattccattgtttgcagagatgggcaagtgtgagctcccgtcgacggtctgaaccgaagcaacagtagcgaaagactgaagaagagcagcggcagcagccatctcgggatgcgaggatttatgaaagaaaatcgaacgccggacagaggaaggagggaaaagaggcagagatgttggaatctttgcttttcttttccagttttcctccctttctttacctgtggtgctgtgcccgctgcttgactcctgctgcatgtttgctgcggcgtagaaacagattactgtagtagctgtacctctttctttttgcagctttggctaatggtgggggatatctttgtttagtccatgtaactacgctggagtatggagtattactatatgattaacctaaatcactactattatagactgatttgtactagccattggttggccatgtgagtgacccactatggcttgtctcgagggccttgttgcctggtttgactcttcctcctccatcgtctggtggatttataccggaaatggtgctttgctttgaagccaattcgaccggcattagagtttcaaacccatgatagcgttgtgccctcgtctcgtctcgtgctttgcaattgtttcgctttcaggctacgcttttgtgaacgtccgtgagtttgttaaaaatcagttagtagtaggttggtttgaaatccgtcgttgggatttctgcgtacttctcctttacaaggagaaatttcgtgccaaactgctctggaaagatccacatagtaacgtccctttttacagtagtatttcctgatcaggcccactcacaaagttgacaggccgttgatcccaacttctcacgacaatcaccagatcaccactagtgtttgtgaccagctaatctaaaatgtcgcgttgacacgcacttgcgacgtacgacgctgatctaactagaaaaggctcgcgttgccaccggctccccacccgaccacggcacacgttgtctcgaggcctttcggcaaccagccaaccacgcgacgtaccggccggggttgtgggcgtcgtgatgtcgtgcacggccacggctgcggcctccgggagtccggatcacatggagcttcgccttcgcgggacgtggcctcccttcggtacaaaaccgatctctgcctcgcctggctgcctcccccgcgacccgcgtgcgcgcgcatgtgagggaagctgccaagcggagccggcaggcgaggttgagctggaccaccgaatggaggaggagacgggagaatatcgggggtttcatcggtggttccccgtgaaaatccgtgccccgccggctggagggccacacgctgatatgcatgcagaggatacagttttttgtgactcgtactcccgtggtggattcgttttgtacctttggttcgttgtctcgtagcatcgcgtaggcggtacaaatcgtctttagcgaggcccggagcttaacatgctcggccgaaagagggcccgtttagttatcaattttttttccaaaaacatcacatcgatctttgaacacatgcatgaagcataaatctatctattatattattaaaacagctcgaaaagaagccaccacgttcgctgtggaagctaaaaattcctacattaatcgaagaaaaagaaaagaagagtccaaatagaaatacaaactaaaaaataactgaaattcggaattaaaaataagcaatactgaaataggagtccatataagaacccaatacgagattaattaaaacctttggtaattctagattttaactgtttacagtagaaaagataagtctatagatctgtactacgttacatactaggagtctttgtccttttctatttctttggcggtgtacacaatacacgtataatctaattcaattacaaacctatacggagaagagttgtgctgccaaataaacaaagcttgcactgctgcacctatatattctgtagatttcaagcatcaacgattgggctggagcggcagaacccaatgatagcgggagccaaccatagtaaaaagacatgatatttacatagacattacaacaaacagatcaatacttgcagccggcaatgcatcaaacaccaaaagtttctttgatgtttatgaaagtacaaatgatatcaacatattgtaattagtgtatatttttcacaggagatgagttagtgcaagccgctataaactgacagtcagattaaacgtttagattatagtggattcataatttaacgttcataatttaacggttgagatataacacctatatataaatataggaattagagttgtagtgctaatacaggtgtacaaagcgccttgctcgatggaataatcgagatccaattctaaaactgttatctaaacctatttgattccagtggaaaaaaaaagcaaaacaggaactaggtaggcagaaagccgtgtatatacgtgtgcacatgtaagtattattttttcagtctaatcacttcaaaactatttagaacatactgtgatatatttgttgccagtaaaaatgaagcgactgcctctttatctattcgatcctttttaatcaccaaatatacaaccagcaattcagatgttttataagtaactaattttgaaataataataataatgaagactatgaaaagaaaaaaccatctacaacacaacatgtgattaattaattttttttaaaaattatgaaattagaaaaataaaaacaaaagtttaagaaagaatacgatttatgaataacaaaagttcaaaacaaaaaaaaaagtattaaaagaacaacccgtaacacaacaatggtaaataacaataaagagggagggataacgggtgagccgtaaataaataaatagggtgtagcggttgatgggacattttaaaacaataaaaatataaatgacgattagattcaattttaaaaatctcaatgacgattaagagaaacagcagcgggcaagccatcaaggagcgcagtcgtgacg

SEQ ID NO: 1532 - DNA, 8853 bp, Oryza sativa
tcctgcagccctgtgacatttgatgtaacttctaaaaatataaatatgtcaatcgacaagacaatgaattaaaaaactataagatctaaatatgaaagtttcaaagaggatgaataaaagttatgacaggtcgggcaatcaaataaatgagaggtaaaaaagtaaggggtgacgacttattgacttttaaaaactaacccgatgataataagattcaatcttttaagatcggctagatggctatttaacaaatttaaataaaaccatgcttaaaaatatataatcctggatgggtgctagccgcgcaacaaataaaggggttacaaaggagtaagggtagcaacaggtgtgacttttaaaaattataaaattataaacccggggatgataatgttcgatctttgaaagtcataaaacaacgagatagatatttaataaattttaagtagaatcatgtgaaaaattagataattttgtgggtgctagccgcgcaattgcgcgggccacccagctagttatataattaaaggaatagaaaaaggagcctccacgttcgctctcgtggcctagaaattctcacattaatcggagaaaaggaaaaggcatagtacatatagaaatacaatttagaaatagctgaaattcggaattaaaaaataaggaatactagaagaggagactagagtccatatagaaatacaatttagaaatagctgaaattcggaattaaaaaataagaaatattagaagaggagactagagtccatatagaaatacaattaagaaatagttaaaatttggaattaaaaaataagaaatattagaagaggagactagagtccatatagaaatacaattaagaaatagttgaaatttggaattaaaaaataaggaatgttagaagaggagactagagtctatataaaaatataattaggaaataattgaaattcggaattaaaaataaggaatattagaggtagagtatggagtccatatagaaatacaattagaaaataaccgaaattcagaattaaaaataagaaatattagaagtagactatagagtccatatagaaatacaattaagaaaaaaaatagaaatttggaattaaaaaataaggaatattagaagtagagtatagagttcatattggaatttaaatccaactaaaattcagaataaaaaggagcctccatgttcgctctcatggcctagaaattctcacattaatcagagaacaagaaaaagcagagtccatataaaaatacaatctagaaatagctgaaattcagaattaaaaaataaggaatattagaagaggagactagagtagttattacacattagtagttttgaaaagttattgcaaaatttaaaattatgttgtcattgtaatatattttaataatataatgagaaaacatatgtgctattatatgagagaaaatataatgatgctagccgcacaatctgcgcgggcccccatgctagtatagataaaaagaaaaattaattgcacagttatgggggaaatcgcgagatgaatcttttaagcctaattagttcatgattagccataagtgctactgtaacctacatgtgctaatgacggcttaattagtctcaaaaaattcgtctcgcggtttccaggtgagttctgaaattagttttttcattcgtgtccaaaaaccccttccgatattcgatcaaacgttcgatgtgacagccaagaatttcattttccccaactaaacacacccagaaaagcacagatgtgtcgacgagacattatacaacaaggcccatctaaggcgacagcggaagtagcataaaacaacattagcacaaggcccatctaacgtggtagccattgaagcacagaacaatacgattagagcgcccgttacacacacttgagtacttgacgcgatacttacatccccaggttacgtacacacactagtagtagtctagtacgtaaaaacattacgcagaaaaacacgggacggcatgtacagcaccacgtacactaccgtacacatcccatatatctggatcatggcacgcgcagccgtagctagtgaagtctgatccttatcaagcggtggcgatgggcgccgcgtggacgacctcggcggcggacttcatggcctcgaagcgtggctccttggcctcgaacttgtggcgcacgtacaggttcatgtagtcctcgaacacgaacctcgggtaggcggccgccgccgcgtcggcggcggcgagcgcgggcgccgggaagatgacggcgtcggcgccggggttgtagaaggaggcgatggacatgcggttgccgtcggggcgcgtgaggacgcggtgcatgacgctcttgtacctgccgttggtgatcacctccagctggtcgccgatgttggcgacgatggcgtggcgcatgggcggcacgtccacccactccccgtccttgagcagctggaggccgctcacctggtcgtcctggaacagcaggatgatgccaccggcgtcggtgtgggcgcggaggccgtccacgagcatcggggcgcgggcacggcgggtagctgctcaccttggtgccgaacgttgggccgttcgacccggcgaaggccttcttcaggtaacccttctccaggcccagcattctcgcacagcaggtccagcaccctctccgagagccttctcgatctccgacgcaaattgcttcatcacctgcctacacaaacgcgacacatgggcttctgttaggccctcgcgaatattcacaagtcaccttgccatttgccaaaagcgaatccagttagtgtgagttctgattgattgatagtctactgcacgttgtatgatgtatactcctctccgggggaaaacagaaaaaaaatggtgtattcctacacttgttactatctcatagtaggaaagggtgcagagatgcgccactacgtccgttcaagagtaatcgacgctgtggataagccgcagtaaaaaagtaagcatctccttttggtcgataatcctgtcacctttggttgcagtagctgtttacagaagtgggcatttctatagtagagcgcgtcgtgtcaggtgtaactttgttgaggttttggtcaggcctacactctacagtagctaggatactttgtaagcctttgctttgtgagtgtactacttccgattaaaatactgacgatcatttaggcgagtttgcaacttaagcttttctttcagaagcatgcagataaattaacaaagactaaattgagtttgttaatgatgattgatgatgacgcatgcatgcagggtaagtatacctgtagtggtcgtcgacgtcggggaggtcggcgaggttggagacggggcggtggcggacgaagaaggtgctctcccagtcgatgcccttcacgtcggcgcccttctcgccggcctccagcatccgccgcgcgaactccttgaacttctcctcccggcagttggcgtagtgcgccttgctcacccgctccacctcgtccatcagctcgtgcgcgatgccatggttcagcatctgcattcacacatgttaatttcgacatgcaaagttaatactttgacaagcatgacaaatcaaagctaattagtaggcgttctagccggcgagcctactgagatgataagattgaattggtgggtcgactgactaagatggagaataagaatatgtttccatcctttcggccagaaagaacgatgtacgtataggtggctcgatgaacaaaaaaaaatcgaaacatatcaataagttgtgcggccacttaggaattagctagaatcatattaacatttttttgctggttagtacatgctagtgcttggcatgcatatgcacctcgaagaagccccagttctcgcaggcgtcgcggatgacctccattgctgcgcccctctcctcggtctccaggttctccatgttgatcaccgggaaggaggcaacactcgccatctctgtctctctctctcgttcactcgctcgctcgcttaagctgagtgtgtgagtgcgtctgtgtgtctgtgtgtgcactctgaggccggcggcgagcgcccaatttataggcgcgagagcgagaagctagcttgcacagttatctttttcactaggctgactgcctgacccccaggacgtggtgtgcggtatgccttacttcctacatctcaaaataagtgcagccatggttttccgcatctaactttaaccgttcgtcttatttgaaaatttttttaaaaaaattaaaaacataagtcacgagtaaagtactattcatgttttatcatctcataacaacaaaaatactaattataaaaaagtttcaaataagacggacgatcaaagttggacgcggaaacttatggctacacttattatggcacggaggtagtacgagtttacgacaaagtttagtgatttggtccaacggagagtaaagtagtgtggacgtaagcaagctaagctaagctaagctgctaatctgattatctgatctgatcacactgtgtcctgtgcacgccgcaggttgagttcatgccggttacccgacacagtcacaaaaaggttctccacaagatttgctcttactcctaattaatgtctaatgcctttgtgatgtagtagtactatagtgtaatactataatggtagtggtggttactattctatatacctaacctaagtgatcaactctattaagtagagaactacagatcgataagagactgttccttgctttttggatttgatgatgacagaattttgggcatagtacacctggcccagacctgatcaatttgatttgtcaaatgtagacttcacatggctaggtcctatggacacatatcaggttttttaaaaagggtgtggcaatttattatattaaagaagatataacattttaagaaaaaaaatatcaaaccatacattatgcaaaaaaaacatacagtgcttagtttgttaggaaaaaaccgtacattgtgtccggccaataccacctctataaccacctactaaaccgaacaagccaacctcctctaaaggcttccctgcttcacgttgattagtccacgttcaaaacaaaccgaccaacctcatcctatcaaatcagctctctaggcaccaaccgatgcccacatggagcaagagtgtcgtctgtgatggctcgctcttgccgtcagtgtttatggatcgagaaaatatgaattgaattcatagaagaaaaatatctgtattaggcagagagagaaagaaaaagaatgtgagaggagaggagagggcaggcatcggaagtgggtgggtgacgttgccgatggtggcaaggtggtgagctaggaaggtggttcagacctggtggagtcgcctcctggattgctcatgtacatattgtactatgtatttacaagccgtcgctcatcgtcgttgtcaacctgtgcagtagcagctcgacgacggccacctcgacccgtccgcagtggtggcccgacgaaggccgcctcgatccacatctgcctcaacctccttgtcgtgtcgatctggtcgacgttgtccgattcgaggctccaccgaggagaggaccgccggatggggggagaggtgaggccgccagccatcggaggagagaagaggaagaggagctcaagctcgaggccgccggatggggagaggcaggaccgccgactgtgggaggagaggagatgtggagccccggcgaagtgtgggcgaggtgggaggcgaccggatagggtttggataagcatatctatgtggctgtttttcgaaaaaaaaaaatcgtattttttatgtttacagcgctacccctaaaagcgaaattttctcatcttagcgttgtacttgtctgaaacacgaagggttttccgtaagaaacacaacagcatgtttgcgatacgtgaattacaaataaactggaggacatttttgccgattcccactccaggagggctgtgttctataaaaaaatttgtgggccaaataaaaaaaccaacaaaatattttttaaaccacagaaaaacggggccctccgaacggttatattttttaatgccccctgataccatgaggttgcatgagatttaacaccaaacaggcacacgctttcttgttgattatttgataccaaattattttttggttatccagtgtatttttttcttaaactaattgatatcttccagtaaaattcagttgaaaactcttgaggcttaaacagatctcatttcagtcagtacacaagcattacatgatgcttaattacttgcatcaatggaaccaattactcttttttgctgttgctggactggaccccgagaccccagtcccaacgattggttgattgtcctgtcgttcctgttcatctctgatcatgtcccttcttcctcatctctgctttctccatcatgtaggggccggaagaactcctatatccacccatcgctgcgatctccacttgacttttctggacccatctcattgcctcgctggtgtacatgcatcaatgcatgcatggtgacggtgcgcactgatcggccggcgcccgttcaacttgtcgcgccgcaaggaccaatatgtctcctgcccggccgtgagtgcgctctgctttccttggtcgcgccggttttggggatcgcccgaacaaacgtgccctggcctatactgggctcaccggcactccggtaggttcagtgcattcgtccggaaaagaaaaataaaaacgtgtacatacaaaaagttgtcctcaaaatatagttagtgtttattccctagaaatatagaaaccggttctgatgaaccctaattagttattttccgtaagcacttctacgatatgaatgaatgataatgtcactatttgtttatatggcaaaaactgttgttggccgaagcactcccttcgtcatttctgtttcctactgacgatctccggaccaactgctagcgtatgttctttttctttttcaaaccgtcccactaatcaaaatgtacttagctaatttgatgtatatatatcaccatcctcgtcattagcggcaaaaccaccgtacggacaggttggacggtcgccgagcttcgtcacttcgatttcaatgacgactaacgttgatatcttaaagaagtggtcgaccactataacgccggccctggtttgacaatgccgtcgactctctcactgctcatcatggtttattgggcatacatcttactagattatttggacctgttttaatttcatatttagagggtacaatatccgggccatttctatattcaaggttttaggaaaatcaaccatagtactttagagtttagagtgacggtagtctgtttctaaaaaaaaaagaaagaaaaataaggtgcaagtggtgatgtctaagtggttcaatcattcttgacgtatgacatagggaatgtttggtcggatatgtagaaatctttttcattatcacagtagatcttcaaaaaaagaagactttgtatcgactaaagtatatacttcgactttcatgcgctagaactttagctcgtaaacataaaagtacggtacgagcttttaagcaatggttgggttcggtattttaagaagtttgggatacaatgataaatgtagcggcaatattataggggttttgccgttgtgctgcagtggggagctcatggaacagtatcttttgcaacagtctcgggagaatgatcagtgtagaactgtagatgtgcaagttgccaaatatactcgaattgtgcccgaccgacacaataatagagggcagaataatattcagaacaagtctcctgcatactttggggttttgatctttcacaaattaattttttcataacataaatacgtactaccttataggaaacctcaaaatattctagcttagcagctgtcatacagagacatatctagagtatagttaggggtgttaactttagtcccagccacatcggatatttagatactaatttagagtattaaacatagactatttataaaacaaattacataaataagagctaattcgcgtgacatattttttaagcctaattaatccataattagcacatgtttattgtagcatcacatgggttaattatgaattaattaggctcaataggtttatctcacaaattagtccagggttatggaatgtgttttatcaatagtctacgttcaatacttctaattattgtctaaacattcgatgtgacaggggctaaaaattttatcccatccaaacccctcctaagcagagatcttaaacctcagttaattttatactatctgggggcaaatgactaccttacaatttttacttttttaatctttctacgtggtagtagatattttgctcctactcatgctacggattgagatcctctgagttactgacatgtgggccttctttgctatggacccacatgttagtgactgttaagtcacttgacttaagtagaggatctcaatcgagctacttcttaccttcatccttgttgtcatggcttttaatcgtactagtaggttacgcgtctaggagtaccatgtattatgtactactaacatacttcttcttttcatattataagatgctttaacttttttttcctaaattaaatttatctaagtttaactaagtttatatgaaaaaatttcaaaccataccaatatactattaaactatatttaatgttagatttaatgtgactaatttagtgttgtagaagttgctatatattttcataaaaaaattggaataatatattttcataaattcgacccaatctattcaaatttaactaataaaat

SEQ ID NO: 1533 - DNA, 1420 bp, Oryza sativa
cttaactgtgtaactagttcctcttttaatctatatttaatgctctatacatacatccaaaaaattcgatgtgatatttttgggaaaaatttttggggaactaaacagagcataaagggatcctctgacttaactgctgtgcagttgagtcacagttaagtcagaggatctgcttccaaacggggccataatatgaaacggaggaactatagtatttgggaccccggctggccaaggcagtaatcataagagcaccgtcacgtcgcgctccgccacgacagtacgacggatcacctgtgcagcggccctacgaaatgaacgggagctaattagctagctaggcacgggtgatgggtcgccggcctccatcgcaatcgcgacggggtcgcgtgaccggcggcccccgtgaagacgacgtgggcgcgcgcgcgcgcgcgtccgtctcgcgtgcaccagctagcagctgcgcgcgaccaagatcgggttacaacagtcgaccagaaactggtggacgacaactcggcaactggcttgcatgcgccgttgcgtcggcgtctgcgtccaaaagagaaatcgctgtaggatgatttgtatatatataaacgagttgtagctagatgatatgatccataagttgccattggtgattggtcacactcttccggaatatgatatatcattatatttactgtcacgaagagtacgtacgtaccaccgaactctatcacatccactttctgaactacaaaacggcgtagttttttttttaaaaaaaaatctatgcatgaatattttgtaatactattttaaatatgtttttaactttataataagttaatggagaggtatacctatagccctaccaaacggtctgagcttcaccttaaaaacagaaagttgagctagttcccgctctacaattctacttaagattttaaaaatggagatgagattaggctgctccacaattctacttaagttttaaaaattatggtcacttttattatcccttggatgatagacaatgtttctcataactattatatcacttatcgctttccaatgattcaacaataaattatgataacatacaaaaaaaattgtaaaattatatgtaataagcttatatatggttaaaataaacagaaacttacaaattttaagacctcgatatctaggagaacctctatgttttaggcggaacactagtagtcctttgggtgggacgttgcgaaacccataggggctagttttcttttaaatttcactatggttgtgttctcttaagtcctggatcaccgaacagatttagatttcttataattattcgaggatagaaatgaatgaattaactagaaagtatctaccatactatatttaaggtaattatttttttataagaaaacagtcattttttcct

SEQ ID NO: 1534 - DNA, 2343 bp, Oryza sativa
gtaaagctcaacataaagtatgctacatcatcatccactagcaataataatcaacagtattttagatctcaaacaaacatgatatatcatttgtaatttagttttatttttagaacttagcatgcaagcaatataaaattaccatcttcacattatttaaacatatacacctatcatttttataatgtataacatacattcatccacatatcccgcagcaaagcgcggggtatcaactagtatcaaggaaaaggtggaccataggattattcgcgcgtacacccatccaagtaacagtgtttggctttgcaaagccaccggccggcaaaaagatcacaggcatgcatggcttctgttattgatatttgtccgagtgtctggaatctaattctaggtgtgtttagttcacgttaaaattggaagtttggttgaaattggaacgatgtgatggagaagttaaaagtttatgtgtaaaaaagttttgatgtgatggaaaagttggaagtttaaagaaaaaatttagatctaaactcggcctctatgtacgcgcacgaagtgcagtaaaaaaaacacatagctagtggctatggagattttattccgttatacccgctatatatgatatggagaattgcgcaagtcaagattcagagaattacgaagtgcaccaaaatgcttcaacgaagcggcagacattgaaaacgttctcaagctgcagtcactgaaaactcagaatatataattgcgagagtgcgagactttcatgcaatggacaagatcaagaacggggtgcctggatatataccgatcatcgttcgctgtagcctatccagatgccgtgtgatcgtgccaagacgtttctctgctttcgcaactttcaaacttcagtaccggcctagatttcgatcttgcatatagccatgcaactccagtgcgaaaaacaaaaagggagatctaattgcgacgccggaaagatcctctcccatcgaggccacggcaccgagagcgtttgcaagatcgcgggtgaaagagatggagatcgatcggtgacgcgcgacgcgccgtccatccccgctgactgaccagtcggccgatcgctcgcgccgctgcgcttcgtcatcctgtcgctgctgtgaaacagagacgacctgaagctacgtgccgtcgccattaattccacgatagcgatacgactacgaggcggcgaaagacccagcaaaattttacactccggtagctgaatcctcagcaaaattccacgatagctgaacacgtttggccggaatcaccattcaccagtaggcagtaattaactagctagagtaccaattttttggaagcatgagccgacctccattgctccacgcgtgggacgctcgaaacactgctgctttccagctcgcacgctgcggtgttgcgtgcatttcatggcgtatcagcgtggtgtatagcctagggaatctggggatgttaacgtcaccggacgagccgtagaaacgagatctgtttttgtttggtgcgttgtcggcaatgcgtagctgatggaatgttggattaaagtaaagtctctcaccttacatggactctgcttgttcaagtggacctccctgttagctgcatactagtgttgttttttcatcttattatactttgtctcatcaaaattggtcagtgtcaacaagtggacagttaatgacatttgcatatatactagagttctatgtttatcactagtgtgtagagactatagtagcccataaactaatcaaggacttctttcagagaccaagtcagaatttagactctcgtttcaaagaaatatttcaaataaatttcacaaaacaacatatatatttgaactaaattattacaaaatggaagatttaagacggtagatcacaattataaatttactagtaaagttatcactaaaactacaaatttcagacggagtatcacaaaactataaatttaatgaaaaagttgtcataaacctatatattctagaattcagatccatagaactattggattttagttacaaaagatatagtttgtgatgaaacttgatgtttaatcgatacaataccttaaacacatagtttcatgataaattaggtttgaatttatagtttttttatatatctttttaaaattttaataaactagcatggtggcccgcacagattgtgtggctagcatcattatatttttctctcatataatagtatatatatttttctaatttattgttaaaatatattaaaatgataatataattttaagagtatagtgtaccagcggttcttaaacttgtaggggtgtgtcatctaggtctttaaa

SEQ ID NO: 1535 - DNA, 4593 bp, Oryza sativa
aaaaagaagaatgagaagaaaacaaaaaagaaaaagaaaaaaagaaggaaaaaatgaaaaaaaaaatgacacgtcacgtccatgtggcatgccacattagtgccacgtagatcctataggggatgtgtcgatttgggacctagatgatatactttgacaagttctggaatctggatatgcattttgagagtttaaggacctatatgacacaaccctacaagtttaagtaccgccaatgcactttactctaattttaaattttgtactaactttaccaaattaccagtttgtaatattcatattgtattgtatatatgtgatagttattaatttttttaatatcaaattttagttatttctaaattatattcttatatggactctagagtcgtcttctaatattcattttttaattccgaattttcgttatttgtaaattgtatttctatatagactctaggctcttcttccaatattatttattttcaattctaaattttgaaaatttctttattggatttatatgtggactctaaaatcatctttcaatattctttatttttatattttgaatatcagttacttctaaattgtatatcagtatggactttagattcttcttcctatttttaaaattttgaattttagttatttgtaaattatatttctatatggactccaaactctacttttaattttattatttttattccgaattttagctaattctaaattcctatatggactctatactatttttctaatattaaattcctatatggactctatgctatttttctaatttcagctatttaatatttaatcgatacaataccttaaacacatgttttcatgataaatttggtttaaatttatagttttgtaatatatcttttaaaattttaactgaattttgatctaagtatcagttgtttgtgaaattaatcaaacatttcagacccaggcaatgcagtcaatctgcctccaaaaacatgaattgcttttatttttacagccagccagatggtccacagacttgaaaacacatcgtaccttcagttgcagggcttgccggctatgaaagtagtactatgaaataagcacgtgagatacttgggattgtgatctcgggacatgctttcgtctagctgcttttccgaaaaaaaaaaattttgcccaacacgggaatctcaatctaatccgtcctgcagccaatgtttttccagatcacacacgacacgaccttaattagccaacgttggtagacgcgaattttccttcctctttccgaagcaaagcgctttacaaaagctacgaaatactgcgattccatcgggataaaattgttctctttcatgaacatgttgggcagcttcatctatgcagttcgagtgagaattggatgttgccacttgttacttgttagtgcacgaatatatttgcatatgtgctcctagctgttaacctctaatgcggaattccagacaggaagaaagattgctgctcgatgaagacatgcaaactttcgatcggaatcaggttaactatactatcacgaagaaagtctagcatctgttctgttgcttgccaatctgtatttaaggtgacagggacgagggctaagcacttgagacctcatatctttaccactttagccacacaatttcttcagcatttcctgcatatctgcatcctttctctaccactgacgaactaattaagcaaattagaagccagaatctgaactctgtcgtgtcaactgcaacatcacaaaagaaaagtaactaatactattccatttcatcgtaacattagttgtttttgacttctttttctaatcaaatctttttatgtttaattatgtttatattaaatatatttaatattatgcttgtctcgtgttagaattgttgttatattttctataaactttatcaaacttagataagtttgactagggcaaaagttaaaacgatttatgataaaaacaaaagcagcagtagctactgcaccagtacacacaactaggcgtaggaaggtggccaatcttattgtcctatccttgcacgaaccagcctaacttgcgatatctgaactgggcagatcgaaaatattcgatgtttcatccggttctccgggaaagctggaaaaaggacgaaaggaggagtgaacgataagggatagatagcgaatctgcggcccatgcggctgtttacgtgcagtaggcccgagccatcgcgtatccggggcatatgggcatggctcgcctgatccaaatatccagtgaatgatggatgaaattatatgcattatgggctctgcaaacgaaaccatagccatagcgatacatatttctgatgagttattccaaaagaatcaagatggtgcttaattaatttcaaatgtccttgcatggtaacatacactagggcagaactggcatccactagcttaggcactttgatacgaagtagagtatatcgtacagtacatataatgatatactccatataaactggccagtggcaggctcaggccgatgaggagaatgtcgacatggtactattcccaggagtacttcccatacttttgtgtgtgcatgcgaagtgaaagaaaagatcaatccgcactttgctctcctatcatagaaagcccatatggctttcactagtcacgcacgctcgcttcctgcaaatagcagccgcatgcgtatatagtactagctgccattggcaaagtccaccaccggtgcactatcgcgctgtctactcctgtgtcgtgacgacgaggagaccctaccactgattcacgagtagaggagagtgtggtaaattattggcctcgctcgccggcatccccgtggcgtttcgcgaagcggcggacttggctctttggctggcaccctgaacagataagcggataacgcgacgggactcttgatagttgatacggagtacgtcacgtctcgatcgatcgatcgatcgatcggtcgattccccggtgtactgttgttgcaaacagctgtgcttgtgcggtacagatcggagacgagacggcacgtcgtagcaggccggaacacactagttagccgagaccgcgacgtgattggacttggacacgatcgacgcgaacgcacgcacgccgcgctcgcccggggagtgcacggcagacgggctgagcaccacgcacgcacgaacgcacgcagcggcgtcgacgagaacacgagattcacccggccgcgctcgtgaagggccgagccaacggacgacgtcccctgactaccaggccgcaccgctgcacgggccgctgctgtttccgcgtttcggttttgcagggaataagttcacttttggtctctctatttgtcgtccagtctgattttcgtccctgaaccacaaaaccgggtacaacccgtcccccaacttacgaaagaggtccctcagcgattttgatagcggttttggttgacgtggcgcttacgtggctcatttgactcagtctttatctgacatggtactgacgtggcgcttacgtggcaatttgatctggaaaacaaactcgtgggacccacatatcagttgcacatacaaaataataaaaataatgatgggccccatatgtcaccctatttctcccctcttactgtatctgttatctctatcctctctctcagtccctggtgggagaggaccacgtgaggtccgccgtgccaaggctcgggaaggccgaaggctgacggcgctcaggaggcggacctcgccgtcgacgccgccgcatgctccgtgcactgccacgcctacgccggggatggtcgccgccggcagcaaggagctcctccgcaacgaggactgattcaccacggaggacgccgtggccatggacttccccaacatcgtcgccctcgctgagacgccgacggccaggacatcgccgccgccgccgctgccgaccacctcaaggccatctgagcgagctagctgctctcctcaaggccatccgtgcagcgccggcgtgccgcccagagatccttggcgtcgaggcggctgcagcggagacggcttcccgctcccgctgccgccgcggctccttgtggtgctcggtggcgtacgcttgcgggtgaaggtggcagagcagcaccccggacgtgtccgcctccaccctggccgacagctgcctcaaccgcgactccacccagccctgtgagctttggcccagagaaacaacaaaacacacgcgaggtcacacacgcacgaaggaatacacaagtgatgcaaatacttcaggggacaaacacgagcttgcggcgaactagctacacttccactcttatttctcagactcagtgatttgttagtcaagctacaacacatgcagttaccgatcattaagactaagcagtacttaactaatcaccacccacatggcgccggccttgacgatctcctggcagacgtcgtcgccgacggcgagctgctcggtggtgacgcgcagggtggcgtctgaggccgagctcgccgtcgtcgtgctcgatggcgcgcagcatcaccgggctgggccacttttaccgcgcaaagacgctgaagaagcgcggga

SEQ ID NO: 1536 - DNA, 9983 bp, Oryza sativa
gatccacctgtacaccgcggaacctcatatggatcaccggcaagggatgtggcggtggcgggagcgacggcggagtccgtggtggtggcgctgctggagagaggagagagagaggaaatgggatagagatgaagatgccgagagaagaggaggaaatgaggagtgaggatgacatgtgggacccatgtgggtcccactattttttatattattttatgtgtgcaactgacatgtgggtcccacgggttttattatttacccggatcaaattgccacataagcgccacgtcagtgccacgtcatatgaagaccaagtcaaattagccacgtcagccaaaaccgctatcaaaaccgtcgagggatctcgtttgccggttttcgtaagttgggggacgggtcgtacccggttttgcggttagggacgaaaatcagactggtcaacaaatagagagacctaaagtgaacttattccgttttgcagcgggggccgcgtccgtaggagtcgcggtgcccacggcccacagcttcgtaatgccatccagagttttgccatgtgggcctcggtgaatacgggctttatttcgactgttccacggccgatcgaatgaacttttcggttttcaaccttgcgagttgcgaagttgcgatacaccagcttttgtgtgatgaaatgaaacccggatcagccgaaagtgaccgacaaatttatgaacaagtgtgttgctttattatcagctaggagaaggccatatatatgtagcaaaagcaaccaaacatctcgatcggggccctgcagctttgcgatccgaacaggacactggatgcggatggatttggtaatcaaaaggaaaaggggtacctgaccggcgccaatcttggagaggatgttcgtttcgtgcgtgcaccgtgcgcctttgtaaagtgcccgaggttgctgtaccattggaggatgaaggatgaggtttgttggaaatgccgtggcagtcgtcagataatatataagataacgaacggacgggccactctgacagtgcatttgcttgttcatttgggagtttattaggagtagtccgaatgtttggttgctcgagcgtctatttttggaaattgaatttcatgttcttcgtcccggtatgtttcgtaatctcttttaccaatcattatattctctcatggactagccttcataatttgctctgtagcctttgcatatcgtgacatttttttcccaacccaaacgcgcccgatttgccccgtccggccacttgggagtagtatatcgaatcgctttcgcaaaggagacaactctgcagcaacgtcgcgtcccatccattggcccgcccggcattttgcatgctgtagatcgcctgtagctgagcgattgggcaacggcatgctattcaccggcaattaccactttacaaccaactcaaagtcttttttgctaaaattaaagtaaaaaggttgcaaacggataaacgatactctgaaaatgcacggttagtctgaaacttttgtgtttctgaatataaatcagggttggatacagtatcttttacccccaataagaagctagagttcatacgcaatgggacttcgtgttttttatcgtcaaaaggaaccatggtttctctgttcgacgactttgtgtaacgaacgccgcatgcatttctagttttcagaaccttgttaattgtgttcttttgtccaaaattgtaccagcatttggagtctatacggagcaaaccacttgataacttgcacttgcagcttacggcgatgatgactagtgaagccttctgcggcaaagcggcagtagtgactgttacagtgtgcccttcattgtctggagtgcagaaaatgatatctgcagggttccaaagtactgaaaatagttcagaacattgcacccaaatttgatttgttttctctttccggtaatccacagccaccgttttaggtaggatgatccactgttaaatgagagccacacacattgcaaaagcaaaacactacgacaggaggacaaatcgggtttcagagaatcggggggggggggggggggatccctttcccctttgtttattagtggcctgatgatgcagccttgcgcccttgcatatatagtttgcatgttgcatgcaggttttatctgatctgatctgctgcactatactggaatgcgactggagagccacgcgcgcgataatgcatcctgactaggcttgcagatggggagttttcgttggtcgtgcgagagcttaagggctaagggtgcgctcgtttcagtagttaggataggctgattagccgtacgtaaaacgagaaatatgattaacatataattaattaagtattaatatataaatttttgatgaataaatttcttggatttttttaaataacttctttatagaaagttttcgtacgaaatataccgtttagcagtttgaaaaacgtgctaacggaaaacgaggagaatctaatcctataagctgaaatgagcgtaccctaaggcctgtgtattgtgtaaataatgctgccttttgccattttggaatttcaaaatccccttttttttaaaaaagtgtttgtaaatacagtaagaaaacacaaactaaccgtgccttgtagactttgtagtggattctgtgctcagacaactttggtcaaaatccatacttacctataatcttctaggacgtctgaatttcttgacatggatctagatctgtcgcgacaatgaaactgatcaagattctaacattgaccttctgatccaatacggattatctggttgggtccaaatgtgtactgtaacttcttttccagattcaaagaggatggcgcttgctgccgtcgaccaagccacctggctgcggacttgcatgtggctcgatcaatcgttcacagcgtcaacgaacgatcaaaccacaatgcaattcgtagcgtgcacaccacgaacaccaagatagaagattgacctgacccgatcgatcgattgattgaccatgtttgctgctgctctttgatgctctgctcccgcttgtggtgttatctccacgagggttgctttcttgtcggtaccaaaccgcagatcagtggtcaaggacgggttaggaaaataagaactgtacaatgaaatggcccatagtccagtgaactgggcagtccttcagacgagtcatgctacgacagcaatacaatatgctgatggttttatgcatttctgctggattttacggttagagagctcagaccaaaagtcacctttcatggaagacaaaattttctaagagtagatgcagcttgtctgactttgtgtaacttataatcgtgctactgatatatgtatcatagtaaagtataatctgtatattagtaatttaattatagactgcacaaagtcatatgatctaagtttcgaaaacaattgcacataagagcgcgtattgaatttgcaggaattggtaaatcttccatatatgtgtctcatgaaactctcacgtgaccttggtccttgtacaagaggtcaagagcatgcggcgttaggctttgagcacggataaaacgccgcacttcgccagagctatcacatgaccaaacctgcgcatttacaagctaagtgtttcaacactaggtgaaatggatcgtcgcatcactctcgcctaaaaatttcctctctcagagccgtgccaacccacatcggtcacgctcatccacgaatttacaacttacaacgggacgcgtactgtcacgtacttgacgtacatagtgcccctctttatcctcccccaacttccgcctcccctctataagtaaccgtcactctcgccgagagtctctcatcccaccacacgacacgacacgagcgcgcgcgaacaccgtttctactaagcacaaacgcgacgaacacgcgcccaagaggaggatatgcagctggagatttcgccgagacagaggagccagcagcagaaggaggaggaaggcgagcaccagcagcgcgccggcgaggaggcggtgggcgccgtcttcagcattgagccgtgggtggacgccgcggcggtgctggtgccgccgcttaacttcgccgaggtgaacgacggcatcttccgctccgggttccccgccgccgacaacttcgcgttcctcctctccctcaagctacgctcgatcgtgtgagtcctatacctaggatctctttctcggccacggcgaccgtggcggcgagctcgtcgattacgtgttctgacggcggcggcgacgccttggcgtggttgatcggtgcaggtacctgtgcccggagccgtacccggaggagaacacgcggtttctggagcagaacggcatcaagcttcaccagttcggtattgacggcagcaaggtaaatgaacaagtcaaaaatcatatgcgttgagtcctttgattttctgctttattttccacggatggcaaagtcgatcttcgcatcgaattgttttttggtttttcggtcgatttggtgcgttctgcttgtggagataaataatttgcacacataatttgcaccgagaaatagcaactggtatcgcattacagtggatgcgagggttactttaggtagaacgcgctgtttacctgtttgacatgagcacgcacttgcgttttctgcgcgttgcctcgtgtcgtatggccatgagctcgttcgactactttccgttaaaaaaacatgggaactgacaactgatattgctgcttgcttcggcaaaacacttgggggcaacgcaactagggcaaacaacaactcaactagaacaaacaaaagtccctttcttgctttatctttgcccctttcagttagggcatttgcttgagtctttcaggctgaaaatgtttatcgtttttgggttttgttaacctaaattgacaaggttacgtggtgcatggtgactataaaacaccctgtttgagcaaaatgcatctagtgcgctactatttttatgttcttatttcactaattcgttttcccttctcacaaaatagtgtagaaaatctcattatggtaggagttattttttttacaatgcaaaacaacagtgtcagttaagcgggttcttgcgtcagcccagcacccatagaagattagaagttgtttacaatgctgcaaaagcgtatcttgctactggcctactgccattagcaacagtaaagcttatctttgttatgattattctggtagcgttgtgctacttttctagaagctagttcaaactgattggtagactcatggctaaggaaaatattttctatttcagcatcacgcatttcagggttaggagatttttgtctgcattatgccagtctggttctgagttttactgaatactgcaagctttaagggtaaaaaaaaaaaaagaaaacaccttaagcttaagtgatcagtgatgcagtacagcacaagttctactccctctatcaaaaaaaaaactaatcctaaatttgaatctagaaagacggagggagtagctgagaaatgatgggcttgtggagtctcctctgtgaattgggtgcctaaacaaagatcaagttgacttatgcccattattttttttaagagaacttatgtgaaaaaaaaagaggatcaagttgacttatagtataatcgcacctgtcttttaactgtcgagtgacgtctgaccagcgtaattctttcataaatttgttggccatgactttaattccgttattaaccagccacccaagattaccatttctctgtgtgccatgccatatttattctcattttactagtccttcactgaaagccattagtacggttttgtcaagctgtccatattaaaagttcatttaggcatagacgcatagtagccttggagtatgtcggtatattactccatctcgcaactttagtactcgtgtcatcgcgtggtagcatccaccgcaagtctgcaacaatgagaacatattccactgtcagttctgggttcatgaaggcatgaactgccacggcaaatggtcaaagttggtcagcgtcggcgacttaaggctgaggtcgttgcttgggttaggtattcatccctagttcatgcaaaatgacataactcattaacgtatgattaattaagttttagtttttttaaaaaaataaaattaatatgaatataaaatttaaattaactttcatatagatttcatatagatttttgttaaaaaaaacaccgttcagtaattaaaaaaatgtgcatgtgaaaatcgagtgagttaagttgggaccttcaaacaaaaaaaaactttcatcgttcattggcgattgttgctgtcgatgataaacaacacagatgtgctgaccaactttagcattcccagcaaaaaagaaatatatcgctgagtgaaaagacactgatcaggtggctgaccttactacaagtgtgtgaatggaaattagtgctcactttgacattgtctggagatgatgcttctttttcgccggactcaagctaggtgtctgaaaccactgaattacgagggtcaccggtaataattgtgtcactgctagatggattctaggatggtcactgctagatggattgtacggtggtgtttggatcaaggactaaactttagctcctgtcatatcggatgaatttagagtattaaacatagactacttataaaactaattacataaatgagagctaattcgcgtgacaaaatttttaagcctaattaatccataattagcgcatgtttactgtagcatcacataggctaattatgaattaattaggtttaatagattcgtctcgcgaattagtccggggtcatataataggttttattaatagtctatgtttaatatttataattagtgtccaaacatacgatgtgatatggactaaaaagttttagtcccatctaaacagggtctaagcttgtttctttgttaactagaaccaataatgtagtacatacttgagtggcatgacgatatctttgcatctgaactttcgataaaggtgaaccttatcagttaccgcattagcctgaaactgtgaaacaaattaaaacatccttctattgctataccatatcatcagtaattcagtatgcatccaactgaccattctcttcaatcctgttgactcttaaagttgatgcatagcctgacaataatctgaaccttgctgttacaggagctgcttgtaaacatccctgaagaaaaaatccgagaagcactcaaagttattcttggtatctgcctctacaaagatatatccaatgtctcaaaatttcatcacactatctgtatctaactcttatcgttttgatcaattcagacgtaaggaatcaaccggtgctcatccactgcaagagaggcaaggtagctatatctatttagcattgcacatccctgatatcccattttcttgaaaccttttgctacatgggaattcgacggtttcctgatattccacatgtttcagcaccggactggctgcgtcgttgggtgcctgagaaagttgcagaaatggtgcctaacttcagttttcgacgagtaccagcattttgcagcggcgaaggcgagaagtactgatcagagattcatggagctgtttgacacatccagcttgatgcacctgacggcctcacagtgttaaccgaaccgaatgttttttcatatccggtcccgatctgtaaccatgctgtctacctagcaacatattgtaatgttgctattgaaacaattcatcagagaataatgttagaaccatcattatcctcataaaagtatccatcaaaatacaaggccttcctcttttttttttgtactgcagagatacagtagtcgcagtctcgcagattctgacaaaatttggaagctggatacgtgaaattactgcatcgctaacatattacttcctagatgctgaaatttaggatcttgtactcgttttgaaatctgacaggaatgtgcttatgtgcaacaacaaaagatcttcttttggtgcaaaaattacctgttaacaggatggattgcactgaatactcgctaccccagtctcctgtgtcctgacttctgagccctagccaaaaggagcatcaaatttaggaggagaaaaaaggaaaaattatccatcgagtccagatgaatcctggggaaatcttaacaagaaggaataaaaacatgaagtgaagggcatcattggactgcatcctcagacttcaagataagatcttcatggagttcaagtcgatagggcgacaaacaattcagattcaaatttgcagattatttggatcaaagcctgaacagagaataggcccaacggccacctgtctggttcgcgcgttctcccgtcggatcccgcgatcgtccacgccagggtttacgattccgatgaaatcctgtcggatttcgcgaaattgtgacgtttcgatgaggctcaaaagtagaaaccgtctgagatttcgaagagtttcatccaaatttaaatttgaattgataaaaaaggaaaaaatcaaataaaatcttataaataatatgatattcatagaacctattgggatataatttttttgaaaaaaaatgatatattgtgtgtatttactgaaacttacatcaggaaagaaaagaataaagaattaaaaaaggaaaacacttagatgggccggattacttatcgaaattttgatgatttcgatcggaatttcaccaaaaccgatcggttttcaagaacttgtcggcaaactcagggaatttgtattcaaattttggtttatgaaatttgttcggaatttaccagttttccaccggatttcgcgaaattccgaattccaccggtgcccgaaacggaagcgtctgtcggaattgtaaaccctggtccacacactcccagctcagaccatgtttagatgggctttaatcccggcccacgtacatgtgtaggcctcgattttgaactaaaatgccggcccataaaatctttagcccaataagccatccgatcacgatcaaaaaatggacgatcggaaaatgaacggtggatgcgggctacgcaccgaaatccaacggtcgatgtaacccccaagaccccaacaagccctacaagctaatccaatatcacgccgcacggagaagtcccgagaccggcgccgccaggaccgccacccacctctgcctccgccctccaaaccctagctccggcgatggccccgaagcgccccactccgccgccgccgccgcctccggttgcctcctcagaggaaaccgcctccggctcggactcggacgagtcggaggaggaggaggaggagagtccccttgctcagcccgcacccgtggtctctaacaagggcgcggagtccgattcttccggggaggaggaatcggaggaggaggaggaggaggacttggtgcgctcctccgctaccaagagcagggatccaccgcaggagaatcgcgaggaggatgattcgtccgatgaggaagaggacgagtcgtccgaatccgagaaggcggaggcgccgccgccgccgccgccgaatccggctccgaagcagggggcggaggggaatggcccgaaggtctcgtcgcccaagaggcaggccttccaccgcatctggtcgaccgaggacgaggtgcgcatcctcgaggcgctcgcggcgcaccgccgggagcacgggtcgctgccacagaccgacgcgctcatcgccaccctcgccggcagcctcgacaacactggctacggccgcaaggagctccaggggaaggtcagcactctcaagcgccgttacgaatccaccgctaagaagaagggcgatctcccaagcaagggccatgaccgccggctctatgacctctccaagagcgtctggggcagcgaggcggcagcggcggcggtgagcggcaccaccaccgcgccgagggagttcggcgagatgtgcgagctgtacccgcacctcgctgaggaggtgggctgcag

SEQ ID NO: 1537 - DNA, 3998 bp, Oryza sativa
tgactcctttataaactgaaccccagtcctcgttaagtatgggttagtgctggcagtgtgttgccctagcctgaggtctctgatatggcaactgtcgcgtgatcagtgatcgtctctgtctagctgacatctctcctggatgaaatcaatccaaaaaaaaagaaggctttgatcagatagattagggttcacacttcacaactctgacgtttcaacgcagcgcgaaagcaaattctgttggaatttttgaatcgtttcagaatttttcaaatttgaattgaaaatttatgaagaatattttaaaaataacttgtaaatagtcctacatttgtagtaaatacatgcatatgaaatgtcaaaaaatataggcgtagaatgaaaatgctctttggacaacaactgaattggtaaattgaaaaaagacatctagaagggtttacaatatgtgttgattgtgtatgcactttatattatggactttgtattgttgttatactatgttgtttatgcactttacagtatgtattgattgtgggtgtactttgtattgtgttgatgtactttatattatgcgtgttgatgttaatggcgtaacatatatttggttatgcatatttaattgtcaatgatatggacttcaaattatcttgtatttgtgttcatgaatatacattgcgcttattctcaatgtgaggttgtcaaattgtaggaaaggtcatgctgaatttctttattaatttcttacattttcccacgtttccacggtttccccattttgatatccttttagtttgcaatgttcctatcatctccatgaattttctcatatttcaaacattttcccctattatccaaatattcagaaaacacaattaattcccacgctactctttggcttttcagcaaatccaatgagttttagatgcttttgtttggtttccaaaacactggaacggtggtttcctgttcgaatcaactgaaatcctggtagttccggttggaattcggtgattttgatcatttttcattgacgggcaaatggaacttgagaatttggcttcttaattttgtttgaaatttgacggttttcgtgaaaaccgttatactgacagggtcaggagcgggacctcgattggaaatataaacccttgcctgtaatacggtacagccgtacagaattcgtgtggtggccacgggctcacgcaccgggtcagtgatagcatccagtggccaatttggccatggagatgatgcattttttacacggagaatgatcccagaaacacgcatgatcttctcttacaagaattttctaacagaacatccatttcaccacacccacttgttcaatgcagcgctgttttgtaacccacataacaaccggacccagcacgtctgaaactaaggttactcatcggttacctaaattaaagtactccctccgtattgtattttaatgtatggtgccgttgactttttttatcaatatttgactattcgttttattcaaattttttgtgataatgtgaaaatatttatgtcatgcttaaaaaacatttgatgatggatcaagtcacaataaaataaacgataattacataaactttgtgaataagacgaatgatcaaacgttagataaaaagtcaacagcgtcatatattaaaatatgaaggtagtagtaatttacagagatgttttagcgacctaaaattctcaagtttgaaattttaatttttggttttcatttatgaggacaattgggactctaaccactcccccggtcgcttcgcgacgcgtccgtcccgacctgccaaattcctcgcacggattaagcaaaccaaactactcggattaaatgcgcaaatcgaaagcacgcgttccattgggagaccggcaaacttcgttttttccttcgagaggaacggagacggagtttgccgtcgtcgtgtgcgtgcctcctcgcgtacgcacatttgcccgcagcgccgcggcgcgcgaggctaccccgaccccgacgtggtctcctcccacccatacacccttccgcttccacgcccacacacagaacccaattcccctccctcctcctccacccgcccctccctcccacacacaccacaccaccaccaccaccacccacccctcgtatgcaattattcacgcccagtcgccgcctccaccgccgccgcctgctcgactcaccaccgcagggcggcctcctcctgccgcatgggtgactcgacggtggccggcgcgctggtgccatcggtgccgaagcaggagcaggcgccgtcgggggacgcgtccacggcggcgttggcggtggcggtggagggggaggaggatgcgggggcgcgcgcctccgcggggggcaacggggaggccgcggccgacagggacctcctctgcccgatctgcatggcggtcatcaaggacgccttcctcaccgcctgcggccacagcttctgctacatgtgcatcgtcacgcatctcagccacaagagcgactgcccctgctgcggcaactacctcaccaaggcgcagctctaccccaacttcctcctcgacaaggtttgcttgctcgttctgcttacacagccgagatggataatggattggccgtggcttccatattccgccgatcgattgggaattttggatgcctatcctaatttcaaacgcagggctttgtaattgaaatgtcactgccccgcaaaaaaaaaaaattgaaatgtcactgaatgtacctttggatgtggcttgggataggtatccggtataaccaattttaacaaatgtagcaactattcaacagtatgcctttcgattcgtttgtagcaactattcaacagtattcagcgcttgagctgcgatttattgtactactgtttgtggtagcttctgaagtagtagcaggtgttctgattggatagctcagttttatttgacttgcacggtacattacagtttgttgttaatgtaagttttgtttagaatcaccagcagtggacagtattagttctatgtctgctctggttatcagtacctattatataatttgttcatcactagagttcttctctagttctgttaaaacttaaaacaagctgtaattactggttacttgatactgggattgtataaatgtatctctaagcatgtttatcacatttatgtctgcataggtcttgaagaaaatgtcagctcgccaaattgcgaagacagcatcaccgatagaccaatttcgatatgcactgcaacaggtcagtcacttcacatgttttacttttgaaaatgtctactttcaatagctccttaaacatagtggtatgttcctaaatggttttatgtactgtgaaaattttgcttccgtaccttagctgtgcttgtgatcttcagttcagaactaagtagtacagagtagtaattaagttctacactgaacatgcttatctcttgcatcaattgtagaatctaagctactgtgaccgatatcaaagtatcttttgttccttcgctcttacagccacatgatctctatcgtcctcttaactgttacaaggattgtccatatgataaaccaagtataccacagaagatagatttgcactaccttgctgactttatatctgtttcaaaattcaaacataaaactgacgttctctaaataagtaatagatgaatgatgaccaaacactatcatatgttttagtttaattcttctttctttttctagggaaacgatatggcggttaaagaactagatagtcttatgactttgatcgcggagaagaagcggcatatggaacagcaagagtcagaaacaaatatgcaaatattgctggtcttcttgcattgcctcagaaagcaaaagttggaagagctgaatgaggtttgtctatatgtatttttcagtatgcaggttttttttcttgctacctacaacaataaataatcttttactgatgtctattgttgttaatcatagggctgcagga

SEQ ID NO: 1538 - DNA, 5780 bp, Oryza sativa
aggttatcatgcaggacttgaggatttccagtctgtgctaacaacattcacacgatataggtccgctgattatttgtcctttttagcacattatgatcatggtagtggttatgcctattcatttggcttatcattcttttgttctctgtcatttatgcttcagtcgcttgcgtgtaattgcggagctaagacatggagatctgtttcactctgcaaatatcgtatcaaggttagtgcttttacaaaatatgtgccttatttcatgtgcatcaacatgctattggcaatgtggatgttgtcatagctgaatcctcaagccagcagtgagctgaggagaggttttggttggaggggggatggtctattgctcctatgagtcaaacttcaactatgttcaattagcaaacaaatccactaatcttgaatgctgatgtttatcatgtattataaggaacaaaatatgactataagtttgtgcctgtttttttggtgcataattttcatttccatgtctatctgtaatctcatatgtttttcagtcgcctaccttacatgagaatagggaatcacattgatatttcttaaatgcagtatcgaatttgaccgtgatgatgagctatttgctactgctggagtctcaaagcgcatcaaagtcttcgagttttctacagtaagttttttttcaggaatcttatgttggccatagctatatgcctgtatagtatttgaaaatactcaaatttggcctatcttatgtcgtaggttgttaatgaaccatcagatgtgcattgtccagttgttgaaatggctactagatctaaactcagctgccttagctggaacaagtactcaaaaaatgttatagcaagcagcgactatgagggtatagtaactgtttgggatgtccaaacccgccaggtatttcttgctctgttccacagttcattttgcacacttgtgttattttctgaacttggattcatgatatttatgtattcaatcttctttagagtgtgatggagtatgaagaacatgaaaagagagcatggagtgttgatttttctcgaacagaaccctcgatgctagtatctgggagtgatgattgcaaggtatttgcaaatttcaatggtacaactacttttgttattcccgaaagcaagaaaactttgcgtagttctcaaaatacagtaaaacataacttggatatatcgcatgttatgcaacatactaggattttattttatttatcagtttttcatgtccctttttctataatggtgcatttttctacctaggctatcccaacctcattgaatgcatagatggaagtatctgtattgcagtataccttatggaacctactgctgtttgtgctaggtcaaagtgtggtgcacaaagcaagaagcaagtgccatcaatattgatatgaaggccaatatttgctctgtcaaatataatcctgggtcgagccactatgttgcagtatgttcctttgattttcttggctcatatcaaatataagtttttttttccttaccagatgttacattattgcaggtgggttctgctgatcaccatattcattattttgatttgcgaaatccaagtgcgcctgtccatgtttttggtgggcacaagaaagctgtttcttatgtgaagttcctgtccaccaatgagcttgcgtctgcatcaactgatagcacattacggttatgggatgtcaaagaaaattgccctgtatgtgtcattgagatttttcttgcactgcaattatgaaattatgtttttgccttttaagcagctatgacttattagtaaaaagtgatgttttaggatatactctatttcatatcgataaaaattggagctatagtgtttctttatttcctgggaaaaaactatttgagaagcttcgcttttttttcgaagaattctggtccttgaaaaacctttggttaggtccgaaattcttggataagcatttgttttcacctttgtttcttttttagctcatctattagtctggcttggtttagtagttacgtcatgctaggcttctcagaaaacagattgttgaccttttgtttaaaatggttacctttttcaggtaaggacattcagagggcacaagaatgaaaagaactttgttgggctgtctgtaaataacgagtacattgcctgcgggagtgaaacgaatgaggtttttgtttaccacaaggtaattgcaagcttattgcctgctcttgtttccgtatctgtgattcagcattatgtgccatgcttaactgtacaggttggtctcctgtggcaccatataccattctaacttcaagtaactctgtaccaattgcaggctatctcaaaacctgctgccaaccacagatttgtatcatctgatctcgatgatgcagatgatgatcctggctcttattttattagcgcagtctgctggaagagcgatagccctaccatgttaactgctaacagtcagggcaccattaaagttcttgtacttgctccttgatgaaatcagtggttttcatgagatccctagatagcttgtatatttgatgtatacagttgtttccttttcgtgccattataccccaaatgggagtggaggtattactgatctccaacatagggcgcaaagttttgaaggtaatcagctgacatagggtttcgagggctcgaaatgtgcatagtccagaattctcatgtataggtttaaagcagtcaagtaattgattatacatatgtaacgtgagaattgagaaatgaacatcaaataagcttgtttggttgcatatattggattggattttgggaactgggaagacaagctgtactgggctgatttcagcaacacaagccagtttgtcacacatctgctacctaacagaaatagttaacttatatatctcattgatcttacgcagggctaaaagtacagtatattacacccccaagccttcttattgtttttactgatttaaaattttccaggatacgcaattgccgtttcatcgcttaaatttcaaacccaataccttcatttctttttttctcttttactgaaaagaacagttttttgaactctcgcagtgaaaatgttggtcgctgcctgtaaaccctgttaccacgttcacagtgcatgaaaatatctattactaccggccaagccactatctttgtcacagtgcataaaacatactccctatgtcccataatataagggattaatattttgttacattttatttttactgtttgatcattcgttttgttcaaaaaaaatttagagttattatttatttatttattgatttactttattatctaaaatactttaagcataactttttgttttttatatttgtacaaattttttttaataagacgagtggttaaacagtgtaaaatgttaatatattatgggatggagggagtagcctagttctcgctctctgcttccacccacagatctgatcatctgaatcgctctctgcgaagcacccacagacgccgcggcttggctaggccggctgccgcatcgcagcttttgtatcggctgccgagtcgcgggagagaaaaaaggagcaaaactgcaagaggcgggtggcctttcgaacgcgcaaggggtttgcgcttgcgcgcccgaaccaacggagctgcaagccaagccaccaccaccccaccccacccacccaccagcgtccagccagaccaccgccccgcgccgcctgcgctgcgtcgccgtgggccgctggtttcagcgacaccgcgccgctgcacgtgcccccgccggcgcctctccttccaacattggctaatggctagccccatgccgttcaggttcacggctctctttgatcctgctcgaagaagaactgagtggataccaaagttaccaacgtcaaaatctacccatagctgttcagcttcatgttatactctagcagatttaggcgcattcggccgactcaagcgacggtaacgtcgtagtctagtgtctctagtgtctaggtggagagggactgaagagcatgtgctgcgctgtggctttcacggcgccctgccacaggaatcagcggtgaatccgccgaacaaggggggcagcacaagaatatctctggacaagagtagattgtcatctactcgatttggccggtcgtgttccatttccagccatgggttggctggtttacaattcccaaatttaactacccagaattgcacttgtgctctgaccttattcgtgcatctcattttcttactttgacacaaggatatatcaacacatgaaagatccactgaagaaagatctaaacaagccaggtgatgtcacgaaaaaggtccccaaaatatatcatgttgtttgaatccccattattaaagctgcacttttatcactttttatgttctctttgtgggttgcattagagtgtagccattagctcttccaaagagccgactgaattcgatacggcgctttcgctgcactacagttccatctcgcgattcgttttggatgtgatcgtatccttaattccttattcatcatatattttctattctgaattgtgaaaaagcgcagaatattctagctctttctcggagtaaaagatcggcaacttgcgcaagtttttggcatgtactaaagttttctttctttatgagatgaatccggtatagatgctatcatgctatgcatacggttgcagctttgatcttgattgaatcattgaatggattcttattggaagacatttttcttaagcagctcttgctttctcggagctagctggtattctgatggggatctttctcttattctggttcaagtggagtaacctagttcgtattagacattcatgtatacaagcagtgatgtatcctgcacaaaacaagaatatcatcgagtgcagtggttgattgaattatcttgcgatcaatgtccttagtgtgtttgctctgcgtggtgcacgcactgtgagtctgtgaaatggtcatctccttgtctggaatcgatcgatgttgagcatgaaaacagcttgaaccgtaacaagcaagagatggtacactaaaaaatgcagagagatgttctaattctacagaatgaatatactgttcaaaatgcagaaggaaaaataatatctgaacagacaggccaccactctgtaaactgttctaatgatctgcttcgaactaaacagaattaatagaggtgagcatttccctcactgacagtagtatgctcttttcttagaaaaggacttctgggtcgttctttttctctgtgggggatactgaatccacaagaatcagcatgattgtgtcaaaaaagaggaaatatcacaatttgtcgtttcagaaacagttaatctgaattctgaaaagtaccctggaggaaacatgaggtgcatgcgagtgttaaaaatactttcccggtgtagcagcttagtacgattgagctagggataaataacacattaaaactcagtttgtgttcacttcttttttattttcaaagagaaaatatgcacttgtagcgcccgttccgtcgtggcgccttgcgggaaaattatctcttaaaaaccctaattgcgatattgtttctttgtttgtcgtctagtgtccgtgccatctcaagatctcaatccccgatctatcgtcgagttcatttccgaatccaaatccttccaaatcaatttcctccgcaaaagtctattttgcctccccggggtcgatgggccgaatccctctcggcccatctaccc

SEQ ID NO: 1539 - DNA, 4745 bp, Oryza sativa
gttcgcgcgcgcgcgcccggtggttgccgcccgtgccgcgctgctgcgccgtccgcgtcacccggtcccgctgcctgccgctgcagccgcgccgccgctcggccccgcagccagcgcgcgtgcccgagccgtggcactcaatccgccgcgtctcccgtgcaagccgcgcgcgcgtgccgtggtggccgaccgcctggtcgtcgccgtcgtcagcgcctgcccacgcctgtcgcccgtgtcgccgctccgctccacaccgccccgccgtcatcgccgttgtcatcgcctcggccccgccactccgcgtgcaagccgccaagggacggaggcagagcccctcctccctctgccgcgacgcccccgctcccctcctcctttttccaaagcggcaaggaggcaagcccctttctctccctccttttccccttttcctcccgccggcatcatcctccctccgtcctgtcgccgatttggccacgagcgccgagcgccagctcgcgccttgaccgcccaaagtcggtttccaaaccgacattgccgcccttaaagcccgggcgccctccctctcttctcctcccatcgcctccactccattattgccacccctctgtttcgccgtcgccgttcgtcgtcgcgcgcgtcggaggagccggcacgagcgaggacgcggaaggggactccgggcgctcgtctccttcctcttcccctgcccgaggccggatagatcactcctgcgccgtcggcctctcgtcacagcgccccacctcatctcggtagagcctccctccgttcttcctcctcgttccatctccttcccttagactcgggtagtagcacgagtagcctccccatagctagccggcgccgccccgaccgttgccgccgctcgccatgtgcccgccgccgtcgccgcccgagctcggaagcgcctctcgtcgccggcctccctcgatgcgtttcctcctaatccaacgctagcattggattcccgtagccgcgtagatgctctcgccaccgggaatcggcccctcgtgacctcgtcgccgttttccccttctcccgccgccggttgccgccgccgcaattcgccgccgtcaagctccctccggcgaatccgagccgttggctcgtctcccctcgtcctgtgcaaccacccggtgtgctcgctttcgcctgtatcgccgtggttcgctccgccgctcgccgctgtcgtccgccgtccattccggccggcgtcgtcgtctacctcccgccggcccgcgtggcagccacgtaggcgccacgtcggcgccagctcggccaagcgttccaccgcgagccgtgaggctgcgcgtgggcccgccgcatccgcatccaccgcgaaccgcgcgcgtgcaccgcgtccctcccccgcccgcgcgcgtgtgccgcgtgctcgctccgcacggtgaaccgtgtcaccgacaagcgggtcccactcgggaccacgcgtggtgagcccggtccaccggctctctctctcctcccctcccgcgcgcgcgtgccttgggccgccttgggccggccggcccatttagctcggccgaaccgctccatttctctcgggccgcgccctagccgcccgaggaaagtctaatttccctccctcttttcttttcttttcttttccaaaaaggatttaattaaatcctttttcctttagaccaaaaatccaataatcttagaaattcaatatcttcccaaccgtaaatccgtttgactccgttcaacttccaaaattcctcaaatctcgagatctaactaatggcacacttagaggtcattaatagggctttatttttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatttaattatgttgcttgtaaaatattatgcattgataggatcgcacttaatctgttgtcccgtctgcaaggcagattggcggacctacctaatttgttgcatttgatccttcctttgttaattgttatatcatgtctccttgtatccatctagttgcgtctcgatattcgtgcaccctgtgcgagtatcgacggacgccttcaaacttaaaatctgaataacaacttgggtaaaacttgggttttacaaaagacttggaaaacccgacacctgggtcggtgcttgtgaactaaatgaatttccaaaaccgcggaccggggaacgtaccgggtgtacggttttccgctcttgcacttaaggaccgtttccttggaatttcatccaaacataacacaagtacgaccacatgggtggaatgggacacccctggctgagtaactagcttatcaggggagtcttgatgccgagagacatgtggattcgccggggtggtgtcggggaggacccctgggcttcctgtcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagagattaacaaactgttcgaacagccgtgcccacggtcatgggcggatgtgaggtgattcctagcgtagttttgtttgactactgcttgcgaaattactgttgtggaaaggggttcgatgtttaaaaaaaaaatctgcagctgatgggatcagctaggcccgggtggccgtttgaaagtggttggcccgggtggccgtttgaaaagctgttggccgggtgccaaccttgtttcaattctaaagactgatacattgcacatactccgaccggacgagacgcactgtcccatccgtgtcgtttgagaagcactcacttagttgttttcagaaaagagttcaaataaaaatcaattgcaaaaacaacagcctttccttgaagcctgcattaaacacttatttcccatggcttgctgagtactcccgtactcacccttgctctatataaataatcccccccagttgctgaagaagatgaagcggaacctgccgatgaggagttcttccaggagcaagccggctacgatgagttttagggtttcggcctagttcccaagtcgcgcctgtgttgtttggtccaagtcctggcttccgtttcccttttgtattgcagttgtgagctcgggatctgtccgcagcccaacatgactgtacctctactctataataaaaagacctctgttgctgtgatattctgtctccctgtgataccagcactgtttcctgggactgatatcgattaacaggttaatttagagcgtcacgggctagttccggtcgggattagttcggggcgtgacaacactcttctccacaggggctacggtctaatagttctctcaaatagggtctcagggctgcaccaattagaaaacacttactctcttaaaactcccattgtttaccctcagctcgtaagctgcagcaaaattttggatttaaaaacttaaatttaaagttgattttgggggtcttttcattgtagcttatttttcaccatttgcttttaaattgctaattaagaacacatatatataatttttatttatatatttttttgattgctaataagctgttgtggcttataatcagaataagcgaagcaatgactgttttgtaatgtgcaaacaaaaaattctatacaggaaatgatagatatttaaccaccttacattaggatactactagacctaaagccaagtgaatgaagtgtcagcctcacaaagtcacaatgtcgacaaaccatactggcagaccacgtttctgatggcgagtcgaacactttaacgtcagtaacaggaggttgttgcctccatgcatctcgcaaaacaccaaatccatgaaaaagagagatctctcaagaaatcaaaatggcacgcagcggcagagtcgccaactggggaaggctggactccagaagctagctaacaagccaccgctgctactactagctactactactactactctcctgcctgcctctggaccagggcttggtccagttggcccttggcgatggcgggaggcaactcctgctttggagccggccggctttgggatattgagaagatgcagctacagtaggcagctcagctgctgctgaaagaaaccagccagcaagtgatgtgatgaagtatcctccgagcttcccaccggttacttggccattggaaaatgccatgcgccaagccattgttaattaccacccgacctgctgttgctgcttatactttgggttaagtcaatcatttggtttttcatttccttttgaatgggaaagtatctttctatgttatgtcctgtgataagatactctctgcatcatgcttggattagtattgttctgtctggtttatattaatttacagggaatcggggtgctggtcatgcatcaaggctttggtttattttagtgtgtcgactcgagagagctgggaatttgctgtgtgcttatgactttgtgctctgacttttgacttaattatgtgagaaaatgatgcaagtagaacttgcctttacagtaattaaaaccacagggtgcctgctctgtagatcctagaggccatttccataactacaatactcgg

SEQ ID NO: 1540 - DNA, 364 bp, Oryza sativa
gtgcaccgtgcaagtcgtcgtcgtagaactggctagtaggaccagtcctaccggcgtgagacgaagaggccccagtaccgaagatcccggctgcaaatcctgctggacaaggactatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacatattcgtgcaaaaagctgaaacaaaaatgaact

SEQ ID NO: 1541 - DNA, 8302 bp, Oryza sativa
ccctaactaaaatttggtaataaacataataaaattaaaagtagagtttagagtccgtataaaaatacaatttacaaataactaaaattcgaaattaagaaaaatatgagcagaagagcttaaagtcaatataggaatacaatttagaagtaactgaaattcgaaattgaaaattaaagaatattaaaagataagtttagagtccacatagaaatataattagaaataataaaaattcagaaataaaaataaataatattggaagaagagcatagcgtctatatagaaatacaatttatagaaaattcggaattaaaaaaagaaatattaaaagacgagtctagagtctatacaggaatatatataatttaaataaggaatattagaagtagagtatagagtccatatagaaatacaattaggaagtaatagaaagttggaattaaaaataaggaatattagaagtagagtatagagtccatatagaaatacaattaagaaaaaaatagaaattatgaattaaaaaataaggaatattagaagtagagtatagagttcatatatgaatttaaaactaactaaaatttggaataaacataataaaattaaaagtagagtttagagtccgtataaaaatacaatttacaaataactaaaattcgaatttaagaaaaacataggaagaagagtttaaagtcaatataggaatacaattagaagtaactaaaattcgaaataaaaaattaaataatattgaaagataaggttaaagtccacatagaaatacaattataaataataaaaattcagaaataaaaataaataatattgaaagaagagcactgaaaattcagaattaaaaaaagaaatattaaaagacgagtgtagagtccatataggaatatatataatttacaaataactaaaatttgatattaaaaataattaataactaacacgtatataaaatacaatatgaatattacacattagtggttttataaagttattgcaaaatttaaaattatgttgtcattttaatatatttaaataatataatgagaaaacatatatgctattatatgaaagaaaatataatgatgctagccgcacaatctgcatggggcaaccatgctagttttttaagtaacatacagataacgagagatcgaccatccctagagtgatcaaaattcactcccaacagtctgaaactccaaaagaaataggtcattttctatctagtacaagaggaattgaaaggacgtattagatgggaggctgctacagggatggacgtcacgtcgccggtattaatctggaaaatgaagaaaaaaaatccggccgaatccccctagaaatcccatcgcgcgcctgcgcgtgtggtgacgccagctcgtggcctgcttgggtccgtgcatgcatcagagcagaggcaactactacgacctcgcgttcctcgtccctatataaaccccagaccaccacctccactgcttccaagaacagatgccatcctgagcttctagctcgcgagtgatctcttcttctagctcagtaaccacagctacaacctacagcttacagtgtccgcaaaattgtaacattgtgtccttccatcggcaacaatggcggcctcggtggagtacaagctggctccgcacccgtgggcgagcaatgctccgtcgagcaacctcgacttgttcccgtccggcggcggcaagcgccgttcgggctccgagaccgactccgacgacgaggacagcataccaccggactggaggtcgctgtaccacccgcggctggaggtggcggagccggccgtcaaggacccccgcgacgaggccacctccgacgcgtgggtgcgtcgccacccggcgctcgtccggctcaccggcaagcacccgttcaactccgagccgccgctgccgcgcctcatgtcgcacggcttcatcacgccggcgccgctccactacgtgcgcaaccacggcgccgtgcccaaggcggactggtcgacgtgggccgtggaggtgaccgggctcgtcaagcgccccgcgaggctcaacatggagcagctcgtgaccgggttcgaggccgtggagctccccgtcacgctggtgtgcgcgggcaaccggcgcaaggagcagaacatggtgcgccagaccgtgggcttcaactggggccccggcgccatctccacctccgtgtggcgcggcgtgcggctgcgcgacgtgctgcggtggtgcggtgtcatgggcgcctccgccggcgcggccaacgtgtgcttcgagggcgccgaggacctcccaggcggcggcgggtgcaagtacggcaccagcctgcgccgcgaggtggccatggaccccgcccacgacgtcatcctcgcctacatgcagaacggcgagccgctcacgcccgaccacggcttccccgtccgggtcatcgtcccgggcttcatcggcggccgcatggtgaaatggctcaagcgcatcatcgtcgcgtccagcgagtcggagagctactaccattaccgcgacaaccgcgtcctcccgtctcacgtcgacgccgagctcgccaatgccgaaggtaattaaccaaccatatcttcctcgaacgcactgcacgagacacacattgttgcatctttgtgatcttaacttgtgtgttttttttttggattatgtgcagcttggtggtacaagccggagtacatgataaacgagctgaacataaactcggtgatcaccacgccgggacacgatgaggtgctccccatcaatgcgctgacgacgcagcggccgtatacgatgaagggatacgcctactccggtaagccccaagcccatctcatctatcatgttgtttgtttttgggcttcggcctgctcgttctaaaagcccaccatgatcactttatgcttttactgggccgttataatatcagtatctttgtactgatggtgaatgggtgattaacggtgatgattttctgttgccaggcggtggccggaaagttacaagggtagaggtgaccctggacggcggcgagacgtggcaggtgtgcaaccttgaccacccggagaggccgaccaagtacggaaagtactggtgctggtgcttctggtccgtcgatgtcgaggtgctcgagctgctcgccgccaaggagatcgccgtccgcgcctgggacgagtccctcaacacccagccggagaagctcatttggaatctcatggtaagcactaagcaccagcaacggcaacgccatccgtttcaacgacgacgatgtgcttacgttttggttcgtgtgcgtgtgtgcagggcatgatgaacaactgctggttcagggtgaagacgaagacgtgcaggccgcacaagggggagatcgggctggtgttcgagcacccgacgcagccgggcaaccaggccggcgggtggatggcgaggcagaagcacctcgagacgtcggagagcgcggtgagcacgctgaagcgcagcacgtccacgccgttcctcaacacggccaccacgcagtacaccatgtccgaggtgcgccgccacacgacgccggagtccgcctggatcatcgtgcacggccatgtctacgactgcacggggttcctcaaggaccaccccggcggcgccgacagcatcatgatcaacgccggcaccgactgcaccgaggaattcgacgccatccactccgacaaggcccgtggcctcctcgagatgtaccgcatcggcgagctcatcgtcaccggcagcgactactcgccgcagagcagcagtgctgacctcacgtccatcgttgagagccctacggcagcggcggcgcccgccgtgccggtgtcgaccgtcgcgctgtccaacccgcgggagaaggtgaaatgccggctcatggacaagaagagcctgtcctacaacgtgcgcctgttccggttcgcgctgccgtcgccggaccagaagctcgggctaccggtcggcaagcacgtgtacgtgtgcgcgtcgatcggcggcaagctctgcatgcgcgcgtacacgccgacgagctccgtcgacgaggtcggctacatcgagctcctgatcaagatatacttcaagggcgaggaccccaagttccccgacggcgggctcatgtcgcagtacctggactacctgccgctcggcgccaccatcgacatcaagggcccgatcgggcacatcgagtacgccggccgcggcgccttcacggtgaacggcgagcgccggttcgcgcggcggctcgccatggtggccggcgggacggggatcacgccggtgtaccaggtgatccaggccgtgctctgggaccagcccgacgacggaacggagatgcacgtggtgtacgcgaaccggacggaggacgacatgctcctccgggaggagatcgaccggtgggcggcggcgcacccggcgcggctcaaggtgtggtacgtggtgagcaaggtggcgcggccggaggacgggtgggagtacggcgtggggagggtggacgagcggacgctcagggagcacctgccgccgggcgacggcgagacgctcgcgctcgtgtgcgggccgccggcgatggtcgagtgcacggtgcggccgggcctggagaagatgggctatgacctcgacaagtcctgcctcgtcttctgaaacgtgacgtgtgtagtgtacgacactgcaaaaactgtacatatacgtagcatagttgcataaattttaattcaaagtttggagctctctcgagttccggtacatcggagtagcgcgcggcggtcgcattcgatggccatggaaaaagtgtagagtgtagattgatggatggttgtgcacatggttcatttgagaatcaagatgtatatttcattggtcatactagagcaaataaaaccgagatattactacgactgtaacaatctgttattacattgtgttgactgtcggcaaaactcactcctctgcctgatatttttcaaatgtttggaaatggctaatgttttcttcttgcatcactaaccaaattgttgaattgaagtgaggcccatatagaggtcatcagaataggcccactggcagcccacaagataatttaccagcccattaatcaaatcttccagcgtacgcctcctcctcgccggtccccaccgtcctatctcctctgtccagcgcgcagagctccgaaatcctcctcctttcccgcccatccccgtccccgaaatccccaaatacgcgcacaaaaatttccccacacgcggcgccgcaagcgcaatccgcaccacggcaatggaggccgccgccgccgacctcctcgccgcgctctcctccccgtcctcccaatccggcctgacctcccgcttcgccgcctacctcgagcccttctccccctacctacccacgctaaaccctagcgccaaaccgccggcgaagaggacggcgaagcagcgcaagcagcagccgccgccgccgccacccgacgcggccacggtccgcccgctcgctaagcggttcctccccttcctgtgccgcgcgctccaggtactcccgctgctactccgccccaaccctagctcaggcgacgccgggtgcaccgacgagctgctcgacgtttacgccctcctccttgactgcctcgcggtcatatcggcgtgcctcgccgggaagccctactccgtgctgctccagcgcggccgattcgtgtgctgcctcgagtcgcgcggacactacgcacgcgccgaggcggacgctgctgccactctggattcgcttcggtctgtgctgtcagtgccgacggcctcaaagtctcgccgtgctgcgactgcgagttttgcttccctccttcctgatcctggcatctcaggggaggctggtgcggaccctgaagtcaccatcctcgcgattgagctcaccgtgtgctttgctaattgtgccagcaagtgcaaggtgaaggaagctgccccatacgaacgggttgtcagccttgttgaccaactccagccatggcttcggtgagattgtgtgctcagctaagctttgcattcagtttgattaataaaataggaaatgagtggtttaaagtgtacttctgtgtgcgcaggattctggctgaggatgtcagcaggaagtatctgacactgcttgtgaatgcattaagtcgctgtgccattctcttggttgctgaatattcagtgttcaataccaaccttgtgtgtgaattctgtcgtgcaaccttgggggagtgtatgaaggcgcaaactattgaacgcttgccggcagtatgtatcattacacaattgattaccctctcgaatttgctaaaaaacgtggctagtcaatgatgttactatatttttatggatcaggttgctcgcaagatttgttcatctgtagatgtgagttggggtgggggcactcagcttttgcttgatgtcttaaagaccgttgttgggtctgctgcatgtctaaaggtattttcatgcttcctttgtttttatgcagctggaaacctctttctagtttgtagtttctcttacattttaatttgcttaaactggtaaccatgaatgccccttatataggaccatttccagtgcttgttattcctttatgttaaatatcatcgaggactgatcggtgctgtttcactgtatcattttccccctcttttgagtaatgtagtcatgtgccatctgatgggctaagtgataatgactagaaacaactaggtcatggagagcagatttgtggcgcactctggcctgatttgtttatttgtaatgtgcaatgacaccttcatctgtctattctttcattccataaatagccaacaacctgtttttctgccaaggcatctttacctgtgtaatgttgtcatgtaagtgatgtaacctttttcaggctgacttaccaagggctgtaaatgggcttgtagaatttgtagcatatttttctcgaagctttgtttcttcaaattgggatttatctgttggtgctgctgagctaatttatgaacaaggtggttatttctctgaggtacatgctgtactatttcgttagcatcatttaatgtgaatgcataccatcccaatgcaagcagtgcttttgattaattcaattacttgctgtgtgtaggtttcctcaacccctgcaactgcctcagtacttattctttatgccattggattatactgtagtgctcagcaaattgaaaatagagagcggcctcataaatccacagattttcttaatgatgaaaagcatctacaaactttaaagagtgcccttgccacactggcacatcttttttgttttgccaatggtagatccattccacttgatactatgggtaaagcttctagttcatcaatgcagcctgggcattctaataagaagaacagtttgtctcactctgatgaccatatatcttttgtggcatacctggattcgctagagtttctttgcaagatattatcacagtacgtgaatgcagtttggaagaacttctctgaaggaataacacccaattattctataaacatgacctatgtgttaacagcactgcatcagtttatcaattccagcattgcagcttataggtaggttcatcagaaatacacaggcagcatttgtcagctctacactatgttgcaagttattttcaattattgatatgttcttagtcaatagggttcccacctatgtttatatgagcaaatttgcaaaatagttatgttgatatagatgaaacaaaagggatccctgattctgcgtgttgaattttcttgtgacagctgtacagaaatgcctgaaggagacaaggataaacagcatgaacaacatggaaccttgctgagagccctagtttcagcaatgaaagtttcttttattaccaatgaaggtatccaggtaccccattcgcttttcctgtatctatcttggagttaattgttcgtttggtcacttaattactgtttgtggttcacgttggtccttcaactagtcaaatcaatcctcgaatttcattaattagctcttttagtccttgtgtgtatgtggcatcacacatctctatgctgagtcagcacctaggatctccagccaacctagagtacatgaaatgaccaaatttgctctccattaacatttttttaatttccattgctcatagacccaacagagcgtctgttgtgtttgtgcatgatgcataaaaccatgcagtgaaataattagagggtatttcattcgtttctcatagttcttgttgggtaaccttggctgctgacccagaatatggacgagaatgg

SEQ ID NO: 1542 - DNA, 3982 bp, Oryza sativa
  unsure (1)..(3982): unsure at all n locations
catgtgaaccttcctttcgaagggaatttggtttcggtggtagtgttcatgaggttgatagtgtcgcatcatctttggtttctgatgtaagttttgttatttgcagcacaattgcattgtaattatggctgtttatagttttctattaaccattgtgtactgtgaatctacaggctactgtaaatgatcaatcaacctttctagctggctatctgtactttgatttatcagaaagacttctatcaagaggagaacttttccaggtagttgcaccggtgctccagtttgaaatatcatgtcttggtgcaagatctttatttgtaggaatcattgctaaattgttgtcttggttgatattttagatttcttgtgatataaacatttagtagttctgtttttgtaggccttttcatacggaaaagaggccttgcatttacgcaagaagctcctaagaaagaaattcaaattcaattttggcaagtttacaagtggggaagctcaatgttctggagggcaaaactctgtttcacttgaagcatggggatcaacaataactgaaatttggccagattctaccagatcaactggaacaagagattctttccttactccttggactgtactccagtgctatcttgatagcattttgcaggtacaataatgacatggcgtaaaggccattgcaatactctttaatgattgaaaaaatggaactggtacaccactgtagtcaaataaatgtgggcctatctgtcatgtcaatgtgacatccaacctgctgatgggtgcctactgtggtatgcaaatggctgtagacataatttttacagtgcaacacacaaattgttggcatttggccagcattcttaacttcgggaatgatgcttcctaaaataaaaagaaactttgtgcatgatgctcacactgtaatgcattaactattcaggttgctttgctgcatgaattgattggtaatggtgccgaagcagaagttttgttacgaacaggaaaggatatatcacaatttcaaggattgccggtttttggtgtccttttcgcatcagctttaggtatgtgtgtttatatacttccttatcaattttaggtctgtgcgtatatatatacttttacatcagtgttacgaagatcaaagaggcactattacttgtaatttagttttggcacttcataagttatgaaaaggacctcttgggacttctccaaagatagtactacctccgtttcaggttataagactttctaacattgcccacattcatataaatgttaatgaataatgaatcttgacacatatatatgtctagattcattatatatgaatgtgggcaatgctagaaagtcttataatatgaaacggaggaagtatacaacagttgtacatattgcttttggtggtttttgcgtcatttgtccttctgcctcatgttgcctgattttttaggtcaaatataccgcaagagacagcaatgggacaccgcagagggcgagcttaaatatgccagggatcttcttgcacaaaatgctacattcatttcgtgcaagctctgcaagttaactctggatatatcacttgatgtgcaagctggagatctattttggagtctatatgagaaagactttcagaaacagtcagcaggcaatttgtctaatgctctaggcatgtatcagtctgccctggataaactgaacggcaccaaattggaatctcctgttgactcatatgataagcttaaaactacttgcattatctgcagcaaatatgggaaagaaccattagctgcaaatgatggagtgttaccttcatgtactgtatgtgcaaattttagtcaggcttccggtgatcactcgaatgagtttacggcattaaaatttctgaaacataaggattctgaatgttgtccaccattggatgttaaagttaaaaggacaaccagaaattcatcacgtttagctaaagaacagaatgtggaagctcatgtaaaaactaggacgcgctctagtaagcgaactgctcatatgaaaggtgaaaaggcttcaactgagctacactgtaagaatggcctatcttgcagcgataatctgtccacagatactttggtccgtggaaaagcaaactgtatccttgatggcgttgaccagagcatagattacacatgcagtatatttggatgttggaattgcctttttgtgaatacactcaactctgggtccatccagaatattttgcaattcagatgggattgtgtttggcatcacaaccatgtgtctatcctgttaaaaataggtacttttctctatttatgctccttattatgtgtgttaaacaaataaattgcacacttgacgtaataacatgtgcgcaactaagggcttcacaatttgcgcataaattacgtgtatgttttcaggtttttgctagtttattttcgatatatttcatgtttaatcatttattactattattttttagtaacatgctataacattcaagaggatacctttattatggaagacccatggaccagtccagtttttcaattttgtatacctggcttttgagcagttctctgttgaacagcaggagtgcagttatttctgtgaaatgctgttggtttacacatatgaagatgggaaatcctcttttagctccaaatgatattcatataaagttaagtttatttatacattcgaagagattgttacgggtgaacatcaaatgatcttttgctagctgtgaaagtgcattgaatctatgtgataggtgaacagatagtagtccttttgtttaagaagtctgattgaatttattcattactaaattcctatataatatattcatatagtttttttttctcacttctgagtgttgtattttacagcaaaagccttgggtgctcatggaggattgcatggagctcataaaattcataatatctattggcagtgcatatcattgttgtactttagatcccttcctcaggattgttatagaacttatgagcataatttatttggactaatcatggatcagagcactggtgattttcttatttcagagagggcagaaatattatatagtatgagtttgtttttgctcaagggcttcctttcagaacagtcaaggttatttcattgtcttgctatagtatcagtcacatatccacattgcaaccgggngnttcgtgaaacttgtgtaagttgttttcatttcatctgtcttcagggacatatgctgccgcttctgcagtgtaaaatgtctgatgttgttccttggttgctgaaagcttttgtgctgtccagagagaatccctcactttttcaggaggtctgtgatttcctttagtcatgtttccatgcagtataatgttttaaatgctcattgcatattcttaattttatcatctctgagtgcctgctgagttcaggctatagtttccttccgtcttcaagtatatgttttactgttgatggttcttgtgttgaaatccaactctcttggttcaggtttgcaggctacttgcatgtatattcttacttgcaacgattgattccacggctcaattacctttatactccagtggatctctctctttgaatcattgggctgcatactttcatcagaattctgttggaacctatctcgattgccagtactttgctggcttaaaatcattactcagaaaaaatgactcgaaggtttgtacgtaattcactgctaaatcaacacattccttttcatgtactatttatctttaatttttaccctgcatttcaggccgctcttgaagatttttcaaatgcgtcagatgagagtctctcaaagtttttcaggttcaaaatgtttatgtagtaaattagccaaatcattatttgtcattgtataggggaaatatcatgtgaaaacgagctaagtgtttgaaactcgcgaaaatcatatctaaaaagctttgtaaattaatga

SEQ ID NO: 1543 - DNA, 17162 bp, Oryza sativa
acactcaccaaattcaagtccaaactcaacttcattcgagagaaacaaaaataacaaatttcagttgaatagtgtcctgttactattcacccgaaatttgttctttttttactcccaaataaagttgagtttgaacttgagatttggtgagaatgtatttcatatctacacctatctctagtaatttttcatgaatttacaaaacttttaggtatgattttcaagagtttaacacttagctcatttttaccggatttgtcctccatggtcatatttaaatttctctcaggttttcatcagcagacataggacatcttgagatacatataaaagaattcttccataagcttcctgatgtaccaattgtgtgcattagcatgcttgaaggtgattttgtgaatgttcttggggaaattcttcttctcccttcttattttcctgcttggatgatgctttcgaggtttgattcaacaaacaaacctattacaatgcttttgccagtggatgctatttctaaaggtttgttgattccatattaaaattgcatagcttactcttagtatttcttttgtgttttttttttctcacatggctgttgcttggcagaaacccaacatgaagattcctgtaccaaagaactggacaatctaatgagagccacagataagaattggcagtgcccttggggctacactataatagactacgtggctcctacttttagaaagatacttgaggagaactttatttccctctctagtgcaaccctcactctgaatgatggacaagcaaaccatgtaaagtggtggtcacatagaatgaagctcaacaaccaccttgataagatgctgaagtaagatttcttatgttatggcaaaacttgaaaattgattccacaagatgtattcctaaaaaaatgtttgaattttctgttgttgagatggatcatatttttaataactttttggttctggtatgttatgttcttttttgaacagagacatggaggaatcatggctggggccatggaaatgccttctcttggggtatgatttaactgaccaacacattgaggaagctctgacaaacctgattgctggtctggaatcagaattcaaatttgaagtaaatccagtgctcatcaaggtcatccttggtggtgctatgtcagtggatgaagtgcaggactgtgtttcccaacttatatcgtataaaggatattttggccgaggagggtgttgtgggaaagacagacttagagccttatcttcttgctgtattgagtctgaagctctggagacagtcgaatgcttaataaaaagtacagtgaatgagctgattgaaccagttgatagagatccagtcatttttgttctggacactaatgtgcaggtgagcaataagatggccagattgtgaactatgtttactgtgtgggttagtacatgtgcgtagatatttcttcgagtccttgagatagtgttatggatgttttccttgactgttcggtctaatggtaggaatagatactgtggattcgatatcatttgtctcaagcctgtgttggtccaggtctgtggttgtatttaatatgaatatgaatattaaacataaccacaaatatcttaaaactgtcgcaacagcttggcacttacagttgttgaatttactgcatcctttgttgattaaaaaaagaataaatttcagaaaacgccatgctttatggttggagttgtacaaaaccttaggaactattactagcatagctccatagccctggatattatggtcctaaagtttcacaaaatcccacccctatacatgcagagcatatatttacttattttttaaaaaatatggagtgtctatgcttttttttaattattgacttcttgattaaggtgattggtttaactcttcactaatttgaataatattttttcagatatgctaaaattaatagagatttgaatgaagttggggatttatgaaacctttagacaaaaaactgtggttatgtgagtcataatacgtgtggttttctgcagctttaactataaaacatggcattctctgaaatttactctaaaaaaataattgcctctgctttttttttcaatttcaatcagcagtccctgtgactctgtgaggctgtgatgtatgttcctatcatttatgatatcttcattaacctcttttgtttaaaatgattaaatgcagatgcttccttgggaaaacttgcctgcactaaggaatcaagaaatttatcgcatgccatcaattggaagtgtctttctagctttgactagaagtaataattattggaaagatgcccgtgttatagctcctccttttcctgtcattgaccctttcaacgcattttatctgttgaatcctagtggagacctgagcagtacacaagaagaatttgatcagatgtttaagaactacgaatggaaggtaacattgatttgacaacaatttagaaatgataaaacaacagtccttgttctaacaaccatttctcagtgctaaatttgtgaaaaataattgcttccaccaactgtggaaatgctcttgttgggagatgagaaatggttatattctggcatctcaatgtgcttgtaaacatgtgcttgccataccaaaagtggttatatttactgctcctttcactttagaaatataaatggctgcaaaatcttgtctacctgtaggctagcactagatacctctagctcagcttgtctgcttattgctactgttggttgcaactaaatttaataaattgcatcaatcaactacagcgtctaacatatgtcatagagataacaggacatgaacccttagggcttttgcaggcttgctggagcatttatgttgcatgttaaagcatgaatttggatgcctatatagtgcaccaacaaacggttgtgatttgtgaatgttgcaacgattgtatgcagggaaaggctgggtatgctccaacagctgaagagctggtgttggccttgaggaatcatgatcttttcctttattttggtcatggaagtggtaagccctatagatataaagattgtagtcatcattttgctggatctacatattaacgttttctcccattcatgttaaaccctgatgccttcggtcctcagaattaagtctagtagggtaatactccatccatttcaaaatataagcacttctagagtttttcacgggaattaagaagaggtgaaattaaatgagggatggttgtcatcgattaagatgagaaaatatgtagagaaattaaatgaaagatggttgtgattgattgagataagaaagtaggtggagaagtttttgcatttcgggataaaattttgaacactagaagttatattttgggatggagggagtaccatagttaagttatttgctgaacctgttttctttttactgattgctgcaacagcgatacattaaggattgctattttcaacgggtgataacatgacctaaattgttgattggtctattatggccacctgggtgaaatttctttagatgaatactcaaacccagcttttatataaaaataactaaagcttgaaccgctaattcattagatggtgcccttgagtcaactacacaaaccggccacatgtgatagcagagtgggttatgtgtcaattggaacaagaacaactgcttctagggggcccagtgccaatggatgctttcaagttttcaattgtatttattacctattgattggactgttaggaataagaactaacctagtgatcatgagtatctttgttcttactgggcactgttctggtagcctttgactaatacagagaacagccattttcatttattagaactaaacagttattttctaactggtcttgaaatgttgcaggaactcagtatgtctctggaaaggaaattgagaaattagataattgcgcagctgctcttcttatgggttgcagtagtggaacattgcgttgcaaagggtgttatgctcctcaaggagcccctttatcatatttatctgctggttctccagctgttatcgcaaatctctgggatgtgtcagataaggatattgatcgattcagcaaagcattgctcggttcatggttgcaagagaattttgtagcggccaaaaattgctcgaagtgttgccagctaacacgagaatttgaatccatgaccattgctgtggagggtaatggcaggccgaggcgaagaggcacacgagggaagaagtccgaacgaatgaataactgtagtaagcgttgcacttgtggcaacaggcgagtagcttcatatttaagtgaagctaggcgtgcttgcaggcttcctcttatgatcggtggatctcccgtttgctacggtgtgcctaccatcattaggaaaaagtaactgccctgtgctcaagtgggagattttgggtgtccaatgcgcctcctggttctgggcattgagcaatcgatgacatgatggtgtatggcgtttgacagaagtgagcattcttggcaccgcattgcacgagctcgcatgtgcttgtgatgtttgtgatattcattcgccatctgggaatgtagatcaggcaagatggtgtgaattggcagatgccttcgatcgacggtttactagaagatctgctgtggaaatgctcatcgaccgtcgtgaagagatacaaatctttcttcttgcaagtatatacaagtaaatgattatattaatatatgctctgtagaatgtagttatgaacaaaattgtaatgttatgttacgggaaatcatttagagcatgtatgttgatgtcataaagtgtagggcacttcaacgatgaagtgtcgaactcaatgataatgtattctacagtttctatgtttggttgaaacatgagctcaggtcattgtaagatcttactgcttcttatgttgtaatatcgtcagtcaacacctccggtttagcaaatgttcaaatctatgtttagtcagcactaagcacaactgaatatctgaagctggtgagatctaaaatcgatccccactggattaatatttagcagagcttctgaaaaactggaaataaaggctacacaaaccgcacaagatgggtgcggtattttccttttcaacaatgaatgtgagatggcatacattgaagtgaaacaatgagctaaaaggttaagacaactactttggtacatgatcatgaacaagtaaattgaggttgaaattgatgaatgctatgcaccagagaaccaattgtgcaatgtactcctccagtggtaaagcccctgttgtctcaattagcacctaagaacaacctctcgcggtttctacggcggcgccgacgccgcctctctggtctaaccataccggtgcttccgcctccggccataaccaaatcatcctcatcgtcgccttccaaggggtaatggtaaggcgtggttgcatttgcaccactgctcaccgcataattgtcctcggcaccgccagttgtaccaattgcattctgaagcctttggttttgatgatgccgagcaacttggcgcattagaaacattaacattcgtctagtgttatctgtcccgtgtccgttggcattgtcatcctcatcactttctacatcatctaaatcatcttcatcttccaagtctagcacataatcaccgaaaacaatcgccctccccatagttgctgttatcgtactgagtgcatcttgcctctctctttcaatctctagcaatctccacttctgttcaaggatgggatcgacttcccttggctttgcaagagggtgctctgacttcacatgcttgcggagttccttgtaggttcctacaaatgagcaaccatcctgcatgcatgtcctccttttcccattgagataacttcgagctggttctactatagtccatcccttcaccttgccacgacacagtggacatgcaagatcaacagactcatttttttcacctgcaatcaatggcgtcgagtccaagttcgtgccaacagtgttggcaggaagttcctctagcaatgcacccttggtgtaagccttcttgaattgatcaaggcaatttgagtggcggtggctagttccacacatgtaagggcgacaacctttatcatgcgaagaacaaaggaggagaacagcattatgcgggtattccatgcacacagagcagttggcatcttcccagtccatcttctgtgcagctggcagagttttctttcggtttgattctttcattgctttccagcggtacgaagggatgggatacggtgcggatctaagctgacgagccacatgcctccttgcccttgcacttcttgccatttcttcggaaacctgtccagaaagaaaccataacgtgatttgcatgaattgttgatacagttgttttcttataaacaaaaacaggccagggatctgcaaggatattaaaatacaagataaacacagaaattaaccttctttagattacaatttttttttgactgggaaaactacaagggctttgcctagtagtgtaatttcattaaagagagaaaatatgtacaaggttaattctttatattacaatttagcaaaacaaaagggaaaaagattaatcaactttgtcaagaatgtgttgaggacttttttttggggggtgggggtgggggtcagtaggagctgcacagatggatcttccttggccaagtcaaaacatttcctgattccttatctggtcattttcatcatttgtcaaacagaacacacaaggcaacgtaaaaatgaacacagctttatggatggatagttgaagggcgcaactaaaatcatgaaacaaaaaacacaaatcacaactgtccaacttccaaaggcagcaatttctgttggcattggaatcaccatttgctgctccattgaattggcataaggaggaaagtttaatatttaacatgatgatagggatgaaccccgccacagaggcagtgaatgtagaccctgatataatcacataatcaaacaaggaaaagaggcatccacacagttatcatttttgtgagtcaaatcaagcatatgaaaccaagcaaacttactaaactaaggctgcaaacttataaaaaagaagcaagaagtagcaaactggcattgtacaatgtcaaaatggaaaacaaacaaaaagatcctccttggttgttgcaattatacaagaaaaactcatgagcaacattaccaaccaattgcagctttactcttgcagcagccttcctccttaaaccaagtcagcaaacttaagatccacaacaatgactaacaagcaaccaaggcagcagaagtcacaggtagactttatgggatccaaccacagaagggtaggaacataaacaaacgaatagcaacaaccaaaggcttttaaataatcaaatcaatgaagcacattagatgtgatctacaatacccattaaaaaagtcacacctaagagccagataagagataaagggaaaaccagtggcccacatggagcatgtcaggacccctcccagatctaccagaattaaagagaaacaaggaacaacacataactttttaattagagagaatcaattgatactgcaattgggccaaggattccatcctttaagaacatgctaagtaaccagcacaagaaaggtatttgaagcaaagggcttctttaagttttacttcaatcttgatcctcctaccatgattgctaacacatggatggaggttggcaaaagggttttcttatgccacaaattggttcaaaattcaccattttcaactcaaatcagtgacaaaaacactttcttctccatctaaaaagtgcaccttatccactgaatagtgcattattaaatattacccgagaagcatctttcttcgttaactttaagcaaagaaatgaaagggccacggcccaagactagataagtgctcacgatttaactaaaatgctatccgaaatgctattttttctacgttaatggcattatcaatgggcacaaggacagttcagaaaatgaagctttactgccaattaaatttccttactacagtaccttctcgcagtagatcatttcctacaaaattgttaatcactactacaacaatcaaaaagcttaaaagcatcaacagaagctcaaaagatacattaaagggtattttgctacgccattgcggccaatcctccaatctacacgcaaagaatacaccgagaacaccgctctcgtgctactggttcaatgactaaaattttgacaataggaggccccttttgctcgcccatcttcgtttttaggtcaaataccccagcaattgtaaccacagtcacctaaatcctcactgagaaggcataattcaccttgataagatcaaattaggccatccagtctgagatcccgacctagaccactcccatcagagagctccacaaaattctcccgaaggagcgccaagaaccagccagaaaacactcaaatcagcaccggaaccccccaaattcccccaaaccaagaagaattcctcccatccgcacccaaatcacagagatagaaccccgaaacaaagctccctagccaccattccaggacaaagaacttgggcctcggcgcctggcgaaccaacccaccaccaagatacccaaccaaccaaatctgacatgttcgaatcgggacgaagggcatgggcaggggggcaagggcaagtacctagacccggggggcgagcgcccgatgcgggagcggagaggtcagccggattccggcgcggtgagcgcgaggccgcgacggagttggagacgacgacgaggaggaggagagcagcaaaccgagcgagagagaaaatggcgaaagacaaggacacccctagttaagccaaattaacgaaaaaaaaactacaacgaaaaagataaagaaaaaatggcgcaaaacataaaaagtggattagaaaggggagaagacgcaaagattctgggcgggtgggccccacgttttttggtgcgagttcgcgttgcaataacagtttcgccgcctgttcacccctgcgtggacccggtccatgcaccggctccctcctcgggcgggcgggagccgggacggaagccggggtcgcggtgcagtccatggaccgcgtccacgcaaaagctggggtgacgaaaccggcggagacggggggtgccttctacgggacgtgttgcgatttgccgtacaccgttgaactgtagcacgttgagagagagagagagaaaataaaatataaaaaggaatattcctcttatcgtttgtacttttatcgtagggtcgagtaaatttcggcgtgttaacccgtattaaacgggaacagattccttcccgccggtggtcatcaacctctatgtaaagttagtgagttcataattggaacagctaaaattcattaataaagctagtgagattacaattggaacagctgaaattaaccccatggataaaattcagaatgtttgttttataacttggaaaagtaggaatgtctcactaagcagagttttacttgaccaggcaactataatttcctcgctgtcactgcgtgattgtggtggaagacggggggattaggttggaagattcttgtaaacacgcatgagaaacaagcgaagaaatagcagtaatgagttgggattaaatcaaccatatccgatatattctgatctgggatagggttggataattggattgggcttggcgtttttcggatggaccgagaagcgcggctcgcacgagatcaaaccgagatcgctcgctgctcctgcgattctggatgggtggttcaggcttcaacactgagtactgaaatttcttcagagaagagtttggtggctttggtggtggtggtggggcgtgggcggtggctgatcacatgatccgtgggactgtggcttttgctggcgtattggtccccagcctctctctctctcctacctcctgctcgaggcttcaggctaatggccctgtgataaaagttcagagaagttcagtgtggattttggggttttgtactaaggctgtgttcgttctagtgacattgggtgagaaagctcatcgtttttcgtgcgcacgcttcccaaactactaaacggtgcgtttttgcacaaaatctctataggaaagttgctctaaaaaatcatattaatccatttttgcaatttaaaatagttaatactcaattaatcatatgctaatggcccacatcgttttgcgtatcttcccaatctccccaatccccttcttctcaaacacaccctaatactacaagaaatttcagactttagtgctgatgaaagtacatgccaggaggggatttaacactcgtgtaagtacaagcaatgactgagcttaacggaaaataggcttagttacgcgaaggacactactgcaagagagcataggcatgttccagaaatggtcagaaccatgtgaccagaggtgttagaatgatcaatggaaacaaggggttggaagttggaacgtagtacaccactctagagtctggagaagcttgtccggagcgtacagtgattgttttcctctatacgaatgtaatatgcgatctctgttcttccttgtttagtgataacatttcccctttctttttgggtaccgagacaactttgccctatataccccatatataagatatcttactgaactgaagagttagcggcttagcgttctctctgtgaaattcctctggggccttacagaggcctgccggaagatcctgtccaccatactggcttctaatgtgctacaacagtcgcttcatgcgcaacaatagtttgcaggcatcgatccggcctgcatcctgatggccgctaccaacaagctggttcgctgcaacggccttgacttgcatattgcatccccggccgcgccaatctctacgtactccctctgccttaaaaaaaaaaagacaaacactagatttttatgtcaaacgtttgaccgtccgtcttatatgaaatttttttataattattattttcattgttgttagatgataaaacatgattaatactttatgcgtgacttgtctttttaatttttttcataattttttcaaataagatagacggttaaacattgaatacgaaaacccagggtttgtctttttttttttacggagggagtatgttttacaagagaaagctgagctgacggcgccagattgctaattagtcaggagaccatgcagagtgcacagtgcactgcaggcttccttaatttgaatggtgctagacgacgttctcaaaccgaaaaatcaaaaggaaaaatgagttattcgcggaacaactcttgcactgctagcagtacagcacaaaacaatacttgctgaattcgtatgatctgtcttaattaatactcccttcatttcagaatgtaagactttttagcattatccacatatatatatatatatatatatatatatatatatatatatgttaataaatttaaacgcatacatatgtctacatctattaacatctaaataaatgtgggtaatactagaaagtcttacattatgaaacggatgaagtagtcatcaagctatatatttatatatatatatatatatatatatatatatatatatatatatatatagtactagccacaagatttcaaagtgtggttttgttattaggcctaattcagtattgttgttctggaagccaactgataatgcttgatcagctacaggtgtgaccctggcacagtagcccatacagtgtttcataaatgatgcgatcctgtcatgatgtaacccttactatttaagcgaacctctgtggacatttgttttctcaaacagaaaaaataattgtcacaatatatatagttacaaccagatcatgtgtataattaatagaccaaataatgaaaactctttttcattaattacatgtctagccacttacgttgtgtaacatttttttattctaatacattgatgtgcaattgttttgcgtgttaaaaaaataaaaataaataaaaggagagagcaaaacaaccgatcaatttagacatagggaccaaattgaaaccactattaaatgcactgatatatccaccggttagttttttttctccaaaatttaaaatgccggcaaacattcttgaataaaccaagggcaagtgtgaaatcgactgcccataagaaaatgagaaattttatggttcttaatagagcaggtacctacattttacactaaaaattttgataactaataccaccatatgcatcaaattttatactagaaaatattttcaatatagaaaatatggtaactcccgataactccttaagtatggtaaaataaccataaaaatgcttataaatgtagtaaataaaaaactgttatagcacacagaactgaacccccacggccctactaatataggatactactttgtatgatctgaatatgatcgtacaaccttgttaattaataaagacgatgaacagatactgtaatttacggttaacaacaattcgatctgttccaaacaaaaaaaaactgaaaaattacaacgaaatctccccgaaaaaaatgtttccaatgtgtgatttcccctagtttgatttgtttacacgcaataatcctaactgatttcccaatcattgaatcaatcttgtcacatttgattagctagtaactagtaatataattctcactactactcatggggtggaagtgattcaaccacgccccacttactactactcttgccgctgctactctcgccgtctttccccatgaagttgttgatcgccgcggcgatcgccgccgagaacttgttcgggtccgacatcaccgcgccgacgttctcggccaatgccgccggcgccggcttgtccccgtcgccgccggcgctccagaacggtctcttattacctccggcgccggcgagcggagggtggttcggagaccacgggtacttgctggagcctggcgcttgcggagctagcagagacgacgacgacggcgaattcccgaacaggttgagatgctgcatgccgccgccgccgccggtggcgcccggcattagcaacggcgaggcggagttgagcaggtacgggctgaggtaggacgacgacggcgcggcggaggcgtcggagacggaggaggaggaggtggtgctggagagaagcatgaaggtggccgcggcggaggtggtggacgccatggcggtggcgccgacggggagcgggtggttgtgcgtgccctcgtacgtcgtcaccaggatcgacatgtcctcgaggcatctctgcacctgcacacaatcaaacgagatcgatcaatccatgcacgaacacacatgatcatgcatgcaaccaatgctaatcaatctgaattcttgtcagtttcgatcgtcacctgcttccgcaccgggcagcccggcgcgacggtgcaccggtagtaagctcgcgggcacgggttgcccttggcgaccttctgcccgtatttccgccattggcacccatcgttcatctgcaccggtgcgacaacatcacaagatcaatattagtaattagtactcgtatcatgtactgcacgcatgcacgcacagatgttgcatgcattgtgtcttacggtggggccttggcaccggactcgaactgaaaccctagttttgcggttggccgggttgacgctctggctcgtgatgccgccggccgcggcgagctcgccggcggccggcgccgcgccaccctgcaccttgctgctctccagcagcgcgtaccccctcggcgccggcctgctgccgtcgccgccgatcatggccgcagccgccgcgccgtcgacgtcgtgcggccttgcttccaccgccttctggtcgtcgtcgtacgacgacgacgctcccaggctaagggacagccctagatcctccttgccgcagtcgctgtcgtcgcttccgacagagcgccgccgccacgcggcctgctccttgctcttcgcctccgggaagccgccgccgcagccggcggaggcggcggccgttgcgccgagggagaggaacacctcggtctcctacacggaaatcgatcgaatcaatcacgagttcgcaaacaacaaggcgtgacttaattgagtaatatggtaattatggtgtgtcacgtggaagaataattaaagtcatgcacgagatgagcgcgcgagctagagctaagcttagtttcaacatgggtaggctcaattggatatttagcctagctataatagctagctaaatcagcttggttaagctagctcagctaattaagaaattaaatcaccttaggctcatctgctgctgccggttgctgctggtaggcggctagcttcatctgcagctcgtagtagtcgcgcaccgtcttgtcgacgactcgccggagcatccggttctcctccttcatcctctccatctcctcctgcatctcgctgagctgaagaagcacacatatatatgtcaactccaaatgggagcaaaggacaagagaaatctccatcgatattaattctatctacttgcatcacatcaccagctaatagtataattaggagtttttataatcgtcggtaagtttaattgtagtactgtgtatagtacctcatcttgcgccatgggggtacggctatcgcctccgtcgtcgccttcgccgccggtggcctctgttaccatgtgcttctcttccgcgctagctccgactccgtcgctgtcgccgccatcgtcgtcgacgtttgctgctgcagctggttgcttgtcctcctcgatcatctctgcttgttgagtcctatatttgatctcctcattggagccgtcttctccttggtccacaaccacttcaactaccttctcctcctcgccgccggtttcctctttagggccctctcgttgcttgacatcaccatcttcctcagctgcagcagcggcgccatcgctggcttcgcgatcgctgccgccgccgcgttcttctggccgtcttctctctgcctccagggagagatctatggcagctctcttcttcttggatgacatgctcctggcctctttctggtaatcttgtgtacctttgtctctcttggtacagctaaaatggggaacggtcttaaatcctaatgctacttctcccgaggcatctaagtcaatgtctgggtgtctaagacgtattaaaagggcaatgaggagggaagactcctccttaatcctattatcccatgtcatctcatattcaacaaaatatattgccttgacacacatgaatgcgtatatatacacgaccttctacacctattgatattttttgggggcacacatgtcagtgatgaatacaatatgagggtttttacgactcgagatgaaatatcaacgagatggattaatctgaaggagtagtgtgaattgtgaagtgcacggtggtgtgatccaaatgacaagggataccgaagtcaagtgggggcttggtcatgtgcatgatgggagagagcgcttctaacgctaaggggattagtattgtatggagcccaggtcaactcttggaatttcttcagggccgctatcatcacgcaccttagtttccccattaccaaaatgacagattaaaatgtgagctatatatacattaatattttcttttcatatgtataaatctagcattctagttgcacaatgtcaactttcaatgccatgtttagtacttttatagaactcgctcgcgctataaattgaactgttgacttgtgtatgtgactataatttagtatcaagtggctcgcaagcacttcatttcatggagaatatagctgtctacagcaccttaggaattgagtaaaacaacatgcaaatttttttttgatgatatatatgtgttagacaatataattcgttcatgacctttatataattcttatgtaattaaggagtgcccttgattgaggttgctagctagcttgtatgcaaacctagcaaaacccaaaaattagttagaaaaaaaaacctaaggtgttaccattttgttttctaaacgcatgcattaattgtgattcacaacacttagtgtatatatatgcttcgatgtcttaagtcggacctctgcaatgttgactcatggcatgccatcgtctgcatcctgtaaggtgatagccatttcagtgccttaatctgatctccttctatagctcaccgatgaccgaagatttatacagtataatggaaaactaaggccggactagcagttgcgtctccgtataaaatctcgagtcaacttgtttgggccacacagaatttcagtaacaatgtatagttattattttacgccaactatcctctcttctgtattataatacacctttgatcctgataatttttttctctagctcttcgatcgtcatgatgattgaggtcaactggttgttggaaccaaaaactggctaatatataagctgttctcctttaattggacgttggacttggaatagatctcaagattctcattaccaccagcaatgcaacagacatatatatattatgaatgttaattacatattatggataattaatgttcttactattaattaatctcactgctaatgtaatgtatatgcatgcaacatctatcttatatcgttttcttttttgaaacaacctatctatcgatctgactatgcacaataagtaacagttttttttggttagaaaactcagctcctcgtgagaggaggagccccgtacgaaatcccaagacgtggcttcgggatcaggcattgcatcgatatggataacacttacaagggctagaattaatcaacatttcacaacaagacacatgtactgctacaagcaaagagtcgtaacaagacgtagttttcttggaattctagtgcgtgtgtgcttgtttttaatttaattttatggtcttgcctagcttgtaacgtctcatcagtcgtcaccgtcgtcgtcgtttatttcggcggttgcacggccggcgacgaccggagtgctcattggactagcctgagagtagtgtagatgtgtgtcggccatggcgttttccggttttccacgggtccgtttcaggtagatgtaggcatgttcagacgtactgatcgtgttaaa

SEQ ID NO: 1544 - DNA, 802 bp, Oryza sativa
tcttagcttgttggttttctccagctagatcaacgatgtgatattttcttgacctcatcatttaattattttctttctttctttttcattcgagacaaggagaatatatccgtagagtaagtttcaatgtacggcgtgtttaactcgatgccaatgttattgtcaccattaactcgatcccaaatgtaattgtcacctacactagtcatgcacacgtttcggtactctaacataacacgactgcaaagtaattaagctgtcaaattagttcacaccaactggtgtactgctttgtagccactaacgccggggcccagagtagtactgcgctaaggtttttcagtcatcaggtcttacatgtcgtcgagaggcgacacgtacgtgcctatattatcaccgattgaaattctctcacataactttcctccgatgtggtggctgatatatgaactcgagagtgatgggtctaaatgttattcacggtgaacgtataataacgtaatgtaagattaaagtgtgttttgattcttattctgtgatgaacaattgacatctgtgattattggttttgatatttggagattatcgtcgaagtggttttggagataatcaattttcaggtgatgatcggattcactattattttatgtgaccggtccgactaggtggtgtatgccggtcagaccggtggtgatcgagcggtcagaccggccagcccgcggtctgaccggccgacgctatgtcggtttcggtttcgggttgtttctttggatatccatgattgtttcatggttacgacttc

SEQ ID NO: 1545 - DNA, 13552 bp, Oryza sativa
aaatgagacccctacatcggaaaaaatgctttttctagtagtgttagttgtactagtatagcaagcagagaatgacatgatcagtgaccactaagccatgcgtgcaattcgaaatagaagcacagcaaactgagcaaggctagagcggatcaacaacctcacggagcccagaacaatagcggcgtagggacggaggacgaggttgaccggatatgactgttcctgctgctcgtgcctggcttcttgcttgaccggattgaaggctatgctatttcttggctgcttgggtgtttgcttgaattgacaacgatgcttgctgctgctagctgctgattggcgaggccgcgaagatagatgacgaccgcggcacacgggcggcaacaaaagagagtgctagttactagttactgcatctaccaaatttctgtaattaactgagtaggaagagttggaacagataatatctgatattgaactaactgaggagacagatgctatcctttgggcctttggcctctggcttaatctaactgctttttcaacaaattcgctctatagattgctcatatccctctgaaggtgaaacattttcactggcttgcctgtatggataggatcgaatctacatctcaactggtaaagaaaaactgggagagatctgaacttcgtgtgctgtgtaatgacttagaagatgctgatcatctcatcttcagatgccttttagcaaagttcttttggtgtgtacttagagatgcttcgatttcacaatcaattcctagttcttgtgaacacttcttctatgatgtagtaggccatcctagttataaacagagcagaggagtgatgatgctgctcggggctgctgcttgggcctagtggctaaacagaaatgttttgattttcaggaagaaaattttaaccacccccctgactattgttttccgtgtaacgttttatctgaggcaatggtctaaattgatgaagtaaaatgaagaagcggaggctaaggcgatcacagcgaagattttgttagctgttcaacttttgtctgcaaattgaactggagtcggctaaaatcttgaatatcgtcctctgttcagcagttgtagatgttttctttcctgtagctagttcagacggtttgtttggccaaaatgttggctggattgctcgtcttctttaaagctggtctccccagtgtaatttgagctgtgtaaactctcaagctttctataaaagctaggccactcaggccttttatgcagaaaaaaaacaggcgacaacaaagaagtgtcagccatgagcagcaggcgcgctatgacgacttgatgagaatcatgagatggaagatggctccgccggcggccagccgtggccgccactgtcgcaccggctatgtcagggcttagctagggttaggatcaatgctctcataccatgtcactatttgaaggaatcgggaagcgaaacgttagattggatttgacataaaaggcaatataaattgtgtacaatatatgtgaagttacgactctatctttgggagtgcatcctatacacacagaccctcgcgtgtacacaccgtgtacaccaactaaaaattataaaaaaaataaaaaattcatacatatacttctaataatattatatttacgtgcaaagtcgcatcttcaaatttattctacatagagagtaaaaaaaaggataaattctggtagaattacaaccttaaaactgtcagattttttgtttttttttgttacggtcaaaatataatgaatttgaggttaagattttgtccataagtgtaatactatgaaagtaaatgtatgattttttttaaaatttttgtgtcaattgttagttggtgtgcacgtgtatatacgtgagagcttgtgtgcataggatattgcctgtagacacacacttatacttaacaataattattaggtcgtatttctagagaaacataatagtaacagagggagtagtatggagttattgccacgagttttgccatgatctccttggatgttcggctttaaaagagaacactaaaacacacaactccctgcccaactacatagtaaattattgaaatttaaagaatgtacctccggtcaaaagtacatgtgagcccaactacacagtacattattatgtacctcgggtcaaaatgcacgagtaaattaaggttcgttaaggagtattaaaaaattgaaaaaaaatcagcaaaatagattagtatgtgataaatcacttcacaaacacgtaaattcaaatttaacttctgtaagtaaaaaaaaattgactgtgaatatacattaattagctatagtttaattttttttgtaacttatataattttaacttacatgtttatgtactgatctatcacatgtcaatctatcttgttgaatttgttttttcaaacttgctaataaataattgaatgacaagcaaactacggtgcgtctcgaacgtttagaatcccctgccgtaaaggagatcgatcccaatgtaaaaggtttgattccacaagtatataaaagagaacaatgaaagataacaagtcgctaacaaactatgtattgaattataaacatttccaaaattgtacctccggtcaaaaaatagtacatgacacctcgcagcagaatagtccacaaaccaaccttgaaaccaagaaaacaaaacagccacaccagattaaatattcagtaattaaggaggaaatttaaagaataataattcagccacaaaaccaatattttggaaaaaacttgtgtttgctgattacaaattaagtttcaggttaattaaccaagttttgtttcagtggaactcttcgtcaggcaacgtgccggccttggcgccgacgttgaagaactcgatgatgacctcgagcgggaggcccttggtctcgggcaccttgagcgccacgaacacgagcgcgacgcagcacacggcggcgtagaaggagaacacgccggcgagccccacggagctgagcatgacggggaggctgtacgtgacggcgatgtcgccgagccagaacgtcagcgagcagatggcaatgcagagtcccctcaccctcgtcgggaagatctcggcgcagaggatgttggggatggggccgaaccccatgacgaagcagcagaagtagacgatgacgctccccgtcgacagcgccgcgtgcgcggtcgccgccatgggcacgacgttcgccaccacgagcacggcgagggacgcgacgaggacgggcagcgtccagaggaggagggcgcggcggcccgaggcgtccatgaggcgcatggcgacgccgatggacgggagcatgaggagcgtggtgaggccgctgatgaggatggaggtggagtcgccggagaggccgaggctggcgaggaggacgctgacgccggcctggtcgaggatctgcggggtgtagtagagcacgccgttgatgccggagaattgctggaggatctggatggtgacgccgcagaagagggcgtggcggacgcccggctcgagcagctcgcgccacgccgggcccgtcgacgccgccgccgccaccgcctccggcgggttcgcgaacgccggctcggtggggctctgcccgatcaggacgtccttggtgtacagcatcgaccggctcaccagcgccgccgcgtggacgtacgccgtggactgcgcgtcgccggcggcgcccgagtcaccgccgggcgcggcctcggactcctcgtgcaggtacatgcgcttcaccgcgccgcgcttgacgccgtcggggcccacgttctccgtccacttccacgccagctgccacccgccgccgatgcccatggtgctcgccgtctcgacgccgccgccgccgccgatgctgctgtgccgctgcatcgccacctggccggaggcgggctcgttcttggtctccacgtcggtgctctgccgcgacagcagcggtgcctgcaggccgccgccgtcgtcgtcgtccttgccgtcgtcggagaggtactcctcctcctcctcgtcgaggtcgtcgtcgccaggctgcacgttctcctcgtcccagctgctgccgccgggcctatcgttgacgctaagcatgctcccgaggttggggaacagcgtgctccccctcatgctgcggtggcgccgccgccggactccggcagccgctcgtggacgctcccgagaagcgccaccacggggtccttcatctgctcgtacatgctgccatggcgcgacgcctgcagccccagcgagctccccagcatgctgccgcggccgccggcgaccggctgcgccacccacgaaagcccctgctccggcccgtacagcgtgacggtgtccctcgcctgctcgttctcgccggcgtcgccctcggacgggccgacgacgtagtcctcgatctcggtgtcgccgccggtgccgaggccctcgacgagcagcgccatctcgccggagacgtctcgcggccgcgcagcatctcgagcacaaccctggcctccttcatgcgccccttgctgacgagccaccgcggcgactccgggaggtagaagacggtgacgaacaggtagagcagcgaggggacgaagaggacgccgagcatgatgcgccagttgggcgagggcgagagcgtcatggcgaagatcatgcagtaggacatgaacatgccgccggagccggtgaactgcggcagcgtgttgaggcggccgcggatctccggcggggaggtctcggagatgtagacggggacgagggtgacggcgaggccgacgccgaagccgtcgacgaggcgggcgaggaggaggacgtagacgttgggggaccagagcatgatgaggccgccggcgaagtagaggagggaggaggcgatgagcatggggcggcggccgacgaggtcggagacggggccggagaaggtggtgatgatggtggcgccgatgagggacatggcgacgacgaggccctccacggcgggctgggtctcgagggcgaactcccgcttgatgtacagcacggcgccggcgatggtggcgttgtcccatccctgcaggtagttgccgatggcggccgccacggccaccaacacggcgcctctcatcgtacgtggcgatcgatcgatctcggatcggtttctcagagaaaccacatgaaaaagcgcgagagggattggatgattttgtgcaaccaacagggcgggtgtttgggtttcatgcacccgtgtgcgtcgcacgcgaggctaacaatagcgcctagtgttgctagctagggccatccgcgccgcgtcgaacgggggatcacaacaatgcgcaagggaaacatgcatgcttgcatctacggttttgacgaattccaccggtctccacgtacgcctaccgacgcagatgttatatgcacggtatactatgtaaaagagaaaatcccttgtatatctctgaaaatcccttgtgtcccttgtatacctagctactaccaatgtttacaatatttctttttatgaatgttcccgatcgaaaaaatccattgtcctattaaaatttcaaataaaaattttaatttattacatttattttatttccaaaatttatgacaaaattttctacaccaattatttagtctcattagttttataaaatgcacacactgtgcactcaaacaaaatttttaattgtttttaagcttatatttaaacctaaataagcataaaggataaaaaaatacatttgcaaccaaacgtaacagtgaaattatggaaaatatgacggtaagagcatggatgggatcaagttgaaatttcaggggtatagaaggggtcgggtaaatttcagaggtacgaaagggattgagtgagttttcaagggtacacggggaatttactctatgcaaaactagaagggaagttatttttatccctcgagggatgccccctagttgtttttatgtcactcaaatagttacgaaaaaaattgaaaaaattgagaacatgtattaacatgtgatataacactccacaaacatgtatgttcaaattcaacttctacatctcataataaaaaaaacaaattaaaccgcagctagctatcgtatattcacaatcaaatttgtttttttcgttgtatgcactagtatagatcctctcatctgtgacggcccgtcacatgcctgcattttccgggctgtcacaacaaagtgatctcaaacaggctcaaaaagaggccgacaaagatatactcacacagacatgttagatgcgcataaaactctagcccatcacgtatggcacctattggtgatagggtttagtttaggaccgattgagataaccggtgaaatctttgccgggccctaatagaagcccatcaccgttggtccatcatcaatggcgggctccaacttgaggcccgattgagataactgttaggcccgtcaccgataactcaggcccaacaaagataactaaaatacctgtcactgttgtaagtttttttggccgttacagatatttattgcacagtataaataccccaactacctagtttaatggttatctcactgttcactgttttggtgggagtgtgagcacgacgatttttgtctcttttttccaagaaaatcataaattgcaaaagtaattgaaaaatagtggtcaattctcataaatttagtaaatacttacctgcaaaatatatatctaatatttttccaccttttggcagctcagggatcgatggatcgaagttggatgtataggaaaactgtgcgacgtcataccaaggagtatagagatggtgtattgaattttattaatgccgtggaggaggataggaaaagaacaacgattacatgtgttgtccatgcgtagattgcaaaaatttgaatatgttagatagcagagtggacgtatacgctcatctgataaaaaaaggtttcctgaagggctacacatgttggctgaagcatggcgagcacactactagaaaaatgatttttcatggtcgtatcctattattttcactggcagtcatatgagaaatccgcttgtgaaattcaaacgagagatagagggtttagaaccacaattgaaaatccatttttgctggcggtgagtttaggaccgcaagtgaaaatccatttttgctggcggttggttaaaaggtccattagcaaaaataagcctattttcactagcggcctcttaacataacgtcagcaaaaacggattttcgctggtggtcctaaagagcgccacccttgaaaaaaaatcacgcgtgctttaaaatatcacagcccattaaaaaatcgccacccaccactccttatcaacctacccatccttatcctctcattcctcctcctccctcctccctcctccctccagatccaccagatccaacaaatagcaccctctcctcctccctccctcggtggcggctctaacggtggttctggtcctcgggtggcggcgcgcggcggctccagcagctgtgtgtggcggcgatggcgacggaaggagagtgcgcagcggcgacaatagcaatgcatgcggcggtgatggcgacgaaaggcgagcatcggttctcgggcggtgacgcgcagtccctttgcctccctcctcttgccgcctctttccctcctcccttctctctccaccgccaccagcctcccttccctctccaccgctgtgtgggggaagagggcagtggcacggggaaggaggtgtggcagcggcgtggcgtatggcgcggcggaggttcttgacagcaagcgggcggcgccggagctgaggacaggcaactacgacgacgacaaccacgaacgcggcggcgacgacgacgacaacgacgctaccggccgggagcgtggatccgccatcgactatcctcaggagcatggctctggcggcggagaggctcccaggcggtggatctaaggtggccgggctcggcgaccttgaccacgcacggttactccccaacctctatctcttctggatctggcttggggccgaggggaggagaccggcggcggcggcaacagctgctcctccagtcccaaatctggcagcggcttctttatgcatttgatttgaatttggggagcgcttgggaactacggttgctagatgtggatttttctcaatgcactatcttcccattctattgcagatttatttgatgtagatgatttatgtattacgtaatagagatgatgtagatgctttgatttgtatgtcatgtttgatcagtggaaataagcagcaaaggaaatgctttgatttgtatgtcatgtttgaatgtttgatttgtggaaataagcaggaaaggaaatatgcgcgtcggtatttttattttatttttattttttgccaaaatccatcatcacttgaggtcgtcttaaccggccaccagtgaaaatcttctttttgctgatggctgccttaatctaaccaccagcaaaaatggatctttgctagcggctggcttaagatgaccgccagtgaagatcagatcttcactggccattgctttgtggcggctctaaattccaccaacgaaaacctaaaatggtgcacaaaatgaagaatgtgaagatcatgagcacgaatcaggaagtggtgcacatgaagatgaccatgacaagtttgtaccttcttcattgggcgttgaaatggttgatgtggatcacgatctattgcaagacatgttacgtgacattgaggacccagcttacaaagagagattcctgaagttcagcaggttggtcagtgactcagaaatgcctttgtacgcagatgcaaagcaaaacacactaagttgtcagcaaccttggacctaatgaagccgaaggaaagtagtcgattgacagacgagtttcacagacttttttaggaatttttatggttttacttcctgatgagaacacattgcccgagacgacatgtgaaacaaagcatgttttgtgtcccctggggttagaagtccgtagaattaacgcttgtccgaatgactacatattgtaccacaaccaaatgccgacttagatgcttgccctgtctgagggccttctcgatacaagcgaaagaatagtgctgacaaaggaaagaagttaaagcggggtggtctgacaaaggttgtgtggtaccttcatatcattgatcgttttcaatagaatctttgccaaccctaaggaagcgaagtttgtacgttggcatgccacagacagaaggaacgacgatatgcttagacacatagtagattcgattcaatagaggaatatcgatcgaagacacgaagactttgctgctgacccaagaaacatgaggatatgtctgtgtacggatggcatgaattcttttggagacatgactagtactcatagcacttggccatttgttattgcaaaatttaacctatcaccatggttgtgcttcaaaaggaaggccgatcttatctcttcacgaaggaaggttgtcaggtgttggcacaataagcaagaaaagaattgttcccgatcaagcctcctatgtgcaggctcatttcgctgtgctccaacatacggcgcctctcatcggcgatctctcgtacgtgacgatcgatcaatcgatctcagtttctcaaagaaaccacatgaataagagaacgtgaggctggctaacaatagggcctgtgttgctagctagcgccatccacgctgcatcgaacgggggaccacaacaacgcgcgcgagaaacacgcatgcatgcatgcatccacggttttgacgaattccactagattgactccacgtatgcctactgacgcgacaatcaatcattttgatgaatacctaggcagctactatacatgcaaaactaaacgtaacaaacaaattaaccgcatctgaggagaccggatattcggaagaaatatatcgattggtagccggccgccgcgcacccaacaacgaattgcggttcatcacttcattcatccaatcatatgataaaatatgacccatttggccaactttattgggccgcctcaacaaccgagggaagccgtggagtgagctgttacttaattattctgagactatagatggtcaaattggtcgcctggcatggtccaacccatgcacgaccaaggcacggctttagattggtcggggtagcatagcataatcgacatgccgagtcgtacctgtgttgctagctaaggccatcgatgtttcgtcgaatgggggatcacaacaatgcacgtgagaaacacgcatgcatgcatgcatccatgattctgatgaactccaccggattgactccacgtatgcctactaacgcgtcgatcgatggttttgacgaatacctagggagctactatataagcaaaactaaacgtaccaaacaaattaaccgcatatgaggagtctggatatacggaagaaatatatcgatcggtagccgaccgccaggaacccaacagcatcttgcgctttatcacttcattcatccaatcatacgataaaataggacccatttgtccatcatcattgggccacctcaacagcccagggaaaccgtggtgtgagctgttacttaattttgctgagactatagatggccaaatggatcgcccggcatggcccggccaaggttcgagcaaggcacagcctgagatttgtcgggacggcatagccgattcaacatgccacgtcgtgccagtgttgctagttagggccatccacgccgcgtcgaacgggggatgataacaacgcacacgagaaacacacaagcatgcattcatccacggttttgatgaagtccaccggatcgactccatgtacgcctacttgacacgacgatcgatggttttgacgaatacctaggtagctactatacatgcaaaactaaacataacaaacaaattaaccgcatttgaggagttcggatatacggaagaaatatgtcgatcagtagacggccgccgagcacccgacaacgtcttgcgttttatcacttctttcatccaatcaaacgataaaataggacccatttggccatctatattgggccgcctcaacagtcgagggaagccgcggtgtgagttgttacttaattttgctgacactatagatggccaaatgggtcacccggtatggcccagcccaggcaagaccaaggcatggcctgagattggttggggtggcatagccgaatcgacatgttgtgccgtgcctgcgttgctagctagggccatccaggccgcgtcgaataggggatcacaacaacgcacttgagaaacacacatgtatgcatccacggttttgacgaattccatcagatcgactccacgtacgcctaccgacacgacgatcgatggttttgacgaatacctagggagctactatatatgcaaaactaaacgtaccaaacaaattaaccgcatatgacgagtctggatatacggaagaaatatatcgatcggtagccaaccgccaggaacccaacagcgtcttgcgttttatcacttcattcatccaatcatacgataaaataggacccatttgtccatcttcattgggtcgcctcaacagccagggaaaccgtggtgtgagctgttacttaattttgctgagactatagatggccaaatggatcgcccggcatggcccagccaaggcacgagcaagtcacagcctgagatttgtcagggcggcacagccgaatcaacatgccacgtcgtgctagcgttgctagttagggccatccacgccgcgtcgaacgggggatgacaacaacgcacttgagaaacaggcatgcatgcatgcatccacggttttgatgaagtccaccggatcgactccatgtactcctactttacacgacgatcggtggttttgacgaatacctaggcagctactatacatgcaaaactaaacgtaacaaacaaattaaccgcatctgaggagtccggatgtacggaagaaatatatcaatcagtagacggccgtcgggcactcgacagcgtattgcgttttatcacttctttcatccaatcaaacgataaaataggacccatttggccatctatattgtgccgcctcaacagtcgagggaagccgcggtgtgagctgttacttaattttgctgacactatagatggccaaatgggtcacccggtatggcccagcctaggcaagaccaaggcagggcctgagtttggtcggggtggcatagccgaatcgacatgttgtgccgtgcctgcggtgctagctagggccatccacaccgcgtcgaataggggatcacaacaacgcgcttgagaaacacgcatgcatgcatccacggttttgatgaattccatcagattgactccacgtacgcctaccgacacgacgatcgatggttttgacgaattcctaggcagctactatgtatgcaaaactaagcgtaacaaacaaattaaccacatcagaggagtccggatatacggaagaaatatatcgatcggtagccgaccgccgggaacccaacagcgtcttgcgttttatcacatcattcatccaatcttacgatcaaattggacccatttggccatctttattggtctgcctcaacagccgagagaagccgcggtatgagctggtacttaattttgctgagactatagatggccaaatgggtcgacggacatggcctagcccaggcacgaccaaggcacggccggagattggtcggggcggcacagccgaatcaacgggccgtgccgtgcctgcgttgctaggtagggccatccacgccacgccgaacaggggatcacaacaatgcccgcgagaaatacgcatgcatgcatccacgatcttgtcgaattccaccggatcgactccacgtacgcctattgacgcgactatcgattgttttgacgaacacctaggtagctactatatatgcaaaactaaatgtaccaaacaaattaactgtatatgaggagtccagatatacggaaggaatatattgatcgatagccgaccgccgggaacccaacaacgtcttgcgttttatcacatcattcatgcaatcttatgataaaattagacccatttgaccatcttcgttgggccgcctcaacagccaagagaagccgcggtgtgagctgttagttaattttgctgagactatagatggccaaatgggtcgcttggcatggcccagcccaggcacgaccaaggcatggcctgagatttgtcggggcggcacagccgaattgacaggccatgccgtgcctacgttactaggttgggccttccacgctgtgctgaacgggggatcacaaaaatgcacgcaagaaacacgtatgcatgcatgcatgcatccacggttttgacgaattccaccggatcgactccacgtacgcctatcgacgcgacgatcgatggttttgatgaatacctacgtagctagtatatatgcaaaactaaacgtaccaaacatattaaccgcatatgagaagtctagatatacggaagaaatatattgatcggtagccgaccgctgggaacccaacaacgtctt

SEQ ID NO: 1546 - DNA, 10882 bp, Oryza sativa
aaataggacccatttggccatctttattgggccagctcaacagccgagagaggctgcggtgtgagctgttacttaattttgcggacactatagattgccaaatgtgtcgcccggtatggcccagccctggcacgaccgaggcacgtcctgagattggtcggggcggcacagccgaatcgacaggccaaaccgtgcttgcgttgctaggtagggccatccacgccgcgctgaacgagggatcacaacaatgctcgcgcgagaaacacgcatgcatgcatgcatgcatccacggttttgacgaattccaccggatcgactccacgtacgcctatcgacgcgacgatcgatggttttgatgaatacctaggtagctagtatatatgcaaaactaaacgtaccaaacaaattaaccgcatatgaggagtccagatatacggaagaaatatattgatcggtagccgaccgccaggaacccaacagcgtcttgcattttatcacgtcattcatccaatcttacgataaaattggacccatttggccatttttattgggtcgtctcaacagccgagagaagccgcggtgtgagctgttacttaattttgttaagactatagatggccaaatgggtcgcctggcatggcccagccctggcaggaccaaggcatggcctgtgattggtcgggttggcacagccgaattgacatgccgtcccgtgtctgcgttgctagctagggccatccactttgcgtcgaacgggggatcacaacaacgcgcttgagaaacacatatgcatgcatccacggttttgacgaattccaccgcatcgactccacgtatgcctaccgacgcgacgattgatggttttgatgaatgcataggcagctactatatatgcaaacctaagtgtatcaaacaaattaaccgcatctgaggagtccggatattcggaagaaatatatcgatcggtagctgaccgccgggaacccaacagcatcttgcgttttatcacatcattcatccaatcttacgataaaataggacccatttggccatctttattgggccgcctcaacagccgatagaagccacagtgtgagctgctacttaattttgctgagactatagatggccaaatgggttgcccggcatggcccagcccaagcacgaccaaggcacggcctatgatttgtcggggcggcatagccgaatcgataggtcgtgccgagcctgcgttgctaggtagggccatccacaccgcggcgaacgggggatcacaacaacgcgcgcgagaaacaagcatgcaagcatgcatgcatccacggttttgatgaattccaccacatacgacaaggatgaataaagttctacatggaaacgacaaggactactcggattgtatccatattggtttccctagttctacttggacaaggggacaactatgggtataaatacaaggcgccctaggtggagagaggacacggaacaatagatcaagacacgagatcaacatacaagccaacatgcccaagacaagacgccagatatcgacttcagagataagcatggctagtcccctacggtgtctacagatactgtcaggagagatatagcgctgtctttaatctcgccggatgcggattcgaggaggaaggctaccctgttgtcgactacgagtcagcacttcagaccgccaagtcgacaacagttagataggctaccccaaatattgtactggtgtgattatggtgaataagagtaacgaccggtttcggccaacaagagtagggttattacctgacaattcaggggcccgaacctgtataaaaatcatcgtccacatctcttttattacaatctcgcatatatcctagtaccaacgatccccatactatgctaataacagaatcacgacatcaaacgttgtcacaccctaaaaatcccaaatatataaattgttgtttaattggaattataagaattgatttttaaaagcctagaagagaagatctaattttaaattataaattccaatataaaagtgggccagataaaatttcattaaatacttttcttgattctatagttcctagatttttttgggatttatttgagccaaggaagtatttttaataaatggaattgcatttcatgaataatttaaattgaaaaaagtttttaaaatcctcttttggctttgggccgaaagtcggcccaaaccctctctctctctcccggcccaggtcggcccgcagccgagccaccgcccgcgcacgcgccctcgcccgctgacaggtaggggcccacctgtcagactcgtcgtcttcctcgcaccgtcgcccagccgaaccctagccgagttgcgccgccgccgcccttccaaattcgatcgtgtctttccatctccggtgaaattgatagagggaaaatgatccccgcgatccattctatcttttcccttttggaatcattggctaattccgtttggaaatctgtggattcgatctcgaatcggattcgtctttctccccgaaccctaaaccttccttcgccgttgccggtcgtcgtgggcctctactgccgccgctagcccctatataatggaccccggtgtctcctctctccgtcgccaccctcgccttagctcgccgccgcctgtagcatcgcctccgcgttcaacggtgcaccgccgtcgccgttgttcgtccagccgtgcgccgccgtcgctccggtcgtcgtcgtcgctcgggaaggccgccgtcgtgatcgccaagccgtcgccgacctcgtccacccctccgtcgttgccgtaggtcgccggagcaccgccgtcatcgtcaagccgaaggtcgccaccgcttcttcctcgacgccatcgccatccgttgatcttccgccgctgctttggtcaccggtgatcagttcgccgcgtcgcccacaacccgtaggtgcccttcgttagtgctgccgcaccgtcgttcgccggcgagcatgcaccgtccgagccgtcgccggtgatgacgtcaccgctgacgtcatcatcgtcatgtcgtgaaccgccgtggactagatcgatctcggccgtccgatttggttagagtgatctcggccgttcgttcccgtagaccgccgccgtgcacccggtccaccgtgaaccctagccgctgacgcaataatccccttttccttttcaaaaataattcattattgcgtcataattccattaaaatccatataaatgatttaatccgatttaatctttgaaaattcataactaattcatcctagctcggatttagttggttcaagtctctaaatttttctaaaattgagatctacatgttaaaaatatccacatatactgttcatgcttgtttatgtactgttttggtgattttgttcttttctctttagatttcgacgttcctggagagtccgattttgcaagagaagactttgaagagttccaaggccagcaaggcaagtcacacagatcccaaacaaccctttgagcatgttgatcccgtttaaagctattgtttctattcaactactgcatttatttttgaatgtcattgggtggaattaacctattgttttgtcatagccctttttgttcttgattactttattccttgataccttgggttattataacttcactagttgagctttatatatgggttcagctggatattagatataattgcttagccatgcttagaaacattagcacactattgggataacttatgcttcactattatttaatgatggcttaatgatagctcatgatggttaattatgattggttaattaattaattcgccaactaaaatttgataatggtgggttgtgagcatatggttttgatggttgtgctcatgacaattaaggaccggttcacgattttcggttgtgaaatatttaccgtgccaaccacaaaccagcgtgggcaacggctttactttctgtatagtatggttcatagtagagcactagactgtgaagtggcggagataagcccacgggggtcgctagggagtccataccttgtttataagggggtgattatgatccgggaacggtgcactgctttgaattgtattatatggagggtattgtcacaatttctattcgggtacttattaagtatcgcgacgcatggttgacatgatgttgaggttgtgtcttgtgggtacagtggtacacctctggccagagtttaaactattcgaatagccgtgcccgcggttatgggcgagtctaacaatgtctttcgtgattagtctcacacctctcactataataaatgatgctgttaagaacttgtttagctcctggtttggaatggttaattcctggtttggagatagaactgtgcagccgggattggttgttcggaatggttgggcctatgcaacagggtatgttgtatagcgttggattaatattgtttaattattatttaactgttttattaaattctgaaatatttgttaaatgctatttatgcaaatgagactatactatgccatcctttgttatcctgtgcacttgcatatttgttgtgtggcttgctgagtatgtcagaggaggagttctacagcgatgctaatggtgtggatgattaggcgtagccctggtcaagctgcctgtggagaggagtcgcctgcgctgtttcttttattttccgctgcttacaactttattgattgagaggaactatctatctcggtaatgacattttattcgcttattaattagagtaataattgtactctattatcaatttgttattgtgtgcctcggctgattcctggacgagggtttaaacatatgtaagcgtttggaattttggatagaaattctgggcgtgacaaacgtcgacagggtggatagtgcctgaagaaaaatttattccctggtcttaaagaatgttttctaagtagtgttcatgctaactatacaagactggattggatatatatatatatacacacacataccgatcaagcgtattaattagaacttgtagatagtaatctgctgatgaattgtcactactacaaaacatcaaataggtgtcagcactataggtgccggaagtgttaaaaccggcacatataggcattttcccacctctgtgatccggaaatacaaaaaaccggtacctttaggtggtaataggtgtctgttctataaaaaaaaacgacccctatactataggtgtcggttttagagtaaaaatcgacacctttaattaattataggtgttggcattttaaccgacatatataataaattaaaagtgtcagctttttaaaaaatccgacaccttttacaaaccgagccgagccgagccgagccaaggagatatttcttctcccagcggggtccaccctcggaggagataagcccggcgaggcgcactgagactgaggataaggccaccactcgattttttctcctctctctcgttcactctgcaagtacacctcctcctcctctcacggccccatcccttcccccacctccgccgccgagccgaggcggcaggcggtgctcggcggtgttgacggtcattatcgatcagtttcgaccgtcaatatcaccaaaatagaggagaactagtgatgtttgcaatgcatatatttgctagaataataatattccactagtattaggtctactaaactttacatagtgacaataaagtggaggagaatcgacatcaacatagacaataaatcaatcggacgatgtcgagtgttagacttatgcatgaatggaccaagaactcagaattgacatgacacactgggccaaaattcacaagtctacggaggagaacaacaaaggaggccacctgctgaatatgggccaggttgggtcggccttctggttcggccgaacctcccctggcgccgttggatcgaggtttttgctggacggcgtggatcactccccaacgatggttggagggcaattccgaccattccaactgccacaaccgtcattggcagcctatttaaggagctcctcttctcacttcactcacacacctcaagcaatagctctctcatttctctcaagtttagcttagtagtatctagctagtggaataggaatagagtagaaatcaggagtccggaagccttcggaagagtttggctatggctctagtagcttttctcttctcttttgtaagctttgtacttttattagaatactcttctaaatatatttatggtattgaaatactttccgagtatatgagtacctaccttacattatattcatgttatactgaatatatgactattagcttatctaggagatgctttggtgcgggtataatgttggcttatgcaattactctatgtcatgacgataatattagagtagtatctgatagtttaggcgtggtgtctagattacgggatatcattatttggggttaaatattgcggatgagaggtgggccgctgatggtgacagctcagtacgggtattcctccgtgccagtatatcatcctaagttaattccctggggagtgtattcctccgtatttagccccggttgtatggtcatgacgggctgtcgtaaggaactcggcagtcaggggtggcttctcgaagtaccaggagggcatcggatagagggtattagctagtatatcggttaactaaaatgtatgtatatggcagtcagggatggcttctcgaagtaccaggagggcatcggatagagggtattagctagtatattggttaactaaaatgtatgtataccatgtatattagaagtataggaatagataatatattatgagaatgagtagttaatgcttgtgtgtcactctactcttggattatcttaacccctgcttagaatatgattatcacaaataatatataaattattagtcaagctctctctacatgatcttcccactggataaaataaatacgatacccttggaatactcttaggtgaaatgctacaatggtatatccgtgcgcttgcggatgagctctgtaaccataatataccagaagtatttctgcgtcattgctgggaattatatttctagtaatgtggttaagaattaccaacaggcggcgggcgacgggtggcggtggcggcggcgcgtggagacacaccggcccagcggcggtagcggtgggaggtagcatgcggcggcggaagggacggaagggagggggatgcggaggcggtggaaaggagaggggatctggcggctcccctccgccagatctgcctaggacgggaggcggcaacctggcgcgaggtgccgcggcggaagcggtggcgctctcttccagatccggccgggagcggtggcccggcatggaggatgaggcggcaagttattgatttgtgcgctgtgttattgatttgtgcgatgtatttatgcgatgtgttcttgacttgtgcgatgtatttgtgcgttgtgtttggtgcgatgtattttgtgcgatgtgccagaggatgtgttcttactgtggatgtgggtttaggctttttttttattcgtgaaacctcaaaggtgccggttctaaacaactggcacctatttgattttcaaatcagtgccgtctccgtggtcccagttgtgaaaaccggcacctaatggggtttgcaaccggcaccgatttgtgtgtctgtagcggtgtgtgacaattacatcatggatgagctcgcttgttcccgtgaaatcgtcaccgagttcgcgcagcatgtacgcggactctgcccagaaatctactaccaacgagaactcgttgcaagttcgttttctgcgcacgcaagtcatttactaattgttatattttgggacgaaaggtattttgggacggagggagtagtagatatacgatttttattaaaactgtgttcagtacagactgacaggtacacacattcactaattaggaattaactatatgctttgaaagaataagggacatctgcaggaacccaagcccactttcatcgtcgtgctccgcaaactcccactgaactcgtgcatcgccgtttcctgctacctgccaatcctaagctccaacatcgaccagaaaaaagtgaagtgattagcttcaaaaaacacaaagtttctacccatagccggccatcagtctcatcattagctggggatgcatgatatctctaaagaactttctgatgatccgcctctgtaaattcaaagccttctataaaactgttagatgtgtgttgtctgtgaatttagtttttctgaagcaagtcgctagtgagagattgtactgtggataaattcttcccatgtgtccacctatttattagggtatgctaagacagctctaccgatgttgatgactagcccattggtacgttactccctacatttgtctgtccaaaatttccacatatgcctgcttatgtgttatgtactagtcgttttattgatttttttttgctggttgtattttaattgagatagttaagtattaaagtttatttcacattcataatttttaaatttaaagtttatcttcctaatcttgtgaggacctaagtcttgtccacttgtctagacaagtagaaaataccaacttaccaagctagacccatcttttgagcaagcatttatatgtcgaatttgctatatatttgtatatagtgagattttgggagaaactaatacagtacattgatatgcaactaacaactaaccgcccgttaacatttctcctcaccgcagtacttgctttcctgacgaaccattgaactatgatgagcagaggaaacagaacgagcacctaggcgcaaatcgagcagcccgtggaacaacattcttcagtctttcgtcgtatctgactcccgatgcctcaagcccttgctttggttagcacgtgcaacagcaacatatatatcaaattagtaacgaacaagaagagcaagtttcacagcttatacatgcttaatttgcttgtatgatatgattgtgcaattctcagttacttggtatatctttgcttgtgctgtaactaaccggttagggtggatatatatacctgtatctcttctgtatagttttttttcccttgaaactgggggaaatttaatgcttcagttagcatccagtactcaactacccacaatgcttctgcttgtaagagcaggtacaatagcaggctataagccagctataaacatattttaaagagataaaggaagagagaaaaaagcagcgggctacagatctgtagcaagctgcagcacagactttaagacgtaatgtgcgtatgataggtgggaccaagtattaataatatagtaagtaactattgtatgaattggctactagattgggctatagatgaattggaactagtagtgggctatcctattgaatttgctctaatatgtatactgtatctgttatgactccgtggtgagttattacaaatagctaattaaaaacgggcgtagacactagctagccgccacatcaaccattgagttcttgcaaatggtacctgtccaattagtaaaggggaacactaggaagcataatatcatgtcacagcatcactgaactcttagaacagctcaagagtctagacgacgccaaggagcctcccaaatttagtttacagtatcggttggtatttgtagtaaacatctcgaaggatccatttttaattttttaagataaaatttagactttctctcgtcgatatcagtttttttttacttttattttcagtttaggggaaaaaaactttttgggaaagattatacgtaatctattaataataatgctctaacaattacatcattgatgagcttgcttgttcccgtgaaatggtcaccgaggccctgtttagatcccaaaaacttttcacaaaaacatcgcatcgaatctttgatacatttataaagcattaaatatagataaaaataaaactaattgcacagcttgcatgtaaatcgcgagatgaatctcttgagcctaattagtccataattagccataagttctacagtaacccacatgtgctaatgacggcttaattatgctcaaaagattcgtctcacggttttctagcaagttatgaaattagtttttttattcgtgtccgaaaaccctttccgacatccggtcaaacgtccgatgtgatacccaaaagttttcatttcaccaactaaacaagctccgagctcgcacatcccgtacgcgaactctgcccagaaatctgctatacccacgcgaactcgttgcaagttagctttatgcgcacgcgaacttgtagtagccacttcgcgttgtcagcgcgcgatgctgttgacagcgctaattcgcacaattccaccacgaacaaagctacgatcgagttcgcatggccaccaagtgacgatgatttattctcgtaaaatattttatcaccagtatattttcaagaaaaataatggatgacaatattttttttactttatttctctatgcgacggcagaatggaccatgcatgctgacatgcatgagatctacaaggtactggattcctaatgcctttcaagcctaaatccatacggaccatataaaatgtatgcctatagtttacaaggtcatcattggaaggaatcgaatttatacacatatatcaggagggaaaattgttttaaactgttgggggaatatcacctcatttattcaaactagtaaggtagcccgcgcagttgcgcgggcatcttatttaaatttgttattaggattttgaatattatgactttgtctctcaatgaaagaatttgaatgttcctttataacacatgattgaaaaaaaaagtataaaggccggatacatgttaca

SEQ ID NO: 1547 - DNA, 16046 bp, Oryza sativa
taggcagcgtaaagccacgaaccaaactcatactaagagtcctaaacaccttaggaaaccctctagtacaagaaagaaactttacataaccaatcgtaccaaatttggactccttctaaattcgactccgcatcccatacgcacacaatacctccatcgtatgccatatggaatctccatcaaccacgtgcatcaactctagcattagtatcccgcataatatctgaccaccatggacaccgtcttaccaccaagccaactcccggtccatcaccgcaaatactcacccgaggcatcgagccacctacacatgaaacaaacaaagaaaccatattctgagaccaagctatccccaacttgactcattgttagcaaacaacagtattatatacgtatagtatccatctagaatccataaccatgaaacaatcacggatatccaaagaaacaacccgaaatcgaaaccgacacaacgtcggccggtcagaccgcgggaatggccagtctgaccacacacatagcaccggtctgaccggcaacctccacccggtcggaccggtcacataaaataacagtgaatccgatcatcacctgaaaaatgattatctccaaaaccacttcgacgataatctccaaatatcaaaaccaataatcacagataccaattgttcatcacagaataagaatcaaaacacactttgatcttacaatctcccccttaatgaacacattggcaaacctcatcaaaaatgttttggtgtttggaaaaataaaaacaaaagtggtaaaaagcacacttcgtacaaatgtacacattgtgcttaaaaatccaaaagaaaacttctccccctttttaaaagaaagaaattcccaattgaaccaaaaacatgctcttctcaaaaactcttcaaaaattcaccttgcttctccaaaagtccaacaattttcacattacttcttccccttttgacaatgattccatcaagcataggaattatgttcattaatgttcaagagcttagcatacatatagcatatcatgtcatgtgttgcaataaaaggaagataaacccatctataacataagaaagcatgcattaaattataaccatgaaccaaagattttacaattaagcttgaatcaacaatcaaaatttatgatttcatacgatttataatgcaacatcttaacaagcacataggttgaagaataaacactaaacacatatacctattgcatttatcactctttctcaaataaactttagcacaaaataaccaagagatttttttttaattttttcttttcttgagtctttttctcatatttttctctttttttattccgggtacgtccctgtcgtcaagactgtttccaaggattcggtattcattttttcatattttttattctctttttcacaatgagcaattaaagctatttgaggaataacaattcaataaagcatatatatagaacatttatagatcaaaccatatgctagcagcaacattgcatattttcttaattcaagtgtagaatttaaatgtcatgcatcatcttccttaaaagcaaaatctaaatatcatgaaaagactagaatacatacaagctatgctagagacaaataaaccttcgaagtattgctagcatgcacaagaaaataccaataatcacagatgccaattgttcatcacagaataagaatcaaaacacactttgatcttacagtcattatcgccgtctctaaatcattaaatagccgaagcatagcttgtgaaggcttcaaggctccaggagttgaagaacggttcatgaaagctttgaagtccgcttcattgaggaggagatggatcttttattttttgtcatctttcaagtggacatcttcaagcatggtttttggattaatcctaatttgttgtcgatctagtttttagttccaaatgcaatgtgtacacgttgcatttgaatggggatgtcaagtataagtgtgtctctaggggtagtattgtaacttcgcatctattgtagacaatttatattgctctttgggtctaatccaatcttattgttcattccccaaattcccccaaattgtgccaattattatataaacgtgatacttaagagagataatatcgatttacttgcgaagtgagcatagctcaactggttaggttccttgcggcggaaccaacccacctgcgttacggctaattattctttcattgatagacgacatacccgtcgacagcaaggcacctctagtgacttcgtcaatctcaaaatatgcctgccaagtcttccggagatgctcataggggtagggtgtgcgtgtgtgcgtttacaggggtgagtgcgcgcgtgttgtgagcgcctgcgtttaaaaaaatatcgctttactcatgtagatataagaggtcattattttctcctaataaaaaatggaaatattgctttaatcctatagatataagaggtcattattttcctgtaataaaaaatggcttgagtgtacataagcgcatattttcaccaaggaacacactgaaagcagacgactactcctttaaacaaaacaatttttttgaaatgaatggcatacgccctggttttgattgagagcagttcatttctcacataatattgccgaacggacaaatgttcagttagttttcatttttacgtgtactatgatcaagcaaaagatgctgcgtgtgtagaaccacacaatttaattttgcaccgggaaatactgtttgttctgttcttcatcctcctccaccgatacaattgcagtgcgaaaacaacatattttgcaaggtggttcatctgcttaaattttattgccagttcaacatctgtttgccgccggccgaagcaacgaaactgaaccagtagcgattcatcaggaacggtgatagcatcgtcaagacgcctccctcgcttgatccctaaagtgtcccggcgcaatgtccacggctagcaggctgcccaaacgtagcagacaacaagagtattctccagcagaatgctccaaaatcaggcacgatgcatccatatttatggcttgtgaacttcatggcagtgaattcgcaaaccagataatccaagcgatgttcttgtcaggccaagtccatgaatacatgatgtcccaacagatctggtagcaccgactcatgacaactatcccaatgcctcaaagtcctaagaatatgtcttcaataatattcagccaataggagtttgagaggggaattgcacgcccttcattatatctatttgaaatgagcatatggcatgtgtttatatatggaaatccggggatatgaacgcgaatagtattgtacggttttgggtatgaatgtggtatcctaaattctggcatatatggattatccaaaatttccattggattatccattaagttttttccaagatctgaaattgttagctcacatggccaatctactccatatatacaacataagtaatgacaaaattaaaatttatcaacattgcgtcaaaagggaggatgcctatgtaggatcgtaaagggtctttcccatcacaaaaactagccattgaagtgaggggggctcccccacttgtattttaggtcttttgtccttccacaaccaatgtgtaactattcaacaatctcccccttcacacattagtgtctctcagcacttcacggcccctttaccgtataccaattgtaaagggtcattcccaccccaaaagctagccattgaggtgaggggcccccacttatatcttaggttctctgctcttccacaaccaatgtgggattattcaacagcctcttatgaagtaaaaccgtagcaaagtagcaaataaaaaaaagtatgaagtttgcgaatccaaattagaatttcacaatataatctcatagcgtcatcgttccatctgcatctcaaaagacatggaaaaatgaatgaagcaacaaaataatttgtcggtgaaaccttgtatcgctagcgatttaaaagttattgctgaaaaataaactaccataaaaaaaacccctgaaaatcaatgcgtatgccttggaaatctcatggcaagaactccgtaggattccctctctattattatgtttatcatgaactacctcttaattattagataaacacgatagttaggaggagtaacatagtccttggatgtactgtgttttaatataagaggtccctaatttattttaatgtataatgaattgagtgtgcacagaatgcaaatgatcagtctttcggacataaccactttttgaaaagaaaggcttattattacagagagcccgactacggtgctctctctcatttgatcgaagtattcagatctatttatgtgtactagaatactgaataacggtagtagaaaaaataggtatgaaggagtataattgtcattcttcttttttttttctcattttcatggaatatgatcgatgccaatgtaatggatgaccacagatcaatttggccaaaaaaaaaagtgacaaagttacccctaatcaatatactagtaaattacttaaaaaaggtatttgcaggcgggccaaatccatctttccaagcggacgtgcgttctacctgcaagcaaaggcttgcgaaaatagatgattttcgcaggcgggcccgcggcatgatttttggtggaggaaatgataagatgagacttagatatttttttggtgacatgatttttacaggcggaccacataaggttccgcctgcaaaatcatattttttttcaggcggaccacataagaggaatttttgcaggggacctcttaagtagtccgtctgaaaaaattgattatcgcaagtgggcagcgagattcaccccggtttatatttttgtacgcagctatttgactccgagggtcatgttcgtatgggaaaataaaaaccccacgtctgcaaaaatggctttttctagtagtgtaatttacccttaataacgaatggcttagattgggtagtataatgctactagtacagagcatcattgtcacagaacaatgctgaatggacaactgtccaatcattttttttttcgaggactatgaatcacgttgaacacggctcttccactgcaaatgatcttgcggaagatggcatagagcttgggatttttctgtgttacgcgcgtgcgtagaaccaaaacagtttaatttttcagcgggaaatacagttagatgtatttttctaatctaaaaattgtttgagtgtacataaccgtgtattttcaccgaggaacactgaaagcatgatgactactcctttcgacagaacaatattttgaaatgaatggcatacgcactggttttgattgagaacacagttcacagaatattgccgaacggacaacagttcagttcgttttcatttttacgtgcactacgatcaagcagaagatgctgcctgtggtagaaccatacagtttaattttgcaccgggaaatacagtttagctagttctccatcctccttcttgttccctagaaagtgtcctggataaatagccaaagctatatcaggctacccaaacagtattctccagctgaatgcttcaaaagtcaggcatgatgcatccatacttagtggcttgtgaacttcatggcagtaaaatcacgaaccagataatcaagtgatgttactgccagcccaaggccgcgaagacacgatgttcgaattgatctggtagcaccgactcatgtcaactatcccaatgcctcaaagtcctaagaatacgtcttcggtgataatcttcagtaggtgttttagaaggcaagttaaggaattacacgccatccattatatccggaagggacgtaaattagagctcatcagtacagttcctatacggtatatatcctctcattgtgtcagccgaatttgaaaaactccatggaattatttcttgccagctagttccaagtgtattgcaaatccgattgattggctcaaatagaagaatatgactgcaggatgtaaccacaaagctaccttgcttgacatctcggctgcacacatctattatgaagattaataatttacctcgattttcgtttcacgcttgtcaaacaactaaacggtgtgtttcatatgaaaactttctatatatatgttgctttaaaatatcaaatatatctattagtcaagtttgtaataattaaaacttgattaatcatgttgaaatagctatctcgttttatgtgctccaactttatttttatcttcataagtttcgaacaccacctgcataatggtggcagtatacttctagcaataccaaaaattaatccattcccgagccaagtctgcatcattttcaatacgactgaaaatggatctgacctgtcgcgctttgaatctgtttgaaataaggacttggatatggatgtagtgtggatgtgggtagtatgatgcgaatttggatgtgtggtatcccaacattctaccatatatggattatccgatatttttatcggattatccggcaagttttttgtcggagctcacatgaccattttatttactctatacaacacaagttatgacaaaattaatattttagtcaactttgtgtcaaaagagaggatgcctctcatctcttttgctacggagaaaaattgtggcgaagcggcaacttaaaaaaattgtgaacttcataagcaaatataagtgagatttccacggcataatctcatagcttcatacttttcttgacgctcataagagggggaaaaaataaaggaagcaactaaaaatattttatgggtagacgtaggatcaagaagacttactagagggagtgagtaggcggttttaaattttttgtccaaaccaggttttgtatgcggaagcgcaaatcaaaacggctttgcacaacaactcctaaaactaataatctcaactaaatgcacaaggaagatagcctatgttaaggtttttaagcgtaagatgatattatcacaaataaactatacaatgtaaacttgcataaagtaaattggcacaaatgtaaattgcacaaaacaaaggagataagagacaacagatttttccacccaatgttcggaagcttgccaacttgctacgtcaccgtttatgcaagcccaacttcaccgctcaaacaatcaaacctccgaaccacctcatcaagaaatgggcaatgtgagatccggtcccgaagtggtccaagaaatattcttaactccattatacctttgccttgcgctatccaacttgggatcaatgcttgagtcaagatcaacgcttgtgaccatgtttatgttaagatcttaacaatcatttatcaagattttcttctcattgcatgctttatttcattattatcaatatggcgatgtccttggcttggtgacaatcaatgcatgatgtcatctatatgcctcatcatggttggtcatattcttttgcacagctcaaaggaaaacactagtgccaacaaattagttgtcatcctccagttgatggttgcattgaaatatataaatatgtttgttgatttttttttcgatttaaagtttgttgagtatttaacaacaccacaactaacatatactcaaacatgagctcacgtgcaaagattcaatatgtatctagaacatgcatacaaatgcattggattttgtccccctaaaattcagcaaaggaatataaaaatatgcgtaagtagagaagaaccaatgggggtttatcctatatacatggagaagtataaacacatgccttcatgtcaatgtagaggagactaaataaggtaaggctgaagtaaacattaaactctcacttatatatcgaaaacatgaaaatcatatatatgaaccatcatatatacgaacctatcaaaaagtagaagataagaagtgctacacatattacttaatcttcatgcattttatccttgtcatgactaaggtctatcaccaaagaattcatatcttccacatctcattattgagaaaagcctagttgaaaacttattacaaaagaaaaggttaatcccggaaaattcggtcttttatctatcacaaaaactacaattatgcaatttgcttgatccaaaatctatcaacattttctctcgttggtattggatgataacctaatataaacaataaagagatgggatgaaaaatgatttcaaattaagatagtgatcttataatgaataaaatatagaatgaggggatatagaatgagcacctcaagatgtgcatagacatggatacaaaggaagacatctacgtgtaaagttcaatacatacctttcgcatttttattttcatatccaaatgaaactagtcaaacaaaaaactcataaaaacgttaattagtcttatataattagatttggcactaatcaccaaaaccaaatttaggcacaatagaacttttctatatatattctttagtgatttaaaagatattgctgaaaaataaacaacaatacaataaaacctcaaaatcaatgcatatgcctggcaaacgtcctcttattatgtttgtcaaaaaaaaactaaatcttaattattacataaacaataaacacggcagttaggagatgtaatatcgacatattcttatataaactttatgttttaattcaagaggtcaatagtttgttttaatgtaatatgtaaaatgacttgagtgtgcagagaaagcaaatgaccggactttctgccagaacaatggtttgaaatgaaaggcatattatcacagaatgatggtgaatgaacaactgctcaatcattttccctttttttttcgcgaggactatgaatcacgttgaacacggctcttctactgcaaatgagcaagccgacgatgccatagagcttgggatttttctgttctgcacctgtgtagagccagaaaagtttaattttgcaccgggaaatacagcttgttctgttcttcctcctccttcgctgatgcattgcagtgtgaaaataacaacgtaaaggaaaaaaaagatagttcatttggttaattaaatctaactgccagttcaacattgttagctagtcgagcagagagtctaatcaataaacgcataaatataaagggaaaaaattctctgcggtggtgtcgcatgacgctttctgagtggcaccacgtagactggcgacccgacatgtcctgtagcaccgcattgaccaagccgcagctactggcaagcaaagctgctccggagttcatggagacattctcttctgttagagtgtataaagtgaattgcccgtctttccctatcagcttaggcttttaggtgcaattggctggtatattcaacttaatatcttcccgtcgcgcagctgccctcgatgatgagtttctgccgccgcctcccctctccgccttttccacgcgccacgtagctccagcactcctcgatctccgtcacgcccaaatccaatcatatgacatcgtcgccggtggttatggggctccgccttccacccatctgtacaacgcaatctatggggccctgtcatcctcctcggcgcccgtttatctgaagctgtcgacgttcccgacggggatacacctgaacgtggtggcatgcttccagggacatgaacggaccgcgacggcagcaagtgagcaggatgatcgatgacaagtagctgatgttaggtttgttgaaaagatattcaatgttgattatattcctggattctgtttccaatgtttcttgttgaaatttgacttggagttagcgttattgttaataatgtggtacaaatagaaatcgccgaaggtgctgcggctggatctacacggtgttgtgggagacattggcatggtgggaagaaagatcttgagctacaggcctacagcagatgggacacgcatcgccagcctatgctgcgtcgtgcaggaagcgtctgcggcactgcggtagagatttattttttcccaagataaagatatccagcacgtgcgagcatcagctaagcatttctcctctttcctaaatgtctcctgacacattagccgcaacaaaccatccaaaattcgtgaaccattgatcagagtgatgttaacgtctgtccaaggccgcgaagccatgatgatccaacagatcaggaaacactgactcacggccactatcccaatgcctcgaaatcctaaagaatgagatcatcttctgtaggtgttttagaggtcagagttgaggaactgcacgcccaccattgtattcaggtggggtgaaaacaacataacacatcacaatgcatttcccctgtctatatgggctgaatattatcacaatgcaacattttctttctatctgttagtacaatattgaatggtagcaaactagcagtacactttgcaaatagtaccgctgcactttaaattgcagatgggcaatgcaaaagacatgctacagtttttattgccttagctattgttagagtgtttctaagtcatgtgcgtcatatgtaaactgacatagctgacagtaataatattgcaaaacttttcgtgcttattctttagtttttctcttcttatggaaccttaatttggcgtgccaggttagttactccctacatttcattaaaaatgttactatattttttaaaaataattgtttaaacttaaaaaataaaagtcgaacgacttgtaatataaaacgaagggagttcaagttttaattaaggttaacgggatgcaccaccgctctgtggtgttgcttgtgtggagtggaaagttttctttcgctgttcctttttaggtcattagtctatcttaaaaaaccgccacaagttttttaacagaaaaacttttaaatctaactacagtgtaattgtaatataatttcactgtaactaaagttacagttacagtccactacattatagttacagttacagtatagttacaatatataatatatttacagtctatagtgtaatctatctatctattatatactaaaagtctattaaacttcctacaaacgctctcataccgccacatgagattcctaccaacgctcccaagccaccacgtggtaatctaataatctggtggacccaatattatatagaattagatctatttttggaaaaaaaatctacatcccacgtccagcttggtctgtgcgtacaggagatatacgtacgccctcccatgtatcccctttaattatctcctatttccatgctacatgatctcttctatttccatactatgttaattcctatttttatgatatattagtcagatgtaaatcataatttataataatagttttcaaaaaaaataactaaatcaccgtcatatacacattaacacatatatatgtacaaacgtacgtactccctccctcctgttccacaggaattagataagaagtgcattttatttttatctgttcgtgagtaagagaccatcacaaatgatttatcatggatggcttcgcttaagcgtgtcttcaattgaatgtgtagatcggctaaataagtaattatttatttatgtcaccaagatcattcatataaaaattaaagttcatagatccaataatttttatagtaataaatgatggtgcataaccttaatagaaaataaaaaagaaagagaagactgaggggaggggagcagatgcggtggtacgtgtgtattacacgtacatgtgggtccaagagaaaagggtgattggatcggtagatttaatctaatggttagtattatcgggtccatcgttttaaataaaaataaatggttagatatcatttttttttcttagaatttatcagagcgccacgtggcggcttataagcgtttgtaggaatcccacgtgacggtttgagagcgtttgtaggaagtttaatggacttttagtatttttaatttattttaacagtaagattatttgtaattaattatactatataaaattaaataaaacttcatacaaacactctcaagccgccatatggacatcctacaaacgctcttaagtcgtcatcgtcatgtggcattttaataaattaaaaaatatcacaccactccagccgtatgtacgtatgttttcctccctcgccctactcttctttaaattaatttttttaatgaaaaaacaattaataatttaatatccatatcacccatattttactataaaaaactaaaatacattatttgaacagattgcaaccaaacaacatccaatttttaatttattggaacattaatttaatttgtaattaattattaatctgactattatatactaaaagtccattaaacttgctacaaatgttcttaagccgccatgtggcactcctgtaaatcctcctaagttgccacatggcactatctaatctcaccgttgatttttatttaaattgacgaacccattagtttacactattagtttagatttattattaaaaataataattttctcatgtttataacgtacaggcgctactgctgtccgtacgtatgagtttgtacgatacaaatgctattgctgttctttctatacgtacaaacgtacatgatctttcctaatcttgctgaaaaaacatacacatgtacataaaaaaagacataaaaaacatacatccataaaaatcagcggtctttgaaatataatttttgataaaatatattacttcacaaatataaatatatttagttaaacaaagatctataatagatatccaatcaatattctttaaaccatcttctgaatctatctattatatattaaaagtacattaaacttctacaaacgcttttacaccgctacgtggctctcaaataaattagcgaaatcctagaaatctattatatattataagtctattaaacttcctgcaaacgctcctacattgtcacgtggcgctttaatttagattaatcatagaaatttagagtaaaaaaaaagagaaaagcatccaatcttcaattgtcacttaaattagtgacacattattttaaacattggattagagctcttaaaaatcccacgctgctaatctctatcccggcaaaaaacatagcgtgcttacgtcgtacgatcatctccctaaaaaaacaaaacttaaatacctacgccatatacgatcgaaaaaaaaataaagctaaaaaataaaaaggaaagcatgcacacgtacatagaacaattggaaagaaatactaatcaggaaaaatcatcggtgccagcacatatttgttgtcaacggcctttaatctacaattttatgatcttcctccccttatttatagtcctggtgtagatagaacttcctttatggtttaattccgagcggtagtaaatacaagacttagcaatatttgattgatcacaactcattatattccatttattataaatcttccaaagtaattcattataggaatgctttcaagaaatggtttgcttttgcacatcgaaaccaaaaattaatcgtgcggatatgtataattcaaaagaatatatagatgagtgattcatacacagaaatcgggatttttatttaaatctaagaggcattcttatcatattagtagtatattaaaatctcccatgtatttttggggtaatatatttcttttttttaggataatctaaattcacttacaatatatatagtgatgtattattctttttttaataacaaataagatgctcgtacatatgtacgaaattcctttccgatttatattctaaaaatgttctccagtttatattctgtcgttatagtgtttgaaacacaaactataatacatgcccgcgcgaatgcgcgggctacgttcctagttacattatagttacactacaactacactatagttacatttgattgttttttgctcaaaaaacttgcgatagttttttagcaattgtaaaacaactgaatgtggatactctaagcaaggaacatagaaagcaaaattacctctctttctcatagtacatatatttaaaatgaaaggcatacactccgcttatgatcaaaagcaattatcacataatgcagaacggacaactgttcagtcatcttctttttttttgtttggcagggcaatcaatcacatcgaagacgactcttctatagaaaatgatcaagcggaaaaacatagagcgtgggattttttctgtgatgcgtgtgtatcacacggtattttgatcgggaatacagttattctgttcatcacccttcttagttaatccgcaagatctttcagttcctgacatttttctcccagttcaacatctgtctgaatgagtaatgcatcaggatttgctgcccaacaccatgaggtaagcatctctgcccaatcccctctaatccttcactctcggggattaaccgaataagctctaaagaataatcctgggacgatagccacgacaagatgcccaaatgtaagagatgccagcaggaatctccagcagaataatcgaacctcaaggcagtgaagtagcagaactaaaagccaaagtgatgttactgtcagctcaaggccaggaagaggtgctgtttgaacagatctgctaaaaccatctcatggcaactatcccggtgcctcaagttcctaagaataagtctacaataatcttcagtaggtgttttagagggcaagtcgaggaattgcaccccttccatgttgtatttgggaagagtgaaaattacagagcacatatcacagttcttttcccttatttatataggatgaatattaccacaatccttacaattatttgttgctagcttcatatatagttgtgcaatctccaattaattggctcacatggaagtctgactgggtactgctacaaagcagacctcaactaccgagctcactattgctgatcatgtgacacagctgatagtaatggtaatcacaaataaaacagaaattgttgcaacatgtacatgtttttatatgttcttcgcatataaaataaaaactgtttccacatttgcatgcgtcttcttcttacaattgtgagttcctggaaagccaatctgagcttaattaaggtcatggcaccctccaaatgtttccagaaaacaacccagcaaaaccttctctttgctgtaagtaatccagatacatttttgttaatagaaatgagggttacgcccttgcccaaaacagagaacactttcagccttcttctgagctggactagtgcttacctccaggagatgaaactgactcatggcaactatcctaatgcctcaaattcctaaagataaatcatcttcagtcggtgtttttacagggcaaagtgccaaagttgatgaattgcacgccatccattgtattcagagggggtgaaaattacagagcacacaacaatgcatttccccttgattatatagggcgaatattatcacaatcgatgcaattatgataatgtgattaggtctgcttagatgcaattatgacaatgtgattattcttcagcgcaatatataggccggacattatcacaactaacacaactgacagtaacaaaattgcataattattcgtgacttattctttagtgttcctacttaccgaacgttaatttagagtgcctaattggttactacttgtttcaaggtttgcgaacgcaacactgcgtggtattatttttcttcttttcataattattatactatcgtctgttggggagttgaccattttcctttaatgttctcttttatattgttttagtgggacactaggaactggggatgaaaacagagtagatacgtatgaaggagcacgcttcttgagctcctaattggcgtggcctattttttaaagcaaaaacttgttatccatatgaatttctatgaagccctgtcttaactccatttatcaacattacaatatttaattcatttgtttgtagcctcgaataattatcacaaatcgctcagatattcaaatattcggctcgaataactggggccatgaatacaaaaatacggataacttacatatggaaaa

SEQ ID NO: 1548 - DNA, 12414 bp, Oryza sativa
aaagcgcttcccaaaaaccttattgccgccttctcccggtgcaggacgttgaaggcagaggttccggagacctgctctcccgatcgcaagtgcacgccggcgagcgggatggagtaatctacgagcgacggcgcagcacagagtaggaggtaaaccctagattgatttcgcgtgtgttgtatgaagacggcgggtcggtttatatagagaagggtcgcttgatcagggcgcccgcacgatctccactacgcgtaaccgacccgcataagtcgcgcgtaacttatccggactccacgccgtttgcacgcaccggattttttcggaacgtttccaaaacaaaaacgaatccgaatttgcagcaaaacaaaactgcaaaaggaggctacatctgcgcaaggtgaagaaccaattttggcggaccattcgacacgtacgtcgtgcacgcgcaccgcctgccctgccaggcgaggcgagcgagcgcgcgcgtgttccccctcttctctccaccacacatacttcaagtggctaggagggcatcctctcttttaaggaggtccccctctcctagaataagcaaggtggtactaaactccacatgcatgccatcccaggaggtgggcttttgtgattttccaaagaattaatcttcgagtggactaaggcccatacattaattccaacaatcccccaccaaatctcaaaatcccactgagatttgccttttccaatgtactgtttatataccagcggttcgatggagaccgattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcgtaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatgtattggtactctcctctagtttactaatggtttgttcttcccaggatctaatttacgggatctctgatcacatagactgggttaccaccatagtataactcacatgggtctcaaacccatctccttcgatgcattttctatcacatttcgtgatagtcccttcgtgaagggatctgctaggtttctagctgtttggatgtaatccaacgttataactccggagtttcttaatttcctgacagacttcaatcgtcgtttcacatgtctagacgatttcatattatccttagaactattcactttgacaattaccgtttgattgtcacagttcataaggatagccggcaccggtttttcaacaataggccgatccattaatagatcacgcagccattctgcctcaacagtagcagtatccaatgctgtcagctctgtttccatggttgacctcgtcaaaatggtctgtttgcaagacctccatgaaacaacaccaccacccaatgtgaagacatattcactagtggctttgatctcatccacatcagagatccagttagaatcactataaccctccagtaccgcaggatacccaatatagtgaagccccaattccacagtacctttctgactaagtgtcaaagaaatattcgccttctttctgagtatagcccttagcaacaagccgagccttgtacttttcaatagtaccgtcaggcctaagcttctttttgaacacccacttgcatcccacaggtttacacccatagggtcgctctgtctcctcccaagtcccgttagcgataatggaatccatttcactacggacagcctccttccagtagtctgcatcaggagatgcatatgcttctgaaattaacttaggagtgtcatccacgaggtacacagtgaaatcatcaccaaaagacttagccgtcctttgtctcttactccttcgaggagctgcactgtcatcctcctcagtgacatgttcatgtgtatgttcagtttgttctggtggtgtgattgaactaggaattatttcagatgattggctcgaactactatgtgtattcttcattgggaaaaagctctcaaagaaggtagcatcacgagactccataattgtaccaacatgcatgtcaggtacctcagatttaactattaaaaatttataggcaatgctttgataagcatatcccagaaagacacagtccacagtcttaggtccaagtttgcgcttctttgttattggtacattgactttcgccaagcacccccatgtgcgcaagtaagaaagtgatgattttctcccaatccatatctcatatggtgttttgtccttatttctgttaggaactctgtttaacacatgattcgaggtcaacaatgcctccccccaccatgccttaggtagtcccgcagtgtccaacatggcattcaccaagtcagtcaatgtacggttcttcctttcagcaatcccattagactcaagagaatagggaggcgtcctctcatgtatgatgccatgttcctcacagaataagtcaaactcgtttgagaaaaactctccaccactatcagacctaagtctttttatctttctgtcaagttgattttcaacttctgccttataaattttaaaatagtctagagcctcgtctttcgttttcaacaagtacacatagcaaaatctagtagcatcatcaatcaacgtcatgaaatatcgttttccaccctttgtcaacaccctattcatttcacaaaaatctgaatgtaggagttctagtggtgccaagtttctttcctcggcagccttgtgaggcttgcgaggttgcttcgattgcacataactatggcacttagaacctttaacaatggaaaacttaggaattaaacacatgctggaaagccgagacatcaagccaaaattaatatgacataaacgtgagtgccaaatattagcctcatcatccacactgccacaaatatggttcatagacttattgcagaaatcagaaagggaaaagcggaacaggcctccgcactcataacctttaccaataaaatatccatgtttagacacgactactttattagactcaaaaaccaacttaaatctgtctctagtcagacgggagccactaacaagattcctgtcgatagaagggacatgctgcacgttcttcagctgcacgatctttcccgaagtaaacttcagatctaccgtgccaacaccatgaacatgcaggacggtggaaccccgagcgacctgataagaagaaaacaatgagatgtcagcacaaacatgtacactggccccagtatcaacccaccaattagtagactgattaactgaaaaaacagtaggtaaattaccatacccgcttccatctccagtgttgccaatggtcacgttagcaaacttagaagtctgccctgcaggtgccttcatccctttgcgctgtggacacttcctagccagatgaccaagttggccacacacaaagcaagtcctctcatcctgattaagattgttgttgttcttcttctgcttcttgaagttggtggtctgctaagctttgtatttccccttgctcttgttctgggccttgtgcacaacattggcactggactgcccaccatcgcccttagacgcggcatctttttcctgagctttctccttaacatcaagagacggtatcaagccctcaacggagtattcttgtctcttgtgtttgagtgcagtacggaaacttctccaagatagaggtagtttcgcaataatacaccaggccacaaatttgtcgggtaagacacacttaaggagttcgagttccttagccatggtttgtatctcatgagcctgttcgactacagaacggttgtcagccatcttgtagtcatgaaactgctccatgatatacagattattgctagcatcagtagcaccgaatttagtattcagtgcatcccacaactccttagcgtcggtcatatgcatatacacctcgaccagacaatcgccaagaacgctaagaatgcatcccacaaagagagtagtggcttcctcgaattgcttctgctgttcaatagtaagaactccttcaggtttgccaatactcacccagaagcatttcatagctgtcagccacagaatgaccctgatctgccatctcttaaaatgcataccggtaaatttatctggcctcagtgcatcggcaaaaccagccatagtaaaatcacagtgcctataataaggtttttggattgttgagattataggcatataatgatttaatctattccataaataaatcatgacattacagatgaaaactagcatgaacgcatcattagatctacacatgtaaactacacagtataacatgaacagatcaaatatgcgcaacatattgaacacgtaccgaggtggcgggaagaccggctgctcgatcgaaacttttcgcaggcgtctacgaaggcacgcagcacgcgagcgaagaggaaggcgagccgtcgcggacgaacagggagcagtctcgcaaagcgcttcgcaaaaaccttattgccgccttctcccggtgcaggatgtcgaaggcaaaggttccggagacctgctctcccgatcgcaggtgcacgccggcgagcgggatggaataatctacgagcgacggtgcagtacaaagtagcaggcaaaccctagattgatttcgcgtgtgttgcgtgaagacggcgggtcggtttatatagagaagggtcacttgatcagggcgcccgcacgatctccactgcgcgtaaccgaaccggataagtcgcgcgtaacttatccggactccacgccgtttgcacgcatcggattttttcggaacgtttccaaaacaaaaacgaatccgaatttacagcaaaacaaaactgtaaaaggaggctgcatctgcagcaaggtgaggaaccaatttggcagaccattcgacgcgtacgtcgtgcacacgcaccgcctgccaggcgaggcgagcgagcgcgcgcgtgttccccctcttctctccaccacacatgcttcaagtggctaggagggcatcctacctttcaaggaggtccccctctcctagaataagcaaggtggtactaaactccacatgcatgccatcccatgaggtggtcttttgtgattttccaaagaattaatcttcaagtgggctaaggcccattcattaattccaacaacagcaaccttcgagttcttgcaaatggtacctattcaattataaaaacgaaatcttggcaggagctctgcctattcaattagtagaagcaaagactactaagatcataatataatgtcagagtatcactcaactcttagtacaactcaagagtagctagacagcaccaggagcctcccaaatttaatttacacagcatcggttggtatttgtagtaaacacctttcagtaaactagtaaggtagcccgcgcagttgcgcgggcatcttatttaaatttgttattaggattttgaatattatgactgtctctcaatgaaagaatttgaatgttcctttataacacatgattgaaaaaaaaagtataaaggccggaaacatgttagaaatacatgtgtaaaacagcgaataaacaaatttcggacagtaaacgaattttgtacagaggacataaataacatgaattttaaaatttgttaacccacatagatgaaatcatcatctttcattgcataaataaactgcagttaaccaaataacctttccgttagcagcttgattttatcgatcccatgcgaacggaaaaaacatacgcatgcatcttattactattttattaattttattgctatagagatataccgtaaccttttggatatcagctaatcgttatgtgcaccgtgcatggatacctcgtaagcaatatgatttagggattagtagatagtggtagtgtggatatatctcgtaataattgatcaagtatattgtatactacatattaagcgttttagtagctttctaaagagcttatcggagtagctactcccttatcctatatatctataaagttcattctcaataagtgttctcagtaagtatagttaatgctaattctctcttctctcatgaagccataacacctcaattgtttttagcccttggatgattcatcaagggtgcaaattgcatctcttctccccaaaagccactccatacaaatcaaccatttataacttttgaataattgatgaaggtacaaaatattcaagcacatgaaagaaaatcatatagtaaataagatattttttctactactcatatctactattttatcacacaattctcctacagcaatgtgccggccatctagttcatagtgataacgtttcccggactgctaaacgtgttatattttatctttttctgataatttctattattttctctaatttattatagtactatgtacaattttaagagtgttcataagatgtttaatggactgaaacttttctatgtttatttttgcatggtatcagtaggatatgaattttttcatcagacttactataatgtattcgtgcaaattaaaggacggtatagtgatgcaatcaataggaatcccaatcgcacactttttttactataatccaaaggaggtttaaatttttaattttaaatcccaactatagttttgagctgagttcaaactttttaacaaagtattgctttttggatttcacagagaaaacaaaacgaaagagaggaacgtgggacctgcgtgggtacatgcttatttgcacctagaagtggggacttttagagataaattaaattggtagttttttaagatagattcaatgcatggataaaacaatggtctagcaaaataaatgaaaaccaacggttaaatgttgtttttcttagaatttatgtgatttattatagcgccacgtgatagcttagaagcgtttataggatgctatgtggcggcttagaaccatttatagagatgctatgtggtggcttagtagcatttagacgaagtttattggactttcaatatataattaatagatagatggtagattgtcagtaataaaacgaattaagctgagcataaaaccaacatatattttttataagttaatacatgcaaggatgcacgcatgcatgtaaccctccatgaagaggacatggacagatgtaaccatggtgcttttgctctcaacaacttatgaaaaaaaaaagaacagatgatgcatatacatgcttgagaggtgagcagattgccggattggacgttttatatgttagatgttaatttttcttttcaatctgtaattgttttttggttttttatcttttttttatttcggtattttttatcactttcggatgtattttctctcatatagaaacggtatattagaagtgagagattatattttaatggatctaataatctaatggtccaaaataacagctccacagtttaagtgttagatgtttcacttttttcttacaattctctaatttattatcgtgtcacatggcgatgtatgagcgttcgtaaaaagccacataacaacttgagagtgttcgtaggatgtttaatagacttttagtatataatagatatattgttatacacgatgtttaatttaatggatatttattatttgctagctagaaattaaggaggccaaagtgagcaaggagagatgacgtaaaattatttgtgaccacatgatagtatatgttattattttttgctatttgtaggagtatttgtcaaacgatgtatttcttatatatcaaaacacatggctaatatagataaatagaatatgttgtagaaaattataattatttagttatctaattattttttacataataaatttattatctaaaaattagaagatggatgggatgaagaaaagagaggttgtgagggagtaacgtacgtacacgtacatgtacgtgaggagtggaggcccatgaggggagcgggagtggatgggatcttggtttattttgtttaatatagatctaatggtgtaaaataatgggcccgctatattaagtgaaaatcaagggtgagatgttttgcttttttctagaatttcttggatttctctaatttattagagcgccaagtggcggtttaggagcgtttgtaggaagtttaatggacttttagtatataatagatagaagatagatagatagatagatatgatctaaacggtagttaaaattctttgaaaattttgaatgaatgtaagtcctctgggtagctggtgactggcagtggttcgagatcaagcagcttagctagctttcctatatctgtatataccaccccagtatgggagtagagtttgatcccttaagggatgtcccctcattatttgcatgtcactcaaatagttataaaaaaatttaaaacaattgagaatatatattaatatgtgatatattactccacaaacatgtaagttcaaattcaacttccacatcacgcaatgaaaaaacaaattaattagggggttaatttgaggatatctttaatttgtttgaaaaaacaaattaactaggggttaatttgaggatatctttaatttgtttttttcattgcatgatgtggaagttgaatttgaacttgcatgtttgtgaagtgatatatcacatgttaagacatcttttgaatttttttttcaaatttttttcatagttgtttgagtgacgtacaaacaacgaggggacatttcctcgagggatgaggggtaagatattttccctttgaactaccagttgagagcaattaattaaaaatcaaatgaagatatcgctcttttttaacacccttcaaagcgaaagaaactgcactatctcgtaggtatttgggaaaaaaattagtacatatacgattttttttaactgtgtgcagtacacactgtctgatacacacattcactaattaggatttaggaattaactacatgctttgaaagaatatgggacatctgcaggaacccgagcccactttcatcgtcgtgctccgcaagcttccactgaacttttgctgaagaatctcttattaataccgtatttagtctagtctggataaagaacaatgcgttgatcattgctctttccaacattaggtgaccatgcttcgtacggtgcatcgccgttttctgctaccttccaatcctaagctccaacatcgagcagaaaaaagtgaggtgattaattagcttcagtagagacaaagtttctacccatggctggccatcagtctcaactctcaccattagcaggggatgcataataatatcactaaagaactttctgatgatccgccactgtaaatttaaagtcttccatacaactcttaattacttacgagttgtgtgcgaatttagtttttttgaagcaagtcacccatgagagattgtaccgtggataaattcttcctatgtgtccacctatttattagggcatgctctgctctgaggagcctattgcgatgttgtgccagaaatgcataccattgaggccttgtccggtttggtggaaattaaaggggtttggagaaaattgagtgggaataattccataccacattatgtgtggaaataatcaccttcgatctttgccacttggggattaactgaatatgacctcactactacaacaaccatttttctatgcgggtgtttcgattattccgtgcgggggtttggcccgtctgcagctggtcgtctggaaaaatcaccattttcacgtgcggacggaccgaccacacgggataatcgattaacccgtgcggtcgtgttataccgaccgcacggaataataaaaaaggaaaaaaatcaaaatccacccacgaaccctaaccaaaatccacccacaaaccctaataaaaaatcaactttgtcggcatcggcgccgccatcaccatcgtcgtcgccgccttcccgaagcccaccgccatcgtcgccgccttcccgtcggaggcgggcgacagatgcggcctccccgtggcggtgggcgacggatccggcctccccgcggcggccggccacggatccggcctccccacgcacggatccggcctcctgccgatgccgccgccgtagccgattcaaccgccgccgccatagccatagctgtcgccgaggacgagggagagagagagggtgatgggaggagggggaggagccgtagccgatgatgtcgccgatgccgcggccgtagtgccgccactgatgctgctctatccgagggcgccgccatcgccgaggacgacagggagagggagaagtgtgggagggatttggataagtgtggggtgggaggagccgggtggaccactttatttttgggggcagctattttcgtgtgtaggtcacttaacagacccgcacgcattatttttgtatgcgagtctgttaagtggcccgcacatgaaaattgattttcctgtgcgggtgataaactggcaccggtccttttattttccgtgcggtttaacttacggaccgtctggaaacaaaaagaggaggcgtgcatgaaaatcaatcatgtagtagtgcctaagacagctctattagtattgatgcctagcccattggtatggtactcaatgcatctgtctgtccaaaatttgtacatatgcctgtttatgagctatgtactagtcattctactgagtttttgcaggttgtattttaattgagatagttacatgtttaaagtttatttcaaatacatacttttaaaatttaaagtttatcttccaaatcttgtgtggacctaagtcttgtccacttgtctaaacaagtagaaaacaccaaatttccaagggccgtcttttgagcaagcatttctattataacgagatttcgggagaaactactatagtacattgatatgcaactaataactaagcgcacgttaatatttctcctcaccgctatacaccgccatcctgatgagccattgagctactgttttgcggcaagttgaagtagagcgagcaccgaggcatatctgtctcccgatgcctcataagcccttacttagcccgtacggcagcaacatatatatcaaatttgtaatgaacaagatgatcaaatttcatagcttatacaactttgcttgtgctttttctagtttggtggttggtatatcttcgcttgtgctgtaactaaccagctagggtggacatatataccggtatgtcttctgcttttctttttcccctgaaaactgagggaaatttgatgcttcaattagacaccagtactcaagtacccattctgcttctgctggtaatatatatactgcatccgtcatgactccgtggtaggttattacagagagctaattaaacatgggcccagacactagctagctgccagcatgccacagctgttgagattataggcatataataatttaatctattccataaataaatcatgacattacagataaaaactagcatgaacgcatcattagatctacagatgtaaactacacagtataacatgaacagatcaaatatgcacaacatattgaacacataccgaggtggtggaaagaccggctgctcgatcgaaatttttcgcaggcgtctacgaaggcacgtagcacgcgagcgaagaggaagacgagccgtcgcggacgaacagggagcagtcgcgcaaagcgcttcccaaaaaccttattgccgccttctcccggtgcaggacgttgaaggcagaggttccggagacctgctctcccgatcgcaagtgcacgccggcgagcgggatggagtaatctacgagcgacggcgcagcacagagtaggaggtaaaccctagattgatttcgcgtgtgttgtatgaagacggcgggtcggtttatatagagaagggtcgcttgatcagggcgcccgcacgatctccactacgcgtaaccgacccgcataagtcgcgcgtaacttatccggactccacgccgtttgcacgcaccggattttttcggaacgtttccaaaacaaaaacgaatccgaatttgcagcaaaacaaaactgcaaaaggaggctacatctgcgcaaggtgaagaaccaattttggcggaccattcgacacgtacgtcgtgcacgcgcaccgcctgccctgccaggcgaggcgagcgagcgcgcgcgtgttccccctcttctctccaccacacatacttcaagtggctaggagggcatcctctcttttaaggagg

SEQ ID NO: 1549 - DNA, 10783 bp, Oryza sativa
  unsure (1)..(10783): unsure at all n locations
gtatttgtcaaacgatgtatttcttatatatcaaaacacatggctaatatagataaatagaatatgttgtagaaaattataattatttagttatctaattattttttacataataaatttattatctaaaaattagaagatggatgggatgaagaaaagagaggttgtgagggagtaacgtacgtacacgtacatgtacgtgaggagtggaggcccatgaggggagcgggagtggatgggatcttggtttattttgtttaatatagatctaatggtgtaaaataatgggcccgctatattaagtgaaaatcaagggtgagatgttttgcttttttctagaatttcttggatttctctaatttattagagcgccaagtggcggtttaggagcgtttgtaggaagtttaatggacttttagtatataatagaagatagatagatagatagatagatagatagatagatgggttacgagtaaaatttaaagaggtgggctaaaggaatgagatatgcttttatgtcattagtgcatatctacatagcaatagtattcagatatctgtactatttttgtccgtcggaaaacatttgcgtttgtatcaaaaaaaaactagatgtaccttgtatctgtgtgcagattatctgatattattggctttgaattgtatctgtaatatttttcgtgtagctgatggaaacaatctgaaaaagtgatcaacaggaacaaaattcatggcggccttttttcatttagagaaaaagatgtttaatcaaaatgtttcacaaatatacaacattcatcaataacccactgcatgaaacgtcaagtctcaacgcgaaaaatactatacaataacaatagtgcaatagcatttactaccggttgaaataattcgcttctcgtacatgaaacactaaattttatggtagatcatgttgtaatgattcaattacaataaatataatggtggaattggatcataggtcggacaagtaatttaggaggaaaaaacattttaggtttactataataagccgtatctttattttaaatgcatgcatgaatgggaaagagatgtgctagaccctgatttctgcatataaaagtatcaatttcaagctagcaacatatttgaattttgtttggttgtgccattaagatctcaatccaatcctccaagaaatttgatcccctccaaattcaaaaaccatccaaattcaaatttgaatttgttaaatatgtgatccaaattttgggcccacaatatattcggattagtttgctagtaggagttcctattaggtgtctttctatttcccttatatgtagtattgtaagccgtacgggaaggggtgacgtttccattgttattcccctacgattataatcaactcctctatagtgatcattgccggtcggtgcccgtggtttttcccgcaagggttttccacgtaaaattcgtgtatccgttgtgcatataggattagagatcgatctacaccacgtcgccgccgtcgccggttttgctttcgtcgtcgctgaatcaatctgttcggtgcagtaccccgtcgagtccgagtcgctgccgtcctcacacacccgcgcgagaaaagcagaagctgcagcaaccgcacagccgtgaggaggaaaaagggccggcctactgcaactgtagggcacgcgacccgaggaagtcagggactacatcgttcctgttgagaaggaatttctcgatttttttctgctaagcgcaccaaagcttgtgtaccaggaaatctacatacttcgctttgtgcacacaggaagtgcacccaggtttcgtgtttttgctaggtttaccctaatttcttacaagcaaattcaggattaattctcatggcaagtttgaagtatgatctaccgctcctagaccgagacacaagattctcactttggcaagtgaagatgcgagccgttcttacacaacaagacctcgatgatgcgctttctggatttgataagaggacacaggattggtccaacgatgagaagaaaagggatcgtaaggctatgtcatatattcatcttcatctatctaacaatattttgcaggaggtgcttaaggaggagacagccactgggctgtggttgaactggaacaaatatgcatgactaaagatctgaccactaagatgcacctgaagcaaaagttatttttgcacaagttgaaagatgatgggtctgtaatggaccatctctccgctttcaaggaaattattgctgaccttaagtctatggaggtaaagtatgatgaagaagatttatgccttattctattgtgttcattgcctagctcatatgcaaacttcagggataatattctttatagtcgttgtggagattatggataccccatatctacacggcggttatatttaaactggatataggatgcccaatatagatagaatatctttatttgtatctcgggtttgtttcttaacttgtacgtcaaggaaataccctgaggtttagtcggttacgattgtattttatctgtattttcattttccgttagggatatgagctataccttgtaatacggactccttcccctatataaggaggggtccgagtccttcttgggacataacttcttatggagatcatacatccaataatacactcggcggattcatccccggacaagagtagggtattacttcttgaataagaaggcctgaacctgtataaatcctttgttgtcatgcccggaaattcactagtaatttccgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataaaccaaacgtcttctccttctggatcctttatcttcaactgaggtttgatgattattgcaagaatgagcatatgacatactcaacaagccacacagcaagtatgcaagtgcacaaggataccaaaggatggcataatatatgctaatttgcaaaagcagcattaagcaaaacatttaagagaagtaaaacagtagagtaattaatcagaaattttaatcaacactgaacagcacacccatgctgcacaggcccaaccatcctgaacaaccaaccccggtcgtacagatcaaacctccaaaccaggagctaagcaaattattaccagatataacatccataattattgtgagaggtgtgagactaatcacgaaaaacattgctcaacttgcccataaccgcgggcacggctattcgaatagttttactctggccagaggtgtaccactgtacccacaagacacgattccacacatgttgccatgccccgaaataccaccacggcattgcaaaggggaaatcgtgacaataccctttgcacaacacaactcaaaacagtgcaccgttcctggatcataatcacccccttataaaacaaggcatggactccccagcgacccccacggacttcttgccgcttctcagtctggcacactataatgaaccatgctatacaaaaggtaaagccgttgcccatgctggcttgtggttggcacgataaatgtctcacaacagtagctcgcgaaccggtccttaattgccatgagcacaaccatcaaaaccatatgctcacaacccaccttaaccagattttaattatcaattaattaacatcacacgattaatcatcgtgagctaccattaaatataaccataattaataagaataatataatataatttatatttaatcccctttaattagctaatgtttctaagcatggctaagcaaacatacatataacatttagctgaaccaaaccaatatataaggttcatgctaatcaaattataacccataggaaaataagatcatcttcggccattaattaacggggaaaggttcaccacccgatgacattcgaaaacaatgcatagttgaaataaaataatagctttaaatgggttcaacatgctcaaagggttgtttgggatctgtgtgacttgccttgggcttccgcaaacgcttccgaaccttgctcaacgaaaacgctctcctccggaacgtcggaaactaaagcgaaagaataaaaaatcaacaaaacagtacaaaaacaagcataaacagtacatgtgaatatttttaacatgtagatcttgattttagaaaaatttagcaacttgaaccacctgaaacggatctacggttatttagttatgattttccgaagatttcatctataagaaaaaggggaaaaaggaaaagacgatgatgccatgatgacatcatcaatggtggccggctcggatggcgacctcgccggagctagggtggtcggccgggattttggaggacatgtacacgtagaggacgacgaggcgaacccaacggtactcaccaacgagccaaacgacgaacgacgacggccagcgacgaagaggcgacggcggcggctcgggataaccggcgacggcgagctacggcggccggagacgaaggagaggtggcggccgagcttctccacctcttggcgaaaccaacggtggcgacggcaagcgacggcgacggcggaggcagcgtggcggcacaaccggagttcggccggcggcggcggcggatggtttcacgcggcgacggctctacgggtcacgggagaggacgggagagggggcaaacgaaagaggaggactaggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaactaattttgcaaacggagctccggatgaggcggatttaacggaggaagcggcggctgcacagggcacagcacgggcggctcggctctgtccagagctggaagatgaacagtgccagggaggtaaattagacttttggttggctgagaacagaacagggcacttgacttgggctggcttgggctgcacagcacgcgcgcgagggagagagaagaggaaggaatgggccgaaaagggcccaagctgaggaggaggatttttattacttttccaattaaaataatcacttaaatgatctttcaattgttaaaaatacttccaatgctcaaataattccaagaaaaatcttgaacatacttggacactcaaagtatttaatataataatatccagatcatttaatgattaatttattatttaaataattgctaaactgttctttgtatgattaaaattaataattgagctccgaaaaatccgagaatattccagagagtataattaaccatggagaatttaataaaaattaaatccatccatgctttatatttagaaaattttatttcccacatttaacttcacttgtaaattaatgaacatttaatataaattttgataataatttattaaataattttataaatcctgaaacaaaaatcaggatgtgacatttgtcttcaaccccctttttagcttgatagccacccccttttagtattgccgaaatcttgtttcgatagttggcgcgccaggtaggggttgcgtcaagcttttcgccgatcagtgcaatgggttccgtctccggcatcgatgacctcgtcttccctcccgggcaggcatttcggttcggcagcctcgacttcatcaccaacgacttcggcaagatctctctcctcgactcggaatcagaccagtcgggagagagccgtatctcggccccgtttggagttctgaacgcggctaagatctactccaagtctatctcgatcgagtcggcttcaacatcaccagatcgagatgatagggcctacccaccgatcctaatgaagctccccgacgatttggcggccgtcttcaccaccacgacgtccccttcccgtaagcctaggcggaggtcggcttcaacaccgatctcgcctagctccaggaaagttggcgtcatcctccagccactcggcacagtttcgacggaccagttggagggctactggagctctctcggcgtcgactcgcgtccgactgagatcttggagtacgatgagttcggctttcgcagcaacgacccagatctcgacaactttgacgaaagcttagaagacaactacacccctctctatttcggcgtcttcatggccgataatgagacggaagagcaacgccaagcccgagaaaccgaagcacgacgcgaggccgaacgacgccgactggaggaggagcgtcaagcacaagaacaagaacggctgcggtgtgagcaacaggagcgtgagcgggccgcaaaggaggctgaagaccggcggctacgagctttggaggcagggcgccgagcgcgatatcttatcggccagcaagacgttgaggggacaccggttttccgcaccccacaacagaatgttgttgccgcgatcaccctcctcaaggagaacgagctcaatcagtctgatcatgttgtcaacatcttgaaccagaccaagaccatgattgcagcttcggtcccagttaactccggaagcgtccgcacgccgagtggcagccaagttccccatcttcgatctcatgaccaccatcagccaagcctcagcatcaccggtgcaggatctaatcgcaggagcaggggccacgacgagcgatctgttcacttgccccccgagcatcatagggagagccgagtggaacgacctcgctcgccgcctcgtcgtcgccccgtcgatcttcgtgacacgatcattcagcgccgagcggcccgaggccaccatcattcatcggatcgctacgacgatgacctagatggagttgccgctttcaccaacgacctgtgtcgagtggattggccagccggctttaagccgactggaatagagaagtacgacggtaccactaatccagaatcatggcttaccgtctacggtctcgcaatccgctcagcaggaggagacaacaaggccatggcaaactatttacctgtggctttagcggattccgcccgatcttggctccacggattgccctgtggtacgattggatcttgggccgaactacgcgaccactttattgcaaatttccaaggcactttcgagcgccccggcatacaatttgatctttacaatgttatccagaagttcggagaatctcttcgagattacatccggtgattttctgaataacgcaacaagatctccgacatcactgacgatgttatcatcgccgcattcaccaaaggaattcgccacgaagaattggtcggcaagttcgggcgtaagcctcccaaaacagtcaaactcatgtttgaaaaagccaacgagtacgccaaggctgaagacgccgtcatcgcatcaaagcagtcgggctccagttggaagccaaaaaaggatacgccggctacgggagggggtggaagtaacaaccataaggaccgcaagcataagcctgaggaacttattgcaaccactactcactcttctcgacagcgttcacgcatcaatacgttcgataagatcatgaactcccaatgcccgcatcatcttaactccaatcacgcggccaaagattgtttcgtctacaagcagttcgcagaacaatacaccaagactacatggaagaactccgacgaagaacaaagcacgtcgaagaagaaggaagatggcgaccccccggcaggttttcaagaccaccgcaaagagcttaaccatatctttggcggccccttggcttatgaatctaaaagaaagcaaaagttgactgagagggagattaacgctgttcagcccgacaagccccaatatcttcgatgtttagaaacagcaatcaagtttgaccgctcggatcatcccgaccgagtggtccacccggggcggtaccccctagaactagacccagtggtccgtaacgtcaagcttctcagaaccctcatcgacggcggcagcgcactaaatatcctcttcgccaaaaccctggatgatatgcagattcctcgctcagagttaaaaccaagcaatgcgccctttcacggagtcatctcggggctatctgcaactccactccgccagatcaccctcccagtaacctttggcactcgggaaaacttccgcacggagaatatgtgttttgaagtcgccgatttcgagacagcgtatcacgccatactcgaacgcccggcgttagccaagttcatggccgtcccgcactagacttacatgatgatgaagatgcccggtcctcgaggagtcctatccctacgaagtgacatcaagcaggccgtcacatgcgacaaagaaagttgcgagatggcccaaactcgcgagatggcgaccgcccgagaagacatccgactagctgcaaccatggcaagcgaaggagaggtgcccacgaccaaggtctcaaaaagcggagaaagcgaagccaagacaaaaaagattcccctagatccttctgatcctactaaaacagctgtaataggcaccgagttagattgtaaataggaaagcgcgctcatcacctttcttcaaaataataaagatatctttgtgtggaaaccatctgatatgcctggtattcctagagaagtgattgagcactctttacacgtcaaagaagacgctaagcctatcaaacaacgactccgccgctttgcacaagacaggaaggacgcgatcaaggaggaattaaccaagctgttagcagcaggcttcattaaagaagtccttcatcccgactggctggctaacccggtcctagttcggaagaaaactgggcaatgtcgtatgtgcgtcgattataccgacctcaacaaatcttgccctaaagatccttttgggttgcctcgcattgaccaggtagtcgattcgaccgccggctgcgagctactcagttttttggattgctactcggggtatcatcagatccgactgaaagaatccgactgcttgaagacatctttcatcacgcccttcggggcctactgctacatcaccatgccattcgggctgaaaaatgcaggagcaacttatcaacgcatgattcagagatgcttcttgactcaaattggccgcaatgttgaagcctacgtagatgatgtaatcgtcaagaccaagcagaaggacgatttaatttcggacctagaagaaaccttcgtgagcatccgtgctttcaggatgaaactaaaccctgaaaaatgcaccttcggagtactgtcagggaagttgcttggctttatggtgtctcatagaggcatacaagccaactcagagaaagtcaccgccatcctcaacatgaaaccgccgagctcccagaaggacgttcaaaagctgactgggtgcatggcggcgctcagccgattcgtttcacgacttggcgagcgggggatgcccttcttcaagctactaaagaaaacagataatttccagtggggacccgaagcacagaaggccttcgaagacttcaagaaactcctcaccaagccaccagtcttagcctcaccacactcacaggaaccgctgctattatatgtatcagccacctcccaggtcatgagcacagtcttggtcgtcgagcgtaaggaagaaggccacgtccagaaagtccagcgactgatctactttgtcagcgaggtcctagccgactccaaaacgagatatcctcaagttcagaagctgttatacggtattctgattactaccaggaaattatcccactatttccaaggtcactcagtcacagtggttacatcgttcccgctcggcgatatactgcataatcgtgaagcaaatggacggattgctaaatgggctttagaattgatgtctttggacatatccttcaagccccgaacctcaatcaagtcccaagcattagcagacttcgtcgccgagtggaccgagtgccaggaggatattcccggagaaaagatggagcactggaccatgcactttgacggatcaaaaaggctttcgggcactgtagcaggagtggttttaatttccccaactggagaaagattaagctatgtactttggatacatttttcggcatctcacaacgtcgcagaatatgaggcgctcctccatggactatggatagcgatttccctagggatcaagcgtctaatagttcgtggggattcacagctagtcgtaaatcaagttatgaaaaagtggtcttgccttgacgataacatgacagcatatcgacaagaggtacgcaaactggaaagcaagttcgatggactcgagcttagtcacgttctccgacacaacaatgaagccgccgacagactagccaactttggatccaagcgcgaggcggccccctccgatgtattcgtcgaacacctttatgagccgaccatacctcagaaagaaatcactcaagttgtggacactcaagacatagccatgattgaagccgactggagagagcccctcatacgatttttaacctcccaagagctccctcaagataaagatgaagccgagcggatttcaaggcgtannnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1550 - DNA, 447 bp, Oryza sativa
agtattttgttcattataagatcactgccttaatttgaaatccacaaatcaattttctgtgtttactacatcaagtccactgaagtccatttctatgtcttgccagtctatctcgcttatcactagttccacattggagctagccttaatcatcggttcatcatcaactccatgtcggagctggtcatctccaacttccccaactctctgtcggagttggtcttcattatcatcatgtcatcataagcaacatcatcaccagcttttcatcacagttggcttgtcaggtcagtagctcctcgtcggagttgacatcatcataaatcattaagggccgaagaacaatcggtgaagttccttcatcgtcattgtaggatcgaatcacaagaactaagccaaccagaggagggtgaatggttgatatacccaaaaactaaaacttttagt

SEQ ID NO: 1551 - DNA, 357 bp, Oryza sativa
  unsure (1)..(357): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctgacggtactattgaaaagtacaaggctcggcttgttgctaagggctatactcagaaagaaggcgaatatttctttgacacttagtcagaaaggtactgtggaattggggcttcactatattgggtatcctgcggtactggagggttatagtgattctaactggatctctgatgtggatgagatcaaagccactagcgaatatgtcttcacattg

SEQ ID NO: 1552 - DNA, 544 bp, Oryza sativa
ggatctgctcatactggtccggctttaacccctgctgaagttcttatagccattcatgatattaatcctgaaaaggatagagttgccctgaagaaggtgagctattggttatgttgatgtattcattatattccaacatctcaacagcataaattagtgcccagtacacaaattggatgtcttgatggattttgtatcaagagttcaagacagacatgcatatgcacctgtgcagtagatatcctttttcttggttgacatgagttttttctcgtttctgatggaaatgaaaatattttcaggtcactgatgcttgcacagcttgctttgaacagcgcacggtatttactcagcaagttttggagaagtcactgaataaattggtactaacttgactgctgttattctttacctattattcttttacatattcttctctttgattaactgtttggattgttatgtaggttgacaatgtaccaattccacttcttttcatgagaacagttattcaagcacttgatgctttcccagctttggtaca

SEQ ID NO: 1553 - DNA, 12505 bp, Oryza sativa
catctgtcacaattcttattgttatcctgtttattttgcgaaaacagtaggatggaatttctttgagtagttcttttgtttgcaatattttttgagtagttctttatctgctgttcttaagcttcatgctatttttcatgctgcagatatggaaaatgccaaagctgtgggttgggttcttaaaattggcatatcagactcagccacgctcgtttgatgttattttgcaggtacaatgttaagtaactgaatgcattcttgcatgtatgttataaaaaatatgcactccttgatatacaatacactactgtactgacatggcttcacaatgctacttttagttacctccaccccagcttgaaatagctttgaataagtaccccaatctacgaactcctctttgttcctttgttaatcagcggaacatgcacagcatcttgcccaggtactttcccaatattattattagtcttgacagcttgctcctttttcgttttacatttttgattttatgggcagtaaatacttaagcatatagttaccaccaacagactgattcaccaaaaacgactagttgacacaaatactagcagagcacccacttctcaactgtttattgccttgttttatatatgagtaaatttcacaaaactacaattatttggtcaaaactatcactttgttacaactttagctgggtattttacaaaactgcaattatttggtcaaaactgtttcattgggtcctattgagtctttgatcagtggcgcgttaatacacgatattctgcaaaaagattccatagtatcacttgtcttaccttttcatattcataacatgccttttgtcattgatttctgcaaatgcagacagattttgaaagttctgggcttcatcaatgaaccgcaccaggcaccaattccatttgtgcctgctgcaatgcaaacggcagatgcaacctcctctcttcctggtgcaactcttatgtgaaatgtgatgtataaactccaatcagatgcgagaaggctttcctgatcacaagtacacacactgccttgtgaacaacgatgatatgtgagtaaaacagagcccagacaaggacagcggtgtcactcaaaagggtctgcgtttgctggacttgtttcaaacaaagttacaggttgtcagcaagggataccgaggtggtttcttaaaggttcattgcgcttgtgctcgaggggctcctatgattttgcagcccgtgcaagttgtacagtagttgtactctttcgtcctgcaattgcggactgaggcttctgtgacaagcaaagaatagaaggaatattgtttaggacgatgatatgacttatcatcatcatgtcttccgccaaggaaatgacatggttgcaagctgcggcaatgcggcattcctttccgagctgcacggagacggcatccgactgattggctaaccatttcttctgttctaatgctaacaatgtctgagtattgtacattaactatttgagtccgctgtcagccgatgttaaacctttaatctcagaagataataatttatagatgttttgattgactagcatatcaaaggtaatagacaatattagcgccgttgattttcttcggtgctgcgttactttcgtaactgcgtagtgcttactactccaaatttccagtaagctcggggctcgtttcctaactcatcgatctcgttttgcacgcgcacgttttttaaactgctaaatatttttcaaaatgttaaatggtgctttttttttgcaaaaaatttctatatgaaagttgcttaaaaaaatcatatggatctttttttttaaaaaaaattagctaatacttaattaattacgcgctaatagactgttccgtttttcgtgcatgaaacttgctctagcgaacacagccatatatgcagacatgcagttgggcaatgtctttccctacaatgatacaatagaaaaacaaattaaatcaaacaaaaaaaaatctaacacatcagataaatccgttcgaaataaatagggtattgctagattttaagcgaactaaatttgtaaaatttaaatttttctaagtgaattgtaattttgcactttggaccatcttttattatctaatctaagtttcactttaaatcatctttttattaacatttgctcttcgtactacgtttttcttttgtcttttttttactgctctattcatgagtccaacgataaccgcgaggacatcgtcactgacttaggacctgtttatatcccttggtaagttttttcacactgttacatcaaatatttagacacatgcatgaagtattaaatatagacaaaaagaaaaactaattacacagatttgacaatgtgatttgacaatgtgatgctacagtaaacatttgctaatgatggattaattaggcttaataaattcatctcgcagtttacaggcggattctgtaattttattttgttattagaccacgtttaatacttcaaatatgtgtctgtatatctgatgtgacacgacaaaaaatttcactcctacatctaaacacaaccttactcatgttgacaatcttcccagtttacacgcatgtcacatttttgcagagggagaagttggaagtacctaggaaaaagtgttagggtctgtttggataatggaaaatgggggatgggattgggattgggaaataaatgaagggttatgattaaatgaaagagggggaatgaatggttaggatttaaagatgttttttggtgggtggaaaattatttaacatttccattagacaaacattgcctcggggtggtcaaaattacaacaaattcaaaaatacctagtctaaaatgaaataattgaataaatggattgccgaaagttaaatttcggtaataaaagattgccaaagtgtaattcacatcgtaaaatcacactttcctaagcctaaatctgtagtactacgtaaagtaacaaaaaaaaaagttgtactccgtatggattgtgtaattttacttcttttgactttaattttgttgttatatatgacttttatcagtttgaatttttttcatgtattttttttcaaaaattaagaatcataaatttatttcatttaattttataatttttgtatggttaaatatcttgttcaaccatttatatgggaaaaaaggagaagtagtgagataatggcattttggtacttttgaaatatgccaaggatttatagatagtctccgagtgtgtgagatagtagtcatattcttctatttcattttatccacatagtatatttgtttccttccttctatttatcatgaattcgcaactctcaggttaatccattactaaagagcttattcaacttattcatataattgtttactcctacttcaaaaaatacatttattcatttttaagctattggttaaatttattttcaaaagtatttgatttattccttttcgaacggtcaggccgttgccgacgttttatattaagaagaaggtgttccattttaaggagaaaacaggaccaaaccttacagtgtctagttaattaggaaaaactgagcgaaaactacaactacaacaccacatcaatagctaacctaacttacactaccatgacggagcccaacataagacatcggtcaagcttgccatagaggcgacacggcaacccacacatgttatcattgccaagcttaccacccaagcgacacatcagtttcgacttcactgcaatgctaccccaacgccaaataaacaaacaaaaacgacacccatgaaggacatcagcccaaattcctacacacagttagcatcaacaaccctataaggagatcgcggtgtgtgtcatcgttgccaagtttcgtcgcacccctacagcaaagcagctccgactctacccagtagtaaccaaacaaggatgatgaatacctgccacaaagcaagaaatgaaaccaaggcggcaaaggcctcgtcaaacacactaggcttgtagagcttcaaaggcattgcaggagcccaccaatggctaccgttgcacgcggaaggttcttggtgctaagagaagtcaacgccaaaacgacacctccaaggagggaaacgacgcctaatggtgccgtcgttgtcataccggcccatgccctagcaaggctttcgccagtgattcccaatcaaatccctacacaactgtcctgcccaacgaccgttgttggaccaccacgctatcccttcagcgcccctgtgcgtatagtaaagtagataatggtataataaagtagataatccgagacgatagtttgtccaattatctaaatcgaagcatgtgaaccgtattccagcttttgcgtgattgaactccgaaattaggcgaatcatattgatttcagatttgacaggctagctcaaagatgtttattaacgtgtgcttctcgacgccactgtcagccgtttggggtcgagctacaatttgagcaaaggacaccaccggcctttgttgtttaactgacagtattaatacgagttatttaatgcatagatcaagagattacatgcctcccatagttccatcgacagtgatactaactatgagttaacaattgaaccagaaataagggccctttaaatcaaaagatttatgtaaaaattttctaggattctttctatatgatttttttatttggccctttaattcaaaggattgaagcttttcgaatcctatgaaattcatatggtcatgggtagcaccttaggtcttgggtttaactcctcatgggagcaaatttcctaggatttaacggcatcgtgctttcagtggtaggtcaatctccaggatttgtcggccaagtcttcgaagatactcataggggtagcgcttacgtgcgtgcgtttaggttgcgtgcgtttaggagtgaatgtacgtgcgttgtgagtctctaggttatattgcgtaattctaaaaaaaaaaggtaaaaatggagattttgtggtaaataacagaaaatgatgttccctgccgatgtgaccaaaaatacacccatcgacatttcgatgcaccgatatgcttggttttaagttattacaataaatacacctacttaacacccacttaccaagctcatgccatgtgaatgtgatttacttcttttgatagaacaccttttctgattctacatcttttgcaaattacaatacttaacatccacagatttttgtacagtgttatgttcctaaatcctaatcggtcatctacttcaacatctactcgtaaatcctctactactccgtaggctgtagaagttgaaccaattacccgggcggccggcacgttccctaatcgcccgatctaaacaatacacaaaaaagtctcgacccgtttcgccccgaccggtcgccgcgccaccacccactccccctcaaacaccggcggtggtcatgccgcctccgcctcctcctccgccgccgccgccgccgtctcctcctcgccttcctctcaccgcccaccgcctccctctcccgcccgcgacctcgccccccgcctcgctcctcctcgcgccgcgcccttcccccacccgcgcgctcgcgctcctcttcccggactcctccgcgcgcctcctcccctccctgccgcccgccgcctcgctccccgccaccgccgtcccctccccgctcgccgctgccgcctgcttcgtgctcctgctgccctcctcccacctcctcttcctctccgcgcacccgtccccttcctcccccgcggcccacctccgcgcctactccctcgcctccggccgcttctcgcccgccccgctctccttcaagcgccaggcctccgcctcggggctgcccctgcacggcctcccgttcggcctcggcgtccgcctcgccggcggggtcaacgccgtggctctgctgtccctctccgccgggcagatctgggtgctagccccagggatggctgcggacgggcgcacggtggagctgcacaagtgcgcggtcgtcgagctcgagccgtcgcggccggtgtacgccatggaggttgccatggggaggctgctcctcggtgaggctggtggtttgcgcgtgttcccgctacaaggcttgatgaagagtgggaaagagaggcaggtgaggaaggagggtgcgggggcagcagtaaggaagagcctgcacaagaagaatggaattcggaatggttttattgtgccaattgggcatggcggtagcgagggaggtggcaaacgagaagctgtttccactcgtgagtatccttaattttccttgaagctttgattctagtatttgattatcttagtgctataatgtgaaaaaggttgatcactatctttgtgaatgacacctaggttaggtagtatttgattgcacttagaaaaagtgcaggatataaggtagctctaatcttcttatagtgttgttgtttttgttatgtctgtgtctaggcaaagcatttgagtgttcacttagggtcgcaatagagcaagtgtagtgtggcggaggtaccgatagaacaggatataccttcagttgatttgtgcaaaactgatgatttgataaaataatatttgccccaacacaaggagcaaagttgggaactatttttcaatatagtatattttttctttggtaaatcccatgtacatgccctttgtagcagaaaactacgggttcacaaatttcacataactacatggagcttgatagtactattaagtattaacacaaaaacacattgtttgatacaggatttgtgaaatttgatattttctgtattataactctcaagtttttctaacaattatataatactttctcagccccattggtggtttcatgagcaaaatgtttttttttaagaaactgataacaattgtttggtgtactactttgtatttaaggctaatatttgtaaaggatgaatggagctaaataattgtctctgcaacatgctgatattttttttaactctaacatatctggttgttaaagtccacttggattttgtttgcaaccttgtagttcaaactgctaccttattccttataatcatgatctgtacaattctatcgattgatcagtaacttttgatggagttaatgaggaataatgttagaattttctttctgacttttgtgcttttagctacttgtaggtgcagacataagttgcatggccaattactagggactgtaaaactataaatttaacaaagagtgcattatatatattttgtctatggctaattttacaacaaagcgaagaaagagaacatgaaaagaagggaaacccaactgtgtaaaaacctgtgatcatgttttctaacaactaaaatcgctgtttatcaaccactcacgacgacaccgagatcttcgacttagctcccacaggtcccaggctcgtcaccccgggaactcgcagcccatcacaactactcatactaggagccacctagctagaatagaaggaagaatctcgtaaatctagactatgatagtgtactcaacttgcagttttccaacagtattaaccatttgttaaactgccttcatcagaggatctagattcgatcacacaacccaatcatatcgcaatacattattctgaggtaatacttaccaatcgatgtttggtttctttcagttgtgtcaatttacaggcatgactaagaacaaacttacagtagaattgctgctatttttgggattagttggttagtttttactatgtgcatgtataggctatttgcttgcacagacttttcagctgcatttcactaaatcaactaatattagtccaaaattactctttcaggtaagctggcaactttgagagtaaaacagacttcagggagctatttctctttcttttcctcatgtagttctgaggatcatcataactcacaaggtgccgtagaagtgaaaaatgtagtgaaagttgtttcaatccgtcctctttccaaggacaagtttttggtccttgattcagctggattgttacatgtattcagtcttcaaaacaaagaattgctctcagaagctactagcaaaagatatagtggaaatcacacacactgtttggataatgccatgaaagtgcagctatttgctgtctttccaagtagctctacaagtgagtttttcatcctggatttgttgtttttgcatcatggtggtttacttcattaataaatgtgttcagagtgcttgtgcagagacagaaatcttttggatttcggatggtgggcattccatacacataatgtcagcacttgatgttgaaccccccaacagtgataatggaggtggtgatggagaaagagaatcaacaaccattaagctcacaggtttgtgtcgtaggtccttttttttttgtaccttaggcctttatttgtcctacctgctattttcaatcatttgattattagctcaaccacatctttagaaactgctcagataggcaagtttctagaaatttctaatttatcatgtaggtttcatattttattaattgtttttttaaaaaaaaattattgacctgttgtgttacattataaagtcatcccaggccattaaaaactgagtagtgttgcctattaagtcatgcgtgttggttaagctttccccagttagcatagatgtgcatgtttaacatcatcaggcttgcaaagtaattgttttaaaaaaccagcataatgtatgaagccctctttttcccattgactaaggtagtgagcttgtttgtttgtttttatcaggccatgatctatcatttatgttgtaactctctttctgtcatgttttttatcttgtgttttcttgcagctattgaagcaatctttacaagtgaaaaggttcaggacattgtgcctatctccaaggattcagtccttatccttggtcaaggtaatattcaatgatatcttgaagattgacattctagattgccatgaatctggatagtttgcttatcttcttctaaacctcctcctaacatcataaatattgtgtttgcaggcaacatgtttttgtatggaacttcttgaattttgttgattatatcatatattcggtaaatctatctgaaaagcttgatgtcattttagtccctttttgctctcattggtttgcctgcaccaacccacacattatctttggtatcaggtgggagatgtgaatgtttgtctagatcatgaatttgcagtttcgatgggtttttggctgaagacagggtgagtttggtgactacaaattgctttcaattatttaaccacttagagtacgatacttatttcttaaattccccccttctcttccatgatgcagtgttggagattttgaagaatgcagttgttcacctgtctttgaagtcatgagtatcattagtctttaatttcagttagcagatgaaatactcgagacttcaacagccagcaagagttgaaaggtgcaggccgttctccatcttgtcaactgtctgaaagcaacattacaaaactataggtctttcagcacagttcacaagccacagcaacttctgaacaggtgaagccagattattcccagaatacaaccacccagttgtttttgcatacacattttgcgtgccaggacaactgcagttctggttgcgatatctggaagaagataaggctgcaatcctatgcccagctcagctgttgtggaacgtggatcatcatcaagtgggtcggttatgaagctacaggtttggtgctccacaaggaggttgatcagttcagagactggaccttgagtccatggtgtcctggagttcagcgagtattttcgttccaagtgccaggccccgaggacttcagaaaccaataatgtatttgccatgttcaatgtcaggttttcacaatgcgcacgctagtacggtgtgagcttgcaaacatttacccgttgtgcctgtttctgaaatcaaaatctagttatttgccccgtttggaaagtttatttgttggctcatattgcagcagaaccttattatttgctcgaagttggattcgggacttcacgtcttccatggccatagaaattgtaacgctcccttttaaattgctagctccagtggcctcatatttcaggtgggatatcttcttccagcatcagaacgtactgtaccaatcatctgcacgatcgcacattcacaatggactagaatggcagcaaccatcaacccatcctttgttcgcccagccgtcaaatctcataggctgttcactctgaattctgaaaaccttacgacggtttgacaaaatttctcaaacaatctagtatatatatacttcaggtggaatctcctccctacatcatcagtagatcatccgaactgtgctgcaagcccgaaatgcatcctaagcttaccacagctgacaaatctcataggctgtttgttcattctaattctggatcctggaaccagacgactgtttgacatatgggtccccatggattgcttacgacttattataagccgtaatgtcttattagcaattaaaaaaataatatgtgagtaaaacttttgtatttatgttcttagagacttaaaggccaaagctgaaaaataatacgttgaataaacatcaaaatcaaattcaaaattaagttttaaaatttaaattttagctttggcttataaaaggcaaaggaaacaatgaagcccatagcccgttaggagtactatgctttccttctcacgccgcgcgagagaggggaaaagccagtgaagatggtggccatggccggcggcgacggcgcggggcggcgtttttcgccgtcgtgaggtgctgctttgtcggcttctctccgcaagacgctcccggcccgcatccgcgccgctccgcagattagcgggcgcatcggcaatgcctgtgacgggggctgctaccccgagtgagggctaggtatttggtcgccgagaatgcttccttgccttgatcagtaactaggggactgggattcgggaatgctggtaggtacgttcttcgcctcctcccgggcttgctttttgtggagaatttccctaatctagtattctagtgataatatgctttaaactgtacatcagtacatgttgtcctaaagttcatattacttcctgcatctagaacaccctattctaaagtgatggatggttcaagtatttccctcttagataatcatgatttgctaccttaagttgtgcgtggcctgtttttatctcagagctaatctcgcacggcaagacctgattgaacgcataggcattagctatttatttcctgcctttcgagtagtaccacactagttcagcttctgaaagaaaagaaaagaagctgcaaataggctgggcactactagctttatcacagaatgtatgaattttctttcttgatgaaaaatgaaagcagtacttgtcctctgtttaaaaaaagttagcattatgccgttttgattatttcatgataaggttaacgttctgtatgtttcaaggagaaattcatgtctcatagtattggtgattcttcttttcagttgctgctcaaagtaataccagaatatgttgtcagtgatattgtgacatgttttttcaaatagtaagacttgagctctactcatcagttcatcaaggaaagatgggactatgaagactactctaagcaggtaaaagtaaggctgtgtttagatccagaggtgaaaagttttggcgtgtcacatcggatatacggacacacatttgaagtattaaacgtagactaataacaaaacaaattacagattatgtctgtaagctgcgagacgatttttttaagcctaattaatcagccattagaaaatgtttactgtagcaccacattatcaaataatggagcaatagacttaaaagatttgtctcgcaatttacacgcaatctgtgtaattagtttttttgtctatatttaatactccatgtatgtgtccaaacattcgatgtgacagggtgaaaagtttttgtgtgggaactaacagggcctaagccaaaattcaaaagctacctagctttgctctgtggcataacctgaccctgtatgcgaaagcatttatatgtcaccttttgctagttgattagttgatcagagcatttttgctgcaaaccatcttctcaagccttcaacagagcctcaacctcctcctgcactatccatagttctgcagtgatttgcatttaatgaaaagatatgtctattcctctcttttgattcattacaagcgtgtggctcagatttgcaatttgcaactgatactacttacataaagccttttatatggacttgtcaattgtaaaaacctattataattcctcagagttcttttcttctgaaccattttgattagtttccagatgcactaaagagggtatttcaggatatttcaccaggtgagctccattgcttccacagagagtagtaatttgacttgaaatgggggatcca

SEQ ID NO: 1554 - DNA, 6014 bp, Oryza sativa
  unsure (1)..(6014): unsure at all n locations
aactctgtttgcaccatgtcaaaagagaactggtcagcttaagttagatgaaacaagaatacagattgtacagactttacaagggttatcacctggtgccatgtatcctacagtgcctggcatactcgttaatgtgatagagttgtcatctccaaacagcaacttggaaattccgaagtcggcaacatgtgcaaccatatcattgtcaagcaaaatattgcttggctttaaatcaaaatgcaggacaacctcaaagtgatggtggtgtagatactccattgccatcgcaacatccagcatgacactgagcctttggatgaaactgaggtgcagcccatcatttgagtacaaccaattatccaaacttccattgggcatatactcaagaactagtgctttgaagtcaagattagagcaagtgctaacaatcctcaccaagttgcggtgatgagccattcgtaacacgcggcactctgtgtcaaagcttttggaagctacttcctgttgcatgtttaggacctttattgtgacaatggactcatcatctagctggcctttgaagactttaccaaagcttccactccctagcaggttatcatcactgaagtttcttgttgcacggacaagttcatggtatgagattaactggtaattcagcaagtctgcatctgagggtagtggcatctttcctggcttattcattttccttcttaccaacatacacaagcaaaatgctaaaataaaaaatgccacaactgcaggtaatatgaattttagtagccgttgtattgaccttgagtgagttttgctctggcatgattctattccttggctcggaaggccacatagtgccttgtttcccatcaatgacttgacagtgatgtttgagaacacacctccttctggtatctgaccctccagtctattgaaagataggttcaaattggcaagataagtgagattggccaaggactttgggatgacacccgaaagcacattggaggaaaggtctaactcctcaatacttagtaacttgccaactgaatctggtattgaaccttggagtagattactggatagattcatatagatcatcatctggagttcaccaaaagaaaatggtatatcacctgatagctggtttcttgatagatccatcttagtaattgctgtcagttttccaacatcagcaggtagagaaccactcaaagagttctgtgataaatcaagctcaataagtttctgaagatgccacaaactaattggtattgttgaagacaacgagttttgggacaataccacaacttgtaactggtttaggctaccgatggtacttggaataggactgacaagttgattgttagcaagattcagcttaactagacttgttaatccagtgatttctactgggatggtgccagacaaggtgttgttggagagattgagttcttggaggttgttcattgatgtgatctgcgtggggatcatcccgcttagctggtttcctctgagagatagcatcagtaggttggtaagcttagccaatgtactggggatgcttccagtgatcctattgttgtctgctacaaaaatttcgatcagtgtgctaaggtttccaacacagggtagtaaactcccttcaaatctattgtatgacatgccaattgtgttcagattactgcaatttgataatgcagctaggaattcaaggttcccactgagctggttcccatcaacatagatgtcacgaagattccacaagttcccaaatgacattggcaccgatccagttaatccgtttacgaacaaatctattgtggtgaggtcagagattgcctatagattcgggaatggtacctgttatttggttgtttgcaaagcttatatacctgaggtttctcagctgtccaaactctggtggtatttctccctctagattgttctcgctaaggtccaaagcaagcagcccagtatgattgctcagttcaactgggatctttccagtgagctcgttggttgacaagtaaattgcagtgaggtttggcattgtcgccagccatgatggcacagaacctgtgaaattatttacagctagggagaacaaatcaaggttttgacatttggaagggcccgatgggataggtccatcgaaccaattttcaccgagagagaaaaattccaacatagggaggtgaaagctctcgtttccaggaatcggacctctgagattgttccgtgtgactgctatggcttgcaggtaggacatattgaagatagcagcaggcatggagcctgagagaagattattttctaggactagcatctccagcttcgacaatgatccaacgctaccaggaattgctcctgttagcctatttgacccgagttgtatcctactcaggttgggtgtgttattgaacaggccttgtggtattggtccgctcaagtcgttatctgacaatcttaatatctgaagattgttaagatttgccaactcttgtggaatccccccaaagaatttgttgctattaagataaagagactcgagccttgtgaggttgccaaggatggaggggatggtacctgacaggctgttgtatgaaagaacaagagtttgcagtcggggcagcctatcgagctcggttggcacaggtccgatgagggtggtgttgctgagtacaaggctggagaggaaggagagattgccaatctgcgggctgatggttccttcaagtgccatgtcttcaaactcaagcccagtgacccacttcccgctgctgtcgcatgagaccccaatccatgagcagaagggtgcactggcagtccaattgctggcaaggatgccattagggtccttgacttgctccttgaagtcgagcagtgcagcgaggtctgtgttgttgtatggaggggtgagtgaagtggcgcatggtgccaataggatgaggagcaccatgctgatgcagagaagagccatggtagtgaaggaatgaaggttgatgatgaggatacacaattacgcatgagcagtgtgctggttctattggtggttttattggaagtgtggccgtgtgggatgtgcaattgacatgtgcattgtgttgaatggtcaaaaagttgttttttttagtggaaatatgtgtgaaaggaagaaagcgttttagactttttcgtttgaaaacaaactttcatttttcagagctggttgtacactgcagtttcttggtacacttcaaagtttcaaaatagaaagaaggaaaaaaatgaattccttccaagaaacaacctcttccagaagtcaaggagcaaagctgtaggagtatgtcatttccgtcattgatagcttcgttttttttctgttctgtttttaataatagattaaaacccggtctctacaccaacatgggtgtacacagccaactttgatgcttcatgcttggcgccagtacttatgtttgtttgattttccaagaataaaacatctggtttaatttttttttcagaaaatcacttaaatagtcgttctacgctagctagatttttttttaaataaaaactgggagataatctaactccaagtatatttttttgaaagcaaactccaagtatattcatatgccatttccatctttgatactatcttggtatgcttggcaccattacttatgccttttcttttcacgaatgaaacatctggtgtgatttttttcaggacaatctttttaaaagtttgttcctggctgttgtttcaggtatcaaagaactgtaaaaatactgaagcgcttctatcctagagatccatttcttattagggcccgtctagttacccaaaattttttttccaaaaacatcacatcgaatctttggacatatgcataaaacattaaatatagattaaaagaaaaactaattgcacaattatgggggaaatcgcgagacgaatcttttaagcctaattagtccgtgattagccataagtgctacagtaacccacatgtgctaatgacggcttaattagtcttaaaagattcgtcttgcggttccgaaatccccttccgacatccggtcaaacgtccgatgtgacatccaaaaattcccttttccccaactaaacacacccttaacccttattcagcagttgactaagagtctaagagaagcaacactttccatgtgtttggtcaatcctgagtagactatgctctgaatcgtgctcaccaacgcaccatttcacaccaaccgccatttcacatgtctattattgaaggcggtcaggttcagcgaagcaagttgatgatagtcgctcttccccatgctagactatccatatccatggagccatcaaacagcgtcatgatcactgataattgatagtagtacattgaatacaagagaagctgtacgtgcacaacttcccttccattaagtatttaattgcttgcttgcattgtttgcttattttctgtacgatggagggtgggctgtgggcatcatgatggaatcgtggacctctcatatattgttgggttaactgaaatttttcagtggtcctttgaaaactagtagaaatattcattgcgttctttggcaggttattggaggattaagccctaaacaactctctaacacgtagtatattactttttgttagatggctgcaaacctgcaactcaactactgttacaggtatcttttcaaggaaggctacagctttcatgatgcagttcagcatttgcaaccaccacagatgacacatggccttgccagctttgggttatcatctgcagggctgcaggacaagactatctaggcttgtaatacctccttgatccgctgcagtttcacagtcacatccttcatcgtcaccctgtcctcaggcaagtctctggtacactgcagccccaaatccagcagctgcgctaagcagctcctgctgccggttgattcaccttgggcatcatcgctgctcaccgtgtcgtcatacagagagatgccaggatgtacgacgtcggcgagccttgacgggagcgctcggttgacccactccctcaagctcagctctccgacgaacatggcgtcggttggcttcttccccgtgaagacctccaggagcatgaccccgtagctgaacacgtcgctctttcgcgatgcttttcctgtcgacccgtactctgtgatgttcatggtaaacaaagatcaagggggatctgcagaaattggcgatttcagtggaaccaaagatgaacggtaaatcgacaagtgattacctggtgccatgtatccgattgttcctggcatgctcctggagaatatggaggtgtcctctcctagcaataaccttgcaattccaaagtctgcgatgcaagccgtcatgtctgcgtcaagcagcacgttgcttggcttcagatcacagtggaggactacctcaaagtgctcatggtgtaggtaagccatagcgagcgccgcatccaacatgatgctcaccctctgcatcaatccaaggcaatgcctgtcactgtacagcaaccattcgtccaggctcccattgggcatgtactgcagcaccaacgccttgaagtccagattcgaacaggtggtgagtatcctcaccaagtttcggtgccgagccatgcgaagtgcacggcactcgacttcaaaactcatggtagctctttccatgtccatgttgaggacttttatcgcgacgatctgctcatcgtctagattgcccttgaagactttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1555 - DNA, 744 bp, Oryza sativa
aatgttcggaatgtctttttcctgttggaagttatcttactatcagtacaaccttgcaaactatgttgttatcttttggaaatataaatgtttgtcactttccagtcttgcagctattgcaaagaatagacctgtttactacgaacgcatactgccagtgctacttggttttgaccctagtttggaggttgcaaaaggagctcatcctgcaagtctgcggtattccctgaaaacagcttttttagggtttctaaggagtccttgccaggcaatgattgaggtgagctcaccttatagttatatgccatctttaccattttctagagttcaaagtatacaaaatgtactcatctatcttcttcttcttcttctttttctttttcttttttttttgcatgttctcctgtttagttttttaatccttgagcttgttttgttagtgttacatgcctacactagtagattctagtgcacggtccttgatttaactgtttaaataatcataccgaaagccattcatttcagtaaaaaaaaaagtaaagttgtccttgtggtttattgtcacgaaaacaaattaacttagctaacttgcaaaaatgtcatgtgaaatgattgtcacttgattaatgattatctaatgataaattttgatgaaattagttagtgacactgataatagatgtaggacgtatagttgtcttaatggctgctttccttacacatgaaggatggctgtgtataata

SEQ ID NO: 1556 - DNA, 1552 bp, Oryza sativa
cgttcctttgaggaatgttaaagtgttcttttatttataggatgaaccttcaacgttggatatgccttacggagatgttagtcggaaatatcctgctgccagatcaagtgatgcttttgctacagctgatggcgtagctaaaagagcaagatttgatacctctgctgctttaaacccaccatttcagggagcatctgattattctaatatgcaggttgacaatgaagcgaatgtggatcattcctctgatccagctctcttgaattgtgatatgtctcctgttgagaagatgattgaaatgattggtgctttacttgctgaaggggaaagaggagctgaatcccttggcattctcatctcaacagtagaagcagatgtcatggctgacattgtaatagaaacaatgaaacatctacctgaaacttcaattctattagctaccagcaacaatggccagcaaaagaaaattcaatcttcctccagtcccctgacagaaaacttgccagcaaactcccactcaatgccctacagtacgcagtttgcacttcctgcagatggagtcagcatgtcaatgtcagatgtgcctgttgtgtctggcgttcatgattctaagcgtgacccaagaagagtatgatatgatctatctttaattcacattttttgcagtcaacagaaagtgcatattgtgaaaactgtcaatgtattgcaggatcctcgtcgccttgatcctcgtcggacagttgcccctgcagccactagttccatacatgtgaagggggaaaccaccggcgtgcatcagacaaataacttgtcaaatgtaccttatcctgtttcagggaaggttgaaaactctttagactattcaggagacctatctaaaaatgaagacgtgcagcaaacatcttgtcaacccaatcaatcactcccaaaggaaaatagtgagattttggatgatgccttggaactggagccgaaatttgaagtgcaggcattagcagatgttggatttcattcttctggtgttgataaagagatggtcaatccattgtctccagaagctacttcaaacaatgaattggatagcgtggaattggaggttgatccattttccccagttttgaaggcatcaacgctggaggatactactaatcatgatttgccagttcttccatctcatctggaattaagtgacgatgagaaaatcttgttgcacaaattagcaattagacggataatcgatgattacaagaaaaacagcgttaacacaagattttccctccttgctcatttgattgcccaggtattcttttggtactgtaatatttatggcctgacatattattacttgtttcttctctgtgacatatatgtttagtgattttaatccccaagctaactttgctagtgttctggaaatacttcaatatgtgctgttctcacaccaggtttctgttattccagagtactgctgatgacaatattatggatttgattcagagacacattatataccattatcatgatcaggtactttactgatagcgtactactt

SEQ ID NO: 1557 - DNA, 2634 bp, Oryza sativa
aaagcaccttacctgcttctaaaaattatgagaacttctttatatcacttgtaagcaagaaaactttattttgatatttgttttgtattttctctgaaggttgaaatttgggtggtattaatatatgttcattctttcgttcttaggcaaggtccttgatacactcgctacctgcttcagacaaatcttttagcaaatttctgtgtgatgcaccatacttgcctgagtctatgcttaaattactggaggatatttgtgtgtcacaaggcaacagccagcaaacaaaggacagtgatggtgatcgtgtcacccaaggccttggaaccgtgtggagtcttatcttagcacggcctccacttcgacaagatagcttagatattgctcttaaggtttgcattttcttttcctttttaactggtagatcttatcataaatcattttgagtgattaatttttttttgacatcttttcacattctaatgtaacgaaaagggtaagacaacttgaattaaacctgcttctgctttttacactagaagcattttggtgatgtgtatatggaaagttacttttgtctgtatgtctgttgcaatccaagattaaacatatttatggctgatatgtttacttatttttgtgaattaaggacaatgttgatatgggtttactatgtgtctatgttcacttatcatgtttcctgtattatgaatttgcagtgtgccattcactctcaagatgaagtcaggggaaaggcagttagattggtctgtaggatcattgcctctatgcttatgttctgttaatttgccatttttttatttagtgctggttttgtaatgctaatccttgtatttttggtaggttacaaaaaaactctatgaactaacatacgcatcagaaagagttgagcagtttgccatcgacagtcttttggcaattgctaataaacatggtgtggagacggacattaatttcacatccttgaaagaatcttcacctgaggtaattcttgatgattttccttgttatgcttggtgctttatcatgcactcagactcaactaggagtgggaactgatgtgccatcctaattgttctatttctgaactcaacagtagcaaatgcaatgtatggttgaggcctacatattttctccttaacgatagtctattctgtttgtatttgttttactgtaaaaaaaaatatggacgtcaggatgggaactgttactgtcccatccaaaatattgtattgtccacacttcaactctagtttgataaatcaacattagtatttttgttgcagtgtatcaaaataagtaaacaccttttcacatttaatgtcaattcatgctcaagcatttgcccaacttactataaatgttctgtgggggttaattatgacacaatcgagtgtagcccccccccccctcgccgccgcacacaccacacacagaaaaaagttagtttagttgacttctaatatctcctcctaatcaaaatttcccctatacttctttcaattttccactgtagtttgactctcaatgatacaagagatcaaatgtcctaattttcttcagatgccattgaaatgtcttaagttttgacatatacactgcattttgattgaacatttgactgatattgaagtttttttttttctgaaagcagtttgaggcaggcagccaggaaacttcggttagtggctcccatatttcagatgctgaaccttctgaaagtacatgcaataagaccgatttggtttcacctaagcaatctgcagtatctgtatctgaggccaaacgccatacttcattgttctttgcactttgcacgaaggtctgtagatgtaaacaatgttagcttgttctgtttattttttctgccggaggtagtaaaaccattttccttcttccagaggcccattcttcttcaacatctgttcaatgtttatggaaggtctccaaaagttgtcaagcaggttctactttcaacttctaaagtcctgaattttgactattggatcacaaccactgtctgctcattacgtcgcaaaatcatgcagtgtatccattggcatatacccaatcttgtaagaaacctgggatcctcatgttctgagatgctggctattattcataacccacctgaaggcagtgaagagcttgttaccttggtattaccatcctttctcttgattcatcattatgcattattgaagcatggatattccttatactcattatcttctcttcttaaagatattgcaaactctgacagaagattcaactccttcagccgaacttgtagcggcagttaaacatctatataaaaccaagctgaaggtttgaagaatttctgcctgctctgtgctctgtgtatcatcatactgcaaattgttttgtttgtcgtcttagtagtattggttatttagtgcttttgctgaatcttgtaattttctctggcaggatgcatctattctcattccgttgttatcctcatttccaaaggaagaggtagtggtctcttgtattttgtttatgcatcttctaactgtctaactgtctagttgcttgttatctgagaaatataaatacttgccttgccatgataatgtttgagaaatagaaata

SEQ ID NO: 1558 - DNA, 728 bp, Oryza sativa
ataatgatgtctggtggtataagaactttttactatccaccacaccaacttcgaaaagattctaggttctgggctttgatgtgcattctaatggcaatcatttctctggtatcgattcaattagaatatttcttatttggaatggctggtggaaaacttatagaacgtgtccgctgtttgtctttccaaagcatcgtccatcaagaagtttcttggtttgatgatccttcccattctaggtttgttactcaaatggatttataagtttcattcttatatctaacactttttttgaatgtcaattcacccttctaaattttacagcggatcacttggagcaaagttgtacattgatgctttgaacatccgacgccttgtgggagataacttagccatactagtgcagtgcattgtaacgcttattgcaggatttactatagcatttgcttctgactggaagctcacattgaccatcatgtgtccgatccctttggtgggtttgcaaaattatgtacaattgaagttcttgaaagggttcagtgaagatgctaaggtgaaaacaaagtccctagtatgaacaaagcaatttctaccatttctgttttttatataaaaaattcacagacaatcctgacactttccacatttgatgaagatgtgtggtttgttagatgacacctaatttggtattacaactgacatatttcatgattggcatcgcataatga

SEQ ID NO: 1559 - DNA, 4302 bp, Oryza sativa
  unsure (1)..(4302): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccattgggccaaagactgtcgacagccacgacgcggccaggcccacgtcgcacgggtggaggaggaagagccggctctgctcctggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggccgacgggagttcttcaccgagttcgactccagcgtccgaggctccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacgaagcagcggcggctcccctttccccagcagatgagcttccgagccaaggagcggctcgagctcgtgcacggggacttgtgtggcccagtgacaccggccacaccaggaggacgacgttacttcctgctgctcgtcgacgacctctcccgctacatgtgggtgacggtcctcggcagcaagggagaggctgcggacgccatcaggcatgcacaggctgctgcagaggcggagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgtcgtcgagcggcgcaaccagacggttgtggggatggctcgggccctcctcaagcagagggggatgccggccatcttctggggggaggcggtggtgacggcaacggcaacctcaacaatggcgtcggatggtcagggacaggggcggatgtggctaggggcagatgcggcggcgtgggaaggcagagaggagtgcaagcggcggcgccggatgcagccgggggtggaggtgatggtgtcggatgtggcggctcaaccgggggagccggatgaggcgggaaggagcgacgctggaatactcgccatgggtgctcccttgaggaaggagagagaaggaagaggagaggttgcgggaagggggagagggcatggggcacaccattggccaactgttgtggctggctagatttggccagttgctagcagggtttggccagcgggatagcttggtcagcccgttagagaggctgttggaggacattttttttcatgtggttgctataatttggtttggagatgctctaacaattgtgggtggggcggagccaaaagaaaccatcttcatgcatagtttttttttatagataatgcggtgtctcttagattaattaagatcagacagcagtacttcctggattggctcagggattatatcacggtagatattacaagtttttagctctgaacattgagctaaaaggtgagccgcggcattagttacacgacatgcatagttaaacgtgtgattatgacacactccgttgtttccaacatgaattttcaacttctgactaatatcggtagattccattccgatggccccttttccgacataatactgatattatcaatatcactacttttttcagatctaccaatctgagtccattttcgattaaaaaatggaaatgaaaatggtaaaaggtttttccgaccgttttcatccctagctaagttgatttgttcttggtaagtctctttatatcttcatttttttcacaatattttgtataagattttaatgggaatttggttttaagtctagcactcattgatttcgtcatgtctattcctctggggctagggccagtgaacccgcggaggaggggggcggggatgttcctatccaacccaccctcgccctgccccattgccacctctagcgttcaagcctaattgtctcacccttgtccctacccttgatgggcaccatagtgtccgttagacttttgatgtacgaaaggtaatcctgctaaattttctctccaaaaaccaaatctaaatagtaagtttatgagacttgcattttatgaaatatttatcatttctcacaaatctatttgcaaaaattatgtgaagttttcattcttgaagcttaaatttagggcatattgtgcgattatttttctgctagtggaaaattgtagaaatacccgttattcatagattatgaggtaattttcactttagataaatgttgaaggactagaagggaatgagtgatagtgttgttattgtttgactagtatgccattggttcatcgtagatgagtgcgcgtgagaagccagtgaagaactgaaggaagtagtgatagattgttagcctggtagttgtgcttgagatgcattctcgcagtcaagtaataaccaatttttgagcttctgccaaagtaccgtagtttggcgcaggcctaagcagagcattgtagagacgtgagatgttatcttgctattccaacagactctccacattccactctctattaaccaatggaccccacctgtcattctcctctttcttcttcctccccttttctcccatcctctgctcgttcttctgcagagctcgtgctagcggcggcggtcgtggcgggcgacgacgcggactgcagcggcggtcgcggcgggcgacggtgtggccgcggacggcggcggggctcgcggacgacggcggaggtcgcggtcagcgacgacacggatggcagcgacggtcgtggcgggtgacggcgcagactgcggtagcttaggccgcggccggcgatggcgcggacggcggcagtggccgcggcgggcgacaacgcggatggcggcggcgggcgtggcggacgacggcgtggacggcgggcaacggcgtggccgtggccggtgacggagcagacggcggcggggctcgcggacgacggcggaggtcgcggtcggcaacgacgcgaatggcgacgacggtcgtggcgggcgatggcgcggactgcggcggcggaggccgcggccggcgacaacgcggacggcggcggcggtcgcggcgggcgacggaggccgcggacggccgtgcggtcgcgtgcaacaacgagagagaatagccggatgttaatgtgcgtagggcccatagttggctagtcattttggctggccaaatttggctagtggagggagggttttggccagccagatggcttagccatccggttggagaggctgttggagggtgtttttttcactggaatggctaaaatttggcttggagagtcatttggagaggctgttggagattctcttacacctaacaaaatctgaagtataggtgataagtggttttccatacaatcttgagaaaattccctctatgcccctaaaactttagtcgatcccttctatgtcgctaaattttcttcgcttccttgtataccccctaactttagattttgatcgcttccatacccttgccatcaattgaccactagttgaccgttaaataggtgtaaaaaagttagttttacacatggatgtgtaaggaatatgtagtgatttgtgaaatctattgttgaaaatataacaatttattgcgtgactattatattcataagtttatttcatgaggaattattatacgtaga

SEQ ID NO: 1560 - DNA, 1480 bp, Oryza sativa
tattatatttttaacaatagatttaaaaaatcattacatatttcttccacatctaagggttaaattgactttttttaacctatttaacggttagggtatggaagggatcaaaatcaaaactcagggggtatacaaggaggtgaataaaaattcaaggacatagaaggaaattcagggacatagaagggatcggctaaagtttcaggagcatagaaggaattttctcgtgctttaatgcataatatttgtgtgcatttttccagcttgtagatgaacaacgctagggtaaaagaaattacatctctttatgtcgtgtcatccaataccctgaaactacgaaaacaaattattgtgcaattttaccttggtgtcttaggccaaacaaaacctaaagtataggcaataagtgatgttccatatatctttgatgcataatattgtgtgcattttcccaccttgtagatgaacaaacctaggggagaaaaaaatacatctctttatgttgtctttgagtgtaggtctaccaacgatgcatagactccaccattgatcctcatgagagagtcatgttgtcccttttcagcgattgaaccatccttgatgactgcaatcacatctgcccctttaatcgtggacagacggtgtgctaccacaatggtggtcctgcttaccataacttgatctagtgcatcttgaacaatgcgctctgattcagcatcaagggcacttgtagcctcatccaatagaagcatctccgggtccttcaagatggcccttgctatagctatccgttgcttttgcccaccagatagttgtgttcctctttctccgacagtagtgttatatccctgaggcaaagcttgatatgaactcatgagcattgcttgccttagcaacagctataatctcttcttcggcaaattgtcctttcctcccgtatgctatgttggcatgaattgtgtcattgaaaagtattggttcttggcttaccaatcccatttgatctcttaaccaactcaattttaagtttttaagttctactctgtctagtgagattgtgccagaatgtgggtcatagaatcgctccagcaaagcaattactgtggactttccactgccgctctctccaacaagtgcaacagtctgcatatgacaattggtttatagcatgtcagtacaagtttaattataaaggaaaataaatatagagaaatttgtattattggtaattttcatttgaaaggcatatttagttctcttgccttgctcaatgaggatgagaagacaaggatcagggcaatccaacatactgtaggaactatcaagtttaaaaaggcaaaccttagtgcataggaactcatatttgtaacaattgagtgcacaccctatattaagagcgtacaagcacatagttgtaggaagcaagatatttcctccaaaaataaagcgctcctagtttgctgcttttttttttgggtgc

SEQ ID NO: 1561 - DNA, 665 bp, Oryza sativa
attatactaaatatcgggtaaagaagtccatgcacaaaagcagttataatagctaatagtagaataggtgcttctggcttgttgagattaaaaagtcgcatgattggtgctttataaatatccatgttgtcaccacattctttatcttcaggttcatctgtagagaccatgcttgtgcaatccatcggatccagatgagccaatatgttttgctaaagagttttatcttctatttctaggagaatcattgatcattgattgttccaaaggcaagacttctacttttaagtcttgaagttgacacctcactatattgtacatcatgcatttcttcagtatgagtctgttgtaactgaataagttgagagtaagctccatcgggatccttgatcaactcatcgtgggaacctgtgggacattcatttttggagaaacaaattgaactacctctgattcacaatgattatttagtacggagaaaataccaagtaatgggtatggaagtatggcttaccttgatcaactatttttcccttggtgaaccactgctatgcagtcggcattcttgattgtactcaaacggtgggccacaatgagtgtagttctccctatcatgaccctatttagtgcctcttgaactagcctctcagactctacatccaatg

SEQ ID NO: 1562 - DNA, 616 bp, Oryza sativa
gcccccccccccccccaaaaccctagctctgggctgcagccccctcccggggaaggcggccgccgcggagagctagggccccccgtatctgtggctggctgggaggtggaagcagcggttgcggcgatggggggctggtctagggttttgatttgggagggaaggccgccgcggaggaggcaggcggccggtggaaccgggcggggcggggcgaggcgcgggcgacgtggggacgggggaagagagagagagagagagagagagacgggacgggagggacaacgaggagagagagagtgcccacaccggtttgcgcgatattatggaggcgggggagtgggatactggcgtgtggggaccctgtggtttagctgggacccacgtgtaagtgtgtggtccgtacactctgttgaattttttttatttataattttttttattaaaagttttacaaaaataattttccattttgaaaattgacggaaggagtcgcctaccgcctctgggaaaaatcgcctctcagagggcggcgaaaatgacgtggcagacgaccgttcgctctcgggcgacggccgtcaacgaatttgcaggcggcccccttgccgcctccgtaggg

SEQ ID NO: 1563 - DNA, 8794 bp, Oryza sativa
attgtagtaccattaggtacttgtagacataagccatctagtatcaactgttcaggccttgcggggtagctaaagcacacatccttgagttcaacattccccttgatatcttctaatattattccagaagttccagtgatgtcaatatttggttttctattgattatttcgaataacctatgagctgcagattggccttctgcaatagcagaaatagagggtgatgcgttacctatagccctgttacaaacaaaagatgcatttagtgtcaaaaaaaaagaagaaaaaaaacctatttttgtagttgaccaaatagtgcagatcatcactacatagttatttgacacatgaagtttgggtccacttgttgagttgaacaagtctcatattatcttatgcttcaaaagtaacactgttgagaaatatggtatttagtataatcataggttaataccataataatcagataattgggtgaaatatcaattgtttcaataacaagaaatctttttaaagtagaactggatacctaggcatggagttgcaaaccctattcctacatatatgatgaaaaattataaagctttacaaaatctatacttgtaacaaaatagttgtgtcatgttatttaatttaatttaatttatttttttagcattattcgtcttgattttggcatatggcaaaggagtattatattgtaatgtggttaattctaactattgtagaagtaggcatcaagtgcctagtatgcctcagtctttttacttgataataacatggtagctgagaaactatatcaaaatgtttagtatatgtactagtgtgctctagcatatcatgttacagagtcaacaattaggaaactcacattgaaccagtcaaaattgcaaatacgacattgatgacttgccctccagtgtagcctttgctaatgactaacttggcaccataccaaaatgcaagagagtaactgcagtaaacaacaaaaaagatagagcctattccaaaaccactgataatcccttccatgatagtggccttgtatgccttttttatgagagtattatacattgtaattgctctcttctcaccattgaaggagacaacctgtttttttaaatgtttttttatgttaaatagttgcaagtaagcattattattgatgtacaaaactaagcattattatttgtcataaattgaaataattagaacataccattcgtatagatccaatggtctgctcaacaacattccccgcatagctatatgatacatgcgtctttccagatatttgagcccgtaatcgagagactaatgcaaaagagaaaatacttggaggtatacaagccatcacaacaagagccagcatccagcctcttatgaatccgatgacaaaaccacctacaaaggctgtcaaaacctgtatatattttcctacctgaacatgagtagtcaaattattagtgttacatcagatctttgcattatgtcatgagcatggaaatctatgtactgaaattggaccccccccccctctttagaaaaacagagtgtcgtactattaataaactagataattaccctgacatgttgctgtgagaaattaagttgcctaatatgtacaaataagttgcagtatgcttttttaaaccaaaacaaaatgacttctaatgttttatataatttgcacgtggttgcaaatatagtgcacggtgagcatattttatgtataattgatactaattattgtgagagaagaaagaagagacaatttgtaccatagatctattatctaaagactacaaataattatgatgatgtggcttcatgagagaagagagaaataacattaactatattttgtggggatgaactatataaatatataacccagtaacactaaaaacacatctttctagttaatgctatttccaaagaaaaaaattctcaatgcatgtgcatcttttcaaatggtgctctaatggaagttttcttctagtttcatttagactagtctagtgtactttttagtcttgttaccttctcaccaagggcatcttggatcagtacggtatctgcagatattctagaagcagcttctccagttgtcatctccacatcaaagaatgcaatgtcttgtgtgataatcgcttcgaggtacaaggatcgaatgcatgccgactgcctttctccagccattgtccaacatgacacctctggaataggtagatggagcactcatgagattctgtcatatgtgaatgtacaacccaactaaacagaaattttgttgcattgttaacatgtccaattgttccagaaaatttgtaaatagaaaattactggtaaatttgctttctaattgtggcaaatgtaattaattaatctgttgtctcatgaagtaatagaccaaaacctcttaatatcattttgctgatctgactatgaagttcaggaatggtaacaagtagtaaaactatgacattaaaatagccaaacattcaacaactttagaaaccatttttatactcttggtgtgtggatcgctatgttactcttgctagtgatcttaaataatttctacggagttgatggtttaagggcatgtacaatggttgataggggtatttttcttttggaagttcaactaaaaacaacttaaaattcaacatataggcatatgcaagagacataaaatatgacaactaatgtcactcgtttgtactttgtgctcataatatagttgtgcatatatatgcccttcctctcttacccttctctcatctacatcgttaagatgtactatgaggcgatatgttaattgtggtgttttacatgcccccaacatatagcttgagattaagcattcttacggagaaaagaagccattgatgttcccactcccaagtagatgtaatacagaacaacctgggtaaaagaaaatgctagagggtaaaagaaaaggaaaaaaatcataatagggaaaacattttgagatattgagtgaaagtaagtcatatagaagcacaaactggaattctatctttttccccgttccaatattaaggttaccatgggaaagtcatttcatgccttaataaatagttagaaaaaattaacctaaattaccatgtcatatttgactttacaaacttgtaaggctaaactcaatatacatatggagaaaaatataaatgtgactaaatttgttgatagaatgcagcattacaagtttgtactttgtagggtgaaatatgaaatcataatctattgtaggctccattcaaaaaaaaaattctattgtagggcaaaatacgaatcataatataaattatcatcccattttcaattcttgataactatttaaatgatgtgtataaaatgaggttatgcgatcctaaagtatgaaacctcacaactaggtcggtggaccaaattaatattgtaaattgatacaagtttgatatgatatatgtctgatttgtagtcattgtgtcatgcaaattattgtggatgttggagtttgttttatatgttaggattagtcatatacctcctaattatttcacatattcagatcatttttttgaaaacaaatatattcaaagcttaatagtattgtcgtttgcaacacaaattaaaatgaaagtggttgaaatcttcaaggcattctcctatccgtgtcacttccaagggtgaccaggccagatggagctcaagcaattgctgccaccacccccacctcccttgcaccacctaagctactcatcagaggtccagacggctgcaagataacaaaggtgggactattttcttctccccctcatgtgcactagagtggtcacggtgaggtgttcgagacgagcggtggtcatggcagtgcctagatccatgcctctgtagctagatatagggtatttccttagtggagactaggaagaactatgtatgtacccaacgattggcatagtttcttttattttattcaatggtcccatttagttgattacatggcccaattacataccatgaaaccttttctttttgctactttagatgtccatattcaggcaaggtggtcggtggctgacggggggcagtggtgaggcaggaggccaatgcacatggtggagcggcggatgcaaggcatgacgatggcgaccgtggtctaggtgtggaggttggtgatggctgtggggcaagcccacccgcatgaaggctggagacaaatgcctttagatcgatgatgaggctggtggctagttgtggagaagaggttgacaagataaagtgcttggatttggccacatagagtcaaatggtggctgcagtttgtcttttgctacctggcttggctctctctttgtatggcaggtctacttctagatatggtagcaaggagtaccatggtgaggggtgtgccagtggcttaggcagcaggggaggagggctgttgcatcttgagaacggtgatggcgagtcatcttgtcccgccatcttgttttttccgatctgatctccccttctttatagagccccccacccccacccctacccaaaacaaaaaaaaattgtggccgatctgcttctagattcagccatatggagctccacggtgagagtgagacaaatgggtcgggtaacaagagcgagaacaattcgcgaggagtcgggtagaggggtgtcgctgcgcattagccatgtgttggcaatggtttgaatggttgtggctggctaggtggatggtgaggccacaacggcaataggaaagcatgtaggctccatgcaaaaaagcctaagctaaaaaaaggacgacgctttgggtgctgcgatcccccttgagagcattgccaagtaatcttcctctccttcactaacatgatcctctatgtgaaaatcatatctaagatttcttgaaaaggctacaatgcttcggtgtcatgatgtctatgggtgaaaatggtacggaaattcccaaccgaaccgatatcgtttccataaaaataaatatcaaaataatgttattttttaccatttctatttctagccatatacaaaatttacttttttaaaaaaaatatgtcagtgttgtattaaagtcgctactaaatagttaaattcataaatctacgaactgatgtcgtttctctaaaaataataaataatgctaccatttccaaacgttttatccctaatggtctccatggaggtaatgctttgggaggtcccattcaatgggatgtgcatacgtggatcaactataaattcataccagtggtttgcttggtgctacgctccttcccgcattgtcggcatgtggtgtagtatcctatttttttatcatgattatagcctccggttctgtagtcttgtattttattctattttgtcagaagaaatttcacgttgtctagtgtggttcatttaaaaaaaataagtaaaactatttttctctcagaataaatgaaattaatttgccaaacacttttttaagataatatttgtcaaacacctacgctaaacatacctaaggagtggcattaaacaagattattaaaaaccacgacaatatgaaacaagcgtgggcccatcacgattgttccatgattccacccacttgccgcgcgtctaggtaactactactactttctccgtttcacaatgtaagtcattgtaacattttccacattcataataatgttaatgaatctaaacatatatatctatctagattcattaacattaatatcaatgtgaaaaatactaaaatgacttacattgtgaaacgaagggagtaccaagcaagcgcggaccactaacgtaatctagtgcaacggattgactccactagagacgcctagatcgtgaccggacatctgaaactgcagttgcatcagggtgaggtaattaaggtgagccaaacgaagcgtagttgattacacctacagtaaattaaacgcgatttagacaacatactccgctacgcgtacgagagcatctcgtccggtggtctcgcgctaatgttccatttagaaaaaaaaaaggtcggaaaagaaactttaatcatttctgtggctatattttattttatttttgaaaaatggaaatcgaaacggtattaaaaatatcagaaaatcaattggaaatcagtacttaatgcaggaatcattgagctacagaatcacatatttgatttaacatggctatatgttgtgatcacggaaattcaaacttgcactatataaattagaatctctcttatatttattaatgtactcaaaatagctatttggttgagaagttaaactataggtcaaacagagacatgtatcacaaatattggatatttagaaatagagtaaaattcataaaactacagatattttgactaaattatcacaagatatagatttaaagtgatgtataacaaaactataaatttaacaataaatttatcacaaaattataagtttaaggctaagtatcaatttaataatagaattatcacaaaactacagatttttggggtttaaatccttaacactaatactatgttgagttataaatgtccgaaatttatgattaaatttatattaaacctgtagttttgtgatacaatactttaaatatgttttaaatatgtagttctgtgataaatttagtgataagtgagtgattttacgatacatcatgttaaatatgaagttttatgataatttagcaaaactacttatagttttgtgaatttattcttagaaatatggtgattactatattataaaactataatttccacttaaatataaaaacagttgataaaacaacagtcgttttcgttccatattttaccgttttcgtttctgtcagttaccattttcaaataatttgaccggtaaaaattatactccacccggtgcctggctgactgccgcccgatcgatcagagttgccacaacaggcaggccgcgggtacgtatatatataggctgtgttgctcggtgtgggtcgggaattaatcccatgcaaaaaataaagtggtagattagcatattattaattaagtattagctaaaagtttttaaaaatagattaagatgattttcaaaacaacttctacatataatttttttaaaaaaatatatatcatttaacagtttagaagcgtaaccgcacgaacgagagagtcgtggttagaaaccaccacaaacaaactcagccacagtacgtgtgacaataccttgctgacccggtggagaacggtactgacgtcgtcgccgccgaagcagtcgatgaccgcggagaagacgacggtcatgagcggctccgacatgccgttcgccatcgccgccaccgtgccgaccgccatcagcgccttgtcgacgccgtcggcgtacctgaacatccccaggaacggcagcttcccggcgtcgccgtcgttgccgctcccttccttcttcttcttctccctctcatcatcctctcctctacctgcagtcgacgccattggcaagagttactgtttctctcagctagctacctagctgctgctcctctgaatctctggttaagtgagaggctactcgatctctgcccgtctccgttttataaatttgtcgggtctcttcgcgcgctctcgtggtgagtggccgacaaagacgcaaccggagcggctgcgtgatggatatcaaaagcgaataaataaatcggcaccatatgccctctccgatccatcggttgcctgtgctgtgaggggatgtttagttcgcgaaaaagaaaattttaggattatagggtgttatatcaaacgtttgtccagatataagaagggattttcagacacgaatgaaaaaattaatttcataactcgtctggaaaccgtgaaacgaatttattaagactaattgatccgtcattagtacatgtgggttattgtagcacttatagctaattatggactaattaggctcaaaaaattcgtctcgcaatttccatgcaaattgtgcaattagtttttttatctatatttaatttctatgaatgtgtccaaagattcgatgggacgattttgagcaaaattctcttggaactaaacaaaggcctgagtttgcctgtgtgctctggccctctttagatttcaacttttttctttaaacttttaacttttccgtcacatcgaatttttctacacacataaactttcaacttttccgtcacatcgttccaatttctttaaattttcaattctgacatggaactaaacacagcctctgagtccctccgcatgcagtgatacactggtacagacgtacagtggaacaagggcctagatacaaccacacaaattggcacccgttatttgcttgtgaattaagcgtttataaaaaaatttaaaaaatagttatattaattggattatataagtatgtaaagaaacatgtcaggcaaaattcgacttttgacttgagggtaaaaatcagaaaatgcatagtacattgtacaacgtaaataaaatttgttattttcttcttaatgtaatagatcaaatttagacatgtatctttgtgtggtgtcttatattatcataatctatcttatcaaagtttataaaaaaatttatataatatttaaaccgcatatatacacctacacctaggtatattgtggaaaaggctatacgtactaactttttcttactaataacactaatgtgtcatattatgagtgcatctagattttttttgtaacttccatctacttaaatcaaacggttgagatgattgtagtaaaagtt

SEQ ID NO: 1564 - DNA, 3684 bp, Oryza sativa
tgtcattataaatatgttgaaatcggagatatgtcactatatatcccttcactgtatttttttatatttttcttggaccaaattatcccttatctgctaccttcatccgctgcactcttcttcctcccacgatcgagcgtggcggcggtggcgctctgcactcctcttccaatgacggtgcggatggcagcggcgcttgagctcggcagcatagaacatgtcggagctcaagcgtagtgacgcggtagtcagcagcgaggccagcgcaacactcatgactatagaggcgagcatgcattattcactcggtactcgtcacggaaagccaagcacccaaaaccccaaatctccaaaacctccccaatcggtggcggcaaccatggacacatcctccgtatggttgtctcccacctccctgtcaagaatgtcacgctctcaactggctagcgcggcatttggcgctctaccctgctcatcctcatggacgccaacctccttctcgccggatgtccgaccctaacaccatggctgcatgtgaggaggctcgctctatcatctatgccgtggatccatgggctagagggattggatacggttgaagagagaagaggagagagggaggaagaagacatggacaatttgattaataaattttataaaataggctaaaagagtaagtagtggtatatctcaaatacacattgaattgtaatggtaatttttaaaactaataaatttataacgatatggatccaattaacccttgtttttatgatggaatatgtataatgttactataatcgactttcctttagttcatgtggaattaagtccaggagatgtttatggtcactcgtacgtaatgccgtaaaatgtagaaaaatatttttttgttgatttgaaaattttaaaatagcgatggccattccgttctttttatattggaacatgtaaaaggttaaaattgactttcctttaatttatgtgcaattaattaagcccaggagatatttagggtgtgaaacaaagtagattatgtgtgttggttatttaaaaaattagactaaattatatacatcgtacattgacttggcatgtgggtggaatttagaacaagaactttagaagtgagtgtgctaatgcacgtataacttggtagataggtgcaatctagtaaaaagaacttaacaaatgagtgtaggagtataacatcttgtaaggtgagtacgattttaatacaataacttaataaatgttgcaacaacgttattatttcaagtatttttttacacgttagtttttaagtacttagtttatcaatatacttgtgtgtatgtctataagcatacataatttttgtcattcaataatgaaaaagtcaattaaattttattgtgtaaaaaaatattgtatttcggttaagatttgagaaggtgaaataaaaaaaatccaaaccgatggtgcaaattggataaatagtgtgattcctatagattaaaacaaggattgtaaggtcctatagattaaatcaagtattgtaaggtaatatccttaatattgctatgtaatggtatattggcatcatgaaaaagtttgtggagcactcaataactaaaacagcatacgtagccaagttgttgcaccaaattctaaatcgtcgttcttgtacacctactggccaagttgttgcaggccagttgttgcacttgaatgtttaattcctaagtttatatactagatcatatccacttatcaacttacactacaagaaatttttctatcaccatgaaaatattgcaacaaaatattatttgtagtaaatgtattattctattaccatgatctaactttcgtgcaattgataaattatattaaaaaaatgtaccattgttgttatagtttattctttgttgcaatatatagtgggctatagccacattgtgacgtggaaaactaacattgcgacatggcaattttattgccataatttttattttcgtggaaattggcgtaatctcttcgtccatgctacattatcgttgcattaataattttgagcacctcacagtatgtaattgttgttggcacaattatagttccttgtattaagtttgttgcaatataaattttcaacatataagttttaagggctttaaattttcatattttctatacatccgccgatagattcttttggtttaaattagtcaaattttcatatgttggattatgttgagagatgtactctcgccataaattttcctgtagtgatagatggtttttcaagtagtggtttttaccgttagtacaatttactcaaaaagtaattatggtatttcatttatcttaattcaatttggttatgtcatctctccatccacaaataatagcatttctacctttttaaattctatacacaaatatataagcattcctatatttttgctgttgtgcttttcattagctgctaacccatatgcacacacccaaaacataattggcctgtaaaatgaggggtattatcataaatagaaacaaagaataactttcgtttgtttttatcttaatctgtattttaaaaaagataggaacgcttatatttgtggatggagagagtaaatagttcaactaaccgatatgatccaattaacaattgcgaattgaatgaaatgtactactggtattttatcagaccgcatgcatgtaaagcgcttggggtcaccatattaatcaactctttcttttccttcgtgtgcatgtgtgcgttatatcatattttcgccaaccttttcatttattttttcgttatctcttcttaattaagtttggtaaagatattctgtagagtgcattgttcgatgattgagacatatatgatcttttgtagttctcgcctcgaagggaaatatgatcgatacctacagatcgtctaattaatgccgccaactacaatggttggtaagagtaggacgtggcctctctattttatttgtcccaacctattttatttgtcccaacaaaagttgtttgtaccaccagtcggagatctataagtagatttcctctgaattaacaatgatgcggtgctgatgcttgcgtgatgttgcattattaattggcagtgtcactgaaaatttcttatgtctatagctggtgattagctagcataggcatcatctcgatctccgaatgacagataatataataaaagatgatcaaggaaatttttctcagctgttgttttcgggtggtcgattggtacatgtatggtaatggttgctttgcggtcaagatgaatagatatctgtcaaaagtaactttgattgcacgctgattcccttttggtgtttcatcttctctgcctagctcgcgttgttgtcgatcgatcgggttggttgttcttgcaacgtaaaggttactacgtgaccaaaaactgactcatatcaaacagacaacgaccaaggttgtgaaaggaactctgctatctaggccaggacagcagcgattaattattccgactcgagttcagacttcagacttaagctcaactgaagtctaaagttttgttaggtgaggcgagaacatcagctgttccatcaggcatgggttgctgtactgccgacctcggctagtcgatcaggtgagacacacgcatggtcccttcgcccgtgcatctaccgtacc

SEQ ID NO: 1565 - DNA, 13555 bp, Oryza sativa
ttttacgaaaagtttttgggaactaaacatggccttagcatgcatgttttagccaagtactctctccgtcccaaaatacaagagattttggttggatgggactttttggacagagggagtaattcattttcatttcttagacaaatctctccatctcaattagttggcacctttcacttggctgtaaggtgattgccatagtgccatcaaagatcaagatatgccaatcaattagagcaatgctaccgtactaaatttttcttactaaacttttactaacaatcatctcaaccatttgatttaagaaaaagttaggacgtatagccttttccaatcagttatatggtcatgtccacctcccttgttgtcgtctccgactggcagtttgttctaccactcatttttctagcatgtagtagtagctggagccggaatgtcagttccttgcgcttacaacttgtcattgaaattgtaagtttgcctattgccatgttagtattcacttgcatggcagcatatgtatgtcacatgcatgatgtcatcatggcatcatctcactgaaataaattgttgacgatgattgtctcctaagtctgcattcttttcttcaattctaaactataacttccttctttttcattaacacatttttcaaattgctgaattatactttttttcaaaaaagaactttatatatatatatatatatatatatatatatctttaaaaatcaaataaacatattttttaaattgtaataactaatactcaattatttatgtgctaataatttatctcactttgcgtgctaatgaaaagctaaattaagttggagattcaaacgtaccctaagtcctaacaaagttcatttggtatgcacgttaacgttcgatttgcataggttatattgatcttaatttggaattattccctatagatctttagaaaaaaaggtcttaatggcaaatcaaatattgtcgtgaaatgtagtgcatgttaggaccaaagtataatgagactatttactgttggtattgctgtagaagttatgggttagctctaggggtgaaaacagtatggaaacttccggctaccgtttccagtttgcaccaaccgttttagtcggtttcagtaaccgacggtggcggaaatggaaacggtaatatcttctggaaatggtagcggaaatgggacgggctttttccgaccgttttatcggtaaccatatttgtatggtaatttccgttaaaattccgaaaagaatccgaaagttccccagcggctcagccagcccaacccatcggaagcctatgaatgaagaaagcttggtaggcttgcagcctataaaaaagtggaagtgactagggaaaatattgttaaccctatgacgttgcatgtggattttgctgaactttggtcttctcaacttatcgatgttgaagcattgttgaactttgtttatattgtttgtcaaacttattatcatatcattaattatcatataacggtgttatgtggagtgtgatgatgcaagaataaagttaaaaaatatctacgtgcatagttaaatgtgtgctatgccacactccgctaatttcgacatgaatttttgactttcgagtttcgaccaatatcggtatattccgttccgatgatcccgtttccgatataccaatattaccgatatcgttaccatttccgggtctaccgttccgatttcgttttcaagaaaaaaaaagaaaatgaaaacggtatagggtttttccaaccgttttcatccctagttagctccatggtttgtagacttgtagttgtatgtctaagagaatggtttccaaattttctagtttatccactcaccgaaaagaaaaaaaatatggtgtatcgtgagacctgagataccaatatatcagacatatttagcgagcttcttataatcaaaaccttcatccagatcttgagaaatatatttacagaatttttttaaaaaagaaactaagagttattttttagcttctccaaattctcgtaaactggttatcaattagtagttgctactccgaacaacacccaatcaggaccgtaatgtctcacgtaccaacactccatgttctccgccaacgcttcatgaaggcgtactttgactttacgtgacccgtccccggccgccatctgcccatctcctcatgcggccatcgccggcgctcgccggcggcggcaggacggtcgcaaatcttctctccgccacggagtggatgcttccttctccggccacccaagtccacaccatctccgtcctcccctcccactcaccgccgtcccctcctcaccacttcgcgttctccaacctcaccaccgcgcctaagcgcaacggaggcaagggggaagaggagggccgcccaaggttcgaggtggtgcgcgacgatctcctccacccgctcgccaatggcaacaaggcccgcaagctcgacgccctcctgccgctcctgcgccgccgcggcgctactgacgttgtccgtgctcaccgttgcattccccttcacccagccttgatcacatcttgtttttcaaatctgatggtatcttcactgttctggacttcggattgcaggtgacttgtgggggttgccagagcgcccatgctgcggccactggtgagatatggattacccattttgtttttcttcattccacttgaatctgtgtgtaatttccagttcattctttacatgagctatgaccttataagccttggtaaacgatcccaatgcatccctgcaaaattgctctctaggtcatgcagatttgtcccttgattagcgcgctgatatagtgaatgtgctgcttttctttcttgaattcggttgagtccaacgaaaatgttgctttgctcatagcattcactttttttttttcatttactgcattagcggtccactgtgctgagtggggaatgaggccacacatattgctgagaggtgaacagccagatatcccgacaggctacaatcttatctctttgatgtttggcaatgtggcttatgcctctcggtcagtgtacgcacacagagatgaaatgctttacaatcacgccagaaaagttgcaggcacaggtggtacagtgttgtgggctgatgatattagcaaagaggattttgttttagatgaagataatggttgtgaaattggttcgagaagagtagttattattaaggaaggggctggtgacgtccaagcattgctaggtaagtaatggactgtttttgccctgaactcctgattttagttccgttcatcagtaaaaataaattttcgacaacagaataatctaatacccataacttagaatgcatgtgtccttgtattgctatatttgcttataggttgaaaattttcactttgagtattaggatcagggcagtcaattttgctttcacagtatgttgttttcttattcacttgttaatctgaaacctttaacttgggccccaaagaaaagggaatcttgcatatttcacatggctttgttgtaccttcaggtgttattcggctagtggagtacctttacaatctgtcgtcatttcataaacatgagaatgttcatgtcgtggtagatgctgggacaggcacaacagctgtggggttagctcttggagcggtatgtctagggtgcgtttgttaatactacttgcatattatgctgccagaataaattgagagttatcattacagcttttgtacactttgaacttttgagagtttctaatggtattacaggtatcatgattttccatttcttttatataaaggctttgttgttggagatacttttggaatatctaaagcacaacaatgagaacagttcttgcacttgatctatcaaagaaaaattgggataaattaatgtctctgatgacaaatgtggtgcattttaacttggtcaagcaatactaattaaaaatcgtgtcaatcaaaatgttcatcacctagtatttccatgtctatgttgttgctttctccatccatctttgctagagatcacagtttttctcacgatccttgcagattgcattggagagtaactgctgtcatgcttgctgacacactcgaaagatataaagaacgagagaagtccttaatatctgactttaagaagctttgccataacaactaccatgaaatggtgggagaaaatgatattggtgacagtttagttgaatgggtggaacgattttcaccaagacggtatgcttcaatcaattaatttaatatgctgcattttactgagcattcattttattcaatacatgctgctttctcaagtgtttctgcaatacaatgttgtcttgggtcattttcaaggcatgtcactataaattacagaacattctggacgtattcatgattttgtaatttgagggtgttcatttactaagtactagtttccttattagtatctagtaattttcttggtaatattatagtcggcggttgaagtggacttgatgttctgattattatttgttttggtgaataattatgtccttctcatgcctttagttcttgctattagaatctttagaatttgcgttcgaatactgatttttcttggggcctttttttttttgttcagatttggcaaggtgctgaacggtgaaattgcattatgccgccagattgcgcagcaaactggtatcctgttggatccaatgtacaccttagctggttgggagcaagctgtggatctatgtgttggagacagtagaaccaaagtggtgatgatccatacgggaggaacgcttggcttctgcggattggcgcagcggtactcatcgcacttcacctcggatgagcaaacttaggccctgtttcttttagcttaggattattataatccagattattaggagtaagctaaaagatagcttattataatctgataagctcatttaggtgagctttttctagattattgggtgaaaaattacccatcatgccaccccactccctctttagacttgcaaacccaataatctaggctctaataatctaggaaagaaacaactaaccacttattctactacagattataacaatctagattatagtaatctgactcaataatctagattataataatcccaagctaaaagaaacagggccttaaccaggccaaccttactgcaagagtgcaattgcatttttacctctatttatcctccttttttaagtccttttgccacttcccagggctagagaggtactacttttgtatacgagtcagaattgcttgaatagtcagaactctgaaactctgaattgaattgcctaagccacactccagaacagacaatttcatcctgctgatctattgtgattacccatcaaattcatggtctttggctgaatctgcttcccattttcatctgaagattgaaacatacgcacgctgaaacgccgtaactctgatggtagtgcagtgcaggtatagttctgaagtctgaaatccttgcggtccttcaccgcctctggatcccgcgcagggaaagtagtggtggagacgcgggcgatttttcccgccggggtcgagacagacagtcctttcaggcggggacagaccacgtcgccgtctgatcgcgaggcgtcgagaacgacgacgccgccaacgacgtcgtcgacgaccccacgagagcgcggccgccggtgtcgctcgctccagtccacccacgcacgcacgcacggcacgttggcgcgcgcacggcgtgacgaatcggagaaaccgcagcaaatttctcgacgcaacgcgacacgacgtatacgtcacgacccccaccgcgcgagatcgattgggccgcgcgcgcgcgcgccacgcacgcacaccggacgcaacgcaacggaagccgcctgccccgtctcgtcgtcgccatcgggacggctgggccgcacgctgctcctcggtccttcgccgctcgtctgctctgcctgccgcacgcggacgcgggtcggcgcggcggagtgggggtctggggtctatggccgccgcgggtgcgggggcgagcggaccggcggcggagacagcggccgcgacgttccggcgggtgtacggcacactcaaggcagagcttctcaaggacccctccttcgacttcaacgacgacgccatccaatggctcgagagcgtcagtgcaactcgtaactcctcaagtttttttttctttttttttggggggcactgtccttaattagataaactacaatacatgaaatatttgatgttttttgtctctttagctttggtacgatctgcaagttgcaacttcttcattgtttttttttttgggtattaaatgcaatttgtcaatgtttagctgaaaaaaaaaatcactgaaccttatctctgaacagatgctggactacaacgtgcttggtggtgagaaaaacatgctattcagaaacaatgcgaccaaaccaaacaatggcacattgcgatatggttggcaagtgatttagtcatttaagatctctgctcttgtacaggaaaattgaaccgtggcttggctgttgttgagagctacaaaatactgaaagctgctagcgcaacagaaccgagcgaggaggaattgtttcttgcatgcatccttggttggggcatcgaatgggtacatgatacttgtatgatttagtgacctgggattatgaaacaacaatattagcaaaatattttctaaacttttttgttctttgagtaacctgcagcttcaggcctattttctggttcttgatgatataatggataactcacaaactcgacgaggaaaaccctgttggtttaggcttcccaaggtttgtcaagtaggattaacttgtccacatagaaatgtccttgtgttactgtagattctcgagtgttgttaaaatgttatgattgtactccaactaaacaaaggaaaaggtaaaaataataacggatgataatattgttctcagatgctactgttggctaaatagcaaggggcagctccacactagggataggtttgatcatggtattagcttgattatctagtaactagcataagatgcaaggaatgatatagatatgtagattaatgctgtttacaatttgagtcctttccttgtcttggttaaatggtgatttagctcatattttctaccttgagcaggtcggcctcatagctataaatgatggactcgtccttcgcagccaaatttcaaggatctttaggcgctattttcgtggaaaaagttactatgttgatctcctagatttattcaatgaggtagttttacattcttaggatttctcttatttgagaaccaatttcattactgaagcataattttgttgcttcctccctaggttgaaattcagacaacttcaggccagttattagatcaaattacaacaaatgaaggaaggaaagatctgaacaagtataatgtacatgtgtatgccactgaattacgaatttctccatggtgtcatactgacatactgcttgcttagtgccctagaaggcagttgtttgtcagtttcatttttactcttcttgcttgataataatcatttttgaattttatgcagatataggcgcattgtggaatataagacagcttactattcattttatttgccggtaaaaatgaatgactcccatataatattttgaaacttttatagcatcaattcaggctgttgctcgtcgatttcttcaaactgagaaaatgtttccgcttttgctgccccttggggaaatgttttatacttttcatgaatacttacactgttccaatatgtggctaatcaaagtaaacttagaaatctaattcaaatgatcagctttcgctgtaccatgactcatgactcatgagcatggttcctcacaaacaggggtacatatagctcagaatgaaacttgatagtcctagaaacaacttcttgtaattcatcttgtggaaaaatgcttgtgcacatgtcgtagtgaggttgagttttgtggttgtttttgtttggtattcacaagcaaaactttttcaaccttacaaggttgcatgcgcactgctgttgtttgatgagagtttggacaattatgctcaagtgaagcatatcctagttgagatgggtgtttactttcaaagccaggtaagatcatcttgatgtttcgttctcttttccacttgaatgcttctcttcttggtttttctgttttcattcatatcagtatcgctagtaaggttttctttccaggatgattatctggactgttttggtgaaccagaaattattggcaaggtaagtacactcctgcagtactatcacaagtttcatagtacactatcaaatgttctttggacttgatccccaagcaatcttaccacagataggaagtgacattgaagatttcaagtgttcttggctatttgttcaagcacttgagcgcgctgatgagaaacaaaaaggagtcttgtttgtaaggcccccgcgcagtactaaactgtatctttgcatagttaagcatgacgtcttattctgtgaatggcatgattgcaggaaaattatgggaaatcagatccagcttgtgttgccaaagtgaaggatctatataacgaacttcatctccaggtgttcccccattatttttgttttcttttaaaatattttttatacataaaatggttttttgttttccattttgtcgttcaatgttgaaaaatatgtcttttttttcttaagatggtataatccagccaagtttcagccttcaatccttgattttgaatgttcgactttttacaaaaagatgcaatgaagccttgatattatatgcaaccgagacgcttacccaaaaaatgctgtgatctgtatctgtttactcatttctttctgcagttgccgcgtgctttcctgccatgacaaattcatttatcatacctgatttttttttaaatctttcagcgggtgttttctgagtatgaaagggagagctatgaaaagctgatctcagccatcgaagcacaaccgaatgaagcagtacgagcggttctgaaatcttttctgcacaagatctacaagaggagcaagtagaacacggctgaaaaataaggccaattttggcatctcgtggattattctggttcttggcttcttgttgggatgtatagcataggtgtgataggtttctaacttctgggactttgcaacgaggaacgtgcctgataaataagaaaaatagtttctcattatatgttccatggatcatatggctagcaggatatttcgtattgcacaacatgaccagtgtgctgaacagcttggcgattacagaaaaaaatttgagaatatattttctttttaaatatttgcatttatatacatgcataggaataatttgtaaaaatatacctcttccgcacagtgttaacgcgggatcgctatgtaatcacagcatcaatacgcggtcagatcgttcagcgcggcacggcttcgatcccgcgggacggatgcgcggaaccgcggtcccgcggaaccatagtgcggcaccgacgagcggtaccgcagaaccatcccgcggcaccggcgcagaccagcgctcccgcatgccagtggtgcggcaccaattacttaattaacctaattaatcacactggccttaatcaaagcaaatcaaagcaaataatatatatagctaagcagctgcgcaagctagcttcctctgctaagcagccggtgccgcgccatggttacgcgggaccgcgttctccaccacgctcccgcgtgacagggcagcgcgatcgaccctattccgcgcttccgacctgcggaaccgaagctatgtcgcgtgtttgtaacggtcccacgttcccatcatgcgggagaggtatatttttacaaatcattcccatgcatatatataaacataaaatattaaataaaaaggtatattttcaatttttattcggcgattacatctattccctgcttgcataagttgcataatactatgagattaaacttgtaacagataaattgctgggatgtttttctcttgcggaaaaatggaataacaaaaaatattttctttgtactttattaaatttgttaatgtgtatatgatcatttatcaagatattgttacagctttcctatcctgtaattagtaaataccatcgggagaagggttgagcattcttcattcttcgtcacaagatacctgatctgatcctgcctcattctgtcgttggatattgcaatgtagccgagctgacaagctccaaaactgatgctctgtacatcaaacctcttctgtcccagtggtctatgcacaaatctgaacactatcaataataatacactatggtactccggtcgctccgcagattcagctgcagatgctactgaacctaatgatgctgatggactataaactatggccggccatgataaactaaaaatgagaactcgtgtgatcaaaattttgtagtaatagttaagccagtagagcagattttagtggaccgaccgtcccagcctctaatagatgcatggctgcactgtaggagaacttcctggcaaataggaaacatggaacggatgtagtattgcattggcaccactcagttctgtgctccatctgataattcacatgatcaataccctgtaaaatgcagcaaactttaagtgagaatcaattaacagaataacgtgccatagaaggtagaggtcctgcactacaggatgcggtgtctgactttattcttaggaatagaatttaacatcaggtagtatagacagggaaaccagtcaacataaacatggaaacacattccttgtaacaaaggttggagttcgcaactaaaaggacctgtgctatgcagatacatgtttctgagtagattagttctttattcaggacaaaacaaggagaattgattacactatctaaattgaatttcctacgagatggacaggttgtgaggcaaacaagtgagatagaacactagagcttttttatcattcacaagccaactgaaaaagaaaaaaaaagatgacaaaacaaaatccacagatattaccttaattgaattgatttgctcaggacttgctgactcatactcaaatgtcattggatgccaagtcattttgtctttaggatctgaggactggttccatgatgtatatgtcaaagttcttctttccagttcattttcatgtccattgatctacaaagttaaaagaatgggaaacattatgaattgttgtgaagaacatacgattatgtcctgcagtctgcaaatcaatatcaacaataacaagccttactgaaaataatgtctgcacatagtgttcatctggaatgcaatcatgctccattcgagtagatcctttctgcaaggtttagcatggatatcatgtctcagtgaagagctcaattgcaagaaacttttgtgatgtgagcaacagcttgaaattgacggtagcatttcatatgcaaacatatgaacaagtttgacaatctgaacttccatttgtcaaataaatatatgaaagttccatctgaatgcgtgcttgacatcttgagaatagataaaagagaatgtgaccggttgaaactttaccgatatctgctttcgacgaagtccaaatcctaatcttcgctgcaagagaagcataatacttaataagtgcaacaatcgtaggtattgataaatataattaattcagggaacaacagtactattgggtacataatgaaacattccttagaagggtgtaaaaatgagataaatcatttgattttggtgatcaagagaaaacaaaaaagactattcgtattcacatcatataaaactacatgtcagacagcagaataaaaactcgctttagttatcattgagcgaaggatagtattacatatgaaaagttgtttatacctacggtaaagaaatggtgtcacttaagaattggaagacaaagtcaatgattgttattatacatgatattagccaatgtatgttaaaatgatcctctcttcaaactagactgaaaaggaatccaaattaaactaaacacttacataattaggcttctgtccaagcaaagccttagttactaccatctgcaacaatcaggtcaaattcaatagaatcgttagtgctacatatagaagaatatgtaggattaatggaccaaaataaatacgaacagttgtcttaattcagcataagaacaatttaactccattcatttttttttcagttttacacaacttttagaagttggattaatctaatgagaacataatcagttcgcattgtgcataaggacaattctacaaggaacaaacaattggctaagataaatatatatattcttatcatgcagtaattatgtagctggatgatataggctatcagaaaaagtattgctgataaaatgtaaatgtatagcacaaaacccccattctgaacatatatagatttttttttttgactgaactgaacatatatagatttgatggaacttttctcagacaattatgctgcaacttggttggcatttttttcccctaaaaaatagcatatatatacagacaaagcattgccatcgaggcagcagagcactaggatactatcgttcttaattgattagatagtatcatttgattatttaacactgtaaggcatcaaatatctacaaacaagggaacagaaaactagtctcacattcacatcccatataagcaagccacatacctactaacatgtttgctaaacaagttgaagttcaagtcacaaaggttctaacatttacagcagaaatttgagggaaattgaaaaggatacttggaacagactagtaacctggttaataactaattttcttgaaatgggttaacatgtgaaggattgaaaaggactaaatcaagctaagcaagtactccaatgtcgaaaagaataaactcaaaaggcaatataccttgcaatgccttctgaatacttgcaagacaagtttgtcgccaacgactacttctgcatgtcttctggtcaatgctacccactgaaatgagaggatagatggttcagtgtaaaactctgaataaaaatgaaatactgattacaagaacaagaatggcaagaaattacagaaacctgtgatcctttcctccatttgtcctttaggataacaggagacatgcttggattgtaacgcttctcggtcttgtcaacaaaactggaaaatatcaacatactaattttgagaaataaaaattgaaatatggcatgtagcctataggaacaaacatgaacttgcaagatttcagatgatctttttactcttacctgtctacaaaacttttagtcgaagccatcaagtaagtatatatgtagctgaaattgtacagaggaacacagctgcagtagaaaaggatattttgaaatgttaatgttgaaaacgtctataagatgataaacattggtacataaaaaaaatgaaattcaaactacaacataaagacttaaagcatactgacta

SEQ ID NO: 1566 - DNA, 13340 bp, Oryza sativa
cattacttatgagaccaagcaaaagcgagagagcttctcaagaaaccttagcagcaccacaacaggaaaccacaatctaaatgcatcactaagaagaatgccctctatagagtcctgcaaagtacaaactggttccgtacgagttcacttgccgatttgccattactaaaccttcagctattaaaccaatcacgagtctgacagccacagaccacagttgaacatttaatcatggtccactccccataaaatttgaactatgtacgagcaagaacagggcactcgcatgtgggggaatgtaccgtacctatcagagagcaaaacaaagcgctggttcgctggatcctcgagggcggcggcgaacaacatcctctctgcctccaccatggtaggttcgccccacgccacctgcaaggcacaaccatattcctcgctactcaaatcgtacccaggtctcatgtcgatacacgccatcacatcagaagcaagagatcacgcaaaagaaatggccgaacctttacgctcctggcgagctgccgcccgtagaagtacgacgatcccgtggtggtgcggtcaagctggaagccaggcgccgagtggacgtacaccgagaacttgccctcctcgccgttctgccgaacacccggtcgatcagaaccaatcgaatagtcaaacagggacgaacaaatgaacgaactaaacgaaaatcagcggaggtggatgattggggctcacgcggaagaaggcgtcccagaggaagtcgagggggacgcccgcgcggacgaggaagaggaaggcgaccctagcggggcccccggagggcggcggcgcggaaggcggcgccgggaggggctgggtgcggagcagcgcggcgaggaggagcaggaacgagagcggcgcggccaggcggaggcagaggcgggcccgcgcggcgcggcgtccggccaccgtgagggccagcaccgaccccgccgacgccgacctcttcgccgccggcatcgtcggcgtcttgcgcgggcgcggcgtgcggtggaccagcccacaccgtgggcctcggtggcatttaaaagcgagcgcgaggagagagagagagagagagagagagagagagagagaggggagatctccttgtgatcgccgcggcggcggagaaacggagacgtgggggggcggtggtggtggtggtgttgtgttttcccgtagcttttggtgcgatttttgggcctcgtgacgcgcgcggcgtctgcgtcgtgcgcgggtgggtgcgggggccggtcgcacagaggcgaggcgaggcgcggcacgggcgtgcaaagtggctggccagtcgtggctcgggccggtgggggattcgcgatttcgcggcgtggtggacaggtgggacaggcgggatcagcgtcagttatgacggaacttccgttaagggcaaggtgttactgcctctaggctaaaatacagagtactccctctccctctgttaaaaaaatacctagtgctaaatgtaataaatccttataccataaatttagatatatctttatccagatttcacttcagttctaaatttgtttttttttggacggagggagtattaagtactacctttgttttgctatatagctacctaatactgtaatacatatccaatactatgaatttagacaagttacaatatggctcatatagtactatggataagctatagtgattgatagtatcagatgatatctcatatattgtattaggtacctccattttaagacgggtggtagttttggctcctttcaactgagtaaatttagtggaattttgtattaagtagtacttaagaaattaactatattctatgattctttttgtaaaattttctgtgtcctaatggaaccttttagtttcaccgatgaccatcgaaaattatcattggttttgagcatgataatgtggagctttgccacttgttttctttcttgatgtcattattttttgtgtatgtgtgcagcccttgggtcacttttataccacacagaaccaatgttggcgtttaccttcaagaccacactgtccattcgacgctaaaaatcaatggcatgtggacggttggaacggcatcatctgccatcgtaagaaaagaagaatatatatcaccacagtccctctcgaatctttggtttacaaatcaaaagagaagacaaacgttgcagggaggaacaaatccaaggacggtgcaagttcgtttaccaagttcgtcgtttaccgcggtgagaactgtgcatccccacgccagcagtagccagtaggacctctggagtctgcacctgagataaaagcagctgattatttttttttctaaagaaaaagggagctgattagcattctctaaaactccggaagcccgcctgtctagcattctctaaaaagagaaaatgcaggaatgcggcgatggttgtagaggagaagatgcagcaatgcacatggcgccatcacgcgcgtacagcggtacaggcaaggcagacaggcaggtaggggcagccttgtagaggaagagagtctgtgtcttggccaaactctgaagactgaagtcatcgtccatgccacccgtgttgccctgccggttgccgctacttcctttcagctacctgcctctcgtctctctccgccacgtccacgccctttgcgcattgcgcgtgggggatctggacccgttcctggttgactacttggctcgtgagaaacggatgtggcgtcgttggctcgttttgcggtttcggcttccctcccggtccctgtagaaactaacgcgggaagctgcgagcctgcgacgggagatgcatgaagtgcgaggacttcacgccgctagttattccggcttgctgttctgcaattgcccacggataacgcttttgctttaaggaactgaactttccagctctacaacaagtcgaaaacaatgggggccgaactttggtttttgtttatatccaaacaacatcaaaagtttcacaccgagtacacctgaattttctttatgcaactgaactttccagctcaagaagtcgaaaacaacgcgggctgaactctggttatttttgttttttgtcccaacaacatcaaaagctccacaagaagtacaccgaattcgaaattaaataacttgacaacaaaaatgtaatatgatggacacacggcatgaaaccaatttatttgcgagtcccccccacgctgcgcatcttgattcatcacttggtcgcgatgaacagcccccacctctgctcaccagcagaactcctttgaagttttgccttccatccattcacaatggcgtcgtagtcctcctgaaaataagtgaaacaaagaatttgatgtgcataccagcaacatggaaagaaggcagctactaaactcgcagttttgcctaaattacctggctgaaatcagagacgaactcgtttttgttcttttcaactttagcaagctccctctctagaacatcgaggaactgcaatacaagattgaatatgatcagtaccacagaaaatcatatctacatttcagttgaagagaatatgggaatgcagccagtgtagctccagagggggattacctgatcggtgcggtcttcagcaatgacatcatggaaaccagcattctcaagcatctggataatttaccaaacagatgttaccatagctctacactttcatgaaagaaacagtactattaatcatatagagtgtagctagcaaaagcacctgtccgtaagccctgacgtcgtgaaggtcataacccctttgcttaatgtaagctgcgaactcttctgaaggtttcccagggcacttgcagtaatcactaattaggaccttacccccaggtttgagccacttgaagaaacttttaaatagtgagggtttatcctgcaaagagcaaaaacagcactggtcaaaacacagttgttctggcatcaaagaaagggtaaaacatatttagtggcaggtaattcaaatagttccaagaatttatttttcccacaatcccactaacaattactacaaatgtatatacaggttctcagggcttgcctaaaacagtccatttcaagctgaaaatatttaaactgttgtaggctgtagagcaataaaccaggaagaaacaaaacatccaaatgggttgtaaataatgtgtaaaacgtacttgtatgtgaaggatagtatcacgactgtagatgacgtcaaacgtgttgtctgggtatgtctttttggtgcaatcagcgacttcaaactcaactgagcacttacgcccaatagcacgctcaagtgcaaaagaaaccatgtttatcgaaagatcaataccaacaacatgaacatcatacttgtcagccatataaaaatcaccgcccccaattccacatccaacatcaagaacgttctggccaggtttgagatccagcctgtccacaaattcttttgtagtttctggtgaacgaagataaaagaataggcatactacaaattagaacaaattagaatattactgatttaaaaatgacaaaaaatacatgcatttactaaccaattccaccagtgctcacaaagccttctccaaagatgcgttcatagcgtaatattccactggctttgtactgcacattgtccaaaaatctttgaaacccccgatcttctgttgaatcaaccttttgccatagccaacatatctgcatagtatggcatcaagtccatcagttcacttgatcacaggacatgagtgtgtatgtggatgtgcaaggacaaagaagtacctggttttgatttttcttgcttttcacgtaagctccaacacacttgcaagtaagtacagagagttcaaaggaattcccatcttgatcaagagcttgacactctttaaacacctatttttaaatcaatctgttagccttcaatcatcacaacttgttacaaagtagcgcaaataacattgctcagtgctgctataagcatactgtgtgtatagtttagattcagtaaagtgggtaacatttaacgaggcaagtctagtagaaaaccttgaactgtcaagcttgagattcaaatgatagaagggaaccagaaacaagatagttagcatactgaccttagtgtaaaaccttggctcccggtaatgtgtaggattcactttcctttttgaatctccagactgatggaaacaagattccctaaagaagatatagccgccaacctttagccatcttaccattctctttactagcttctcaacctacagtaacagtatgagttagcaaactcagaagacatagccaagacataccaagtttcaacacaaagtcgatttatatcatccagggttcatttcccaagacatattcagatgtgcaaagaaggatcgcaacagatcttaaatatgcttatttatttgaaatgagacacgatatgaggcctattaagtactatctgctcattacctcctcgtctgaaagatacatcagtaaccagtttgaaaatatcagatcaatggagttatcctcaatcatcaggtctggacatgtgacatccgcacacataaaggatgcattcttgtggtgaccgtttatgctttcattctacaagaaacgacacacaagactaaatgaatcaggcataacattcatgtagagataaaagaagccaatcatagttcagcgaagccaatcatagttcagctaccaaactggttttaaggttttaaatgagatgtgaatgttaaaccttcttaatcacactttcaatgaaatccattgcaagaacatgcccagctgttttcactagttctccagtgaagcgacctattccagcaccaagttccagtactgattttccttcgtaaggaggaagtaaagacaatatctgcagaagtgtcagaagagatacgttagaacataagtccaggaaaacattttccagcatccaaaaaacatgtctaatcaatgtgactatgctaattttaaaaaggttaataattactgtgacaattgagtgagagggaacaatctcattcacctgctaatggtagtattattgacagttacagtaacacattctcgtgcgagtacagtccccaaaaattcttaagtgggtatttttcttgtgaaaagagttttacttcgtacagtcagcaaacaggtctgtgatcattaaagtaaaaggtctagcatcatcttctagtctggaaaaaggaaacagcaaaacagaatttttcctttaagtaaaacagtgacaacaattcagctgtctacctaagaaacaccttatgtaatatggaccctatgtgatgctactatgtcaaggtctgctgtcatgtcaagtgttcactccattttgctaaggccttgtttagttcccaaaacaaaaacttttcacgcatcacatcgaatgtttgaacacatacatgaagtattaaatatggacaaataaaaccaattacataatttgcgtgtaaattgcgagaaaaatcttttaaacctaattgcgccatgatttgaccatgtggagctacagtaaacatttgctaatgacgaattaattaggcttaataaattcgtctcacactttcctgacggaatctgtaattttttttttgttattagactatgtttaatacttcaaatgtgtgtccgtatatccgatatctgatgtgacaaccaaacacaaaaagtttccctaactaaacaaggcctaagaaaaatcacttttgactcaaggattacccaaaaacatacgagtcaacatcagtcactctctcaaaagaaaaacgaacaccaggctctccaacctccgttctcctttgagtacatctgtgttgaacaattctagaaaagcaatgcacgaaatgccgaccagtttgtcccggttcatcatttaccacgcgccacttactaccacgtaggaactgtatttggttgggaaaagtaccaaaaagtgcatgcacgcgccccagatctagtaagcggataagaaaatgaccagtacatttcacagaaattactgctaagcaccagtaaatcactggacagcggagaaggaattaggcaggtggcactgtggtatcacctcggggcgctcctccttgtcgagatcggcggcgcgggagtcgagcatcatggcctcgacggtgaggtccttggagtgctcctcccagtagctcttctgcgccttcctctcctccacctcaagcactcctgcgaacacaaacgcagacgcgtcagaacatcaccccgcaaaaacaacgccctccgcacgaacgagatccgcaaaatccaacacaccaacaccaacacccccacgcccccatccatccccaaaccagatcaagcagaacgagaacaaaacgcagggcaaaacagaacagatcaggcccgatccgatccgtgggggggaggagacgtccttctgcttaccattaacagcggtggcggccgcggcgtccatctcggcgggatcgttcgaccgttcgttcagtgcgattttagaggggagggtttagcgactgagagtctgagagaagggaggaggccggcgagattaagacccctcgatggcgaggcgggcgcgggagaagctccgggagcggcggttgaaggatcgcccacgaggctgcatccaccaccggatcacggcggaggttttgaggggggaggggaggaggtgcgggcgtgcgtgcgacgatgagaggtgagtgcgcagcgaaggggaggagggagggactcttataggcgggagaggggagagggggagaagaaggatccaggggaggagcggctgagcgcgcgatcagatcgaccgcgagatccgagcagatcagattttttttttcttttcgtcgttttgcctgagatgaggtggtgcgcttggcttcattcgggtcccgcgcagattcaaagcggccgaatcacaggagtatttctgcagaaatctttaggcaatgtttagttcccaaaaattttttctcaaaaacatcacatcaaatctttgacacatgtatgaagtattaaatataaattaaaagaaaaactaattacacagttagggagtaaatcatgagacaaatcttttaagtctaattagtccatgattagccataagtgccacagtaatccatatttgctaatggcggattaattaggctcaaaagattcgtctcgcggtttccagacgagttatgaaattagttttctcattcgtgtccgaaaactctttccgacatccaatcaaacgtccgatgtgacactcaaaaatttttatttcgcgaactaaacaggccctatactccctccctctcaattctaagtacggatataagttttcgtgtctaatatttcactctccatcttatttaaaaattttagaaaaaagtttaaaaataaataacacataagtgctattcatattttatcattaatataataaaaatataattataaaaatattttaaataagacggacgatgaaacattgaacacaaaatccacgaccgtggctaaaataggatggagggagtatgtgaaatggtgcagaatcgaagcgctcgaataaagaaattttcctgtgttgtgatgcagcagagagaaaatatgcctttcgttccagacggcgctaatgcgcgctgcctcgtgtactcatgtgctgatatacgacactctatcgtgtctcgccacgtcgaaatcatctcgacaacatggtactactccccaagcaaaaggaaaaggatcggaccacgtgcagctcctcgctgatcgtcgcgtgtaaccaagcgaacgaagcagaaaagttgagagttgcatcccccgaccttgcacgctgctcgttgtggcactagtataaaactgaatcgtagaggaatagccatgttcggttggcaaaagggtgaaaactttgtgaagatcaaagcgagaactcaaagcagtactgccatcgattttggcattttgcccacacgcacgagcgcaatacgagtaagagatttgcttcagttaaaaaaaaaacacctcgaggtaccggtactatcaaagtatcttcgatcgtttaatctaaccatgtccatcctacctagatagattcaacgttcaacgataaaaaacgatttggtactatgagataccgatatgtcacgtcctatgagccaggcttcaggcactgggctttgatccaggcaaacagggtgcatgcctttaaaagagaaggaagagcaacagatgaggcatcgatgaagaaatcaacagaactgaagccaaggcttcttcctcctccaatttcctctcatctctctgttcttccaatcctaggctctgttctcttattcccagtcccctgcttctcttcccaatctacattgctaattcctcttaattgtatccaaattacttgagtgattactgctgtgaattatcggttgcttccggtgttgggcattgatcggtgggtgggttgaggatcgtgacaatatggtatcagagcagtcaattcgtgggattccaagcaaggaggcgtgttgggcgacacacagttgcaatggtgacctttggaggcggaatttgagccgtggaggggttagtgctggtggtgcccgccaggtgttcggtgaaatgccgagctggctaggagatggcgcaggcgctgctcttcgtgtccaagtgagccaagtcctttacccggtgaccagcgaggtgctgcatcaagtttacaacacctatggagctgtggcggtgcaagtcctcaccacgagtcctttgggtgttgaggccttcgtgtggttccggtcaagctgtgatgcagagagggctcgatctgtcaccaatgggcgcaatatctatgatgggtgttgtctacttgatgtccagcacgtgcatcctttcaacgggaacggtgtcaacatgacgcccaccaagtgttcgacgccggtaccaagctgcgccaacatcaagtctgatgccaagagcacttctactactctagaacatgtgttcccggccaccatgagtccatccacgccctcagacgaatcagcagttgtggtgccaccgatttccctcaccgcgaccaaggagaattgggctgacatgggcaaggcggaggataaatcagaaaagaccttccatgatttgtgtgttgagataaaggacatgatcaatcagatactcgtgacatgccgcgacatcaaggttgagtcaactacgagcgttgatatcaccagagttgtggcagctacaagcaccaacaccaaatcagtccccaacacattggaggttagtaatgaggccaattcaatcagcttggttgatactaatgagttgtgcatggtgacagccaccaagtgtttgacggaaggcaatgaacaaatgatcaatgatgatgacgatgacatggccaccgaggatttagttgagctcactgaagtgaactccaagttcacactacagaaaacaggtagctctccaccagtaccaccttggaaagcggcaattccatggtacaaggctgagatgaccttaggttctcggcctttaccatggcctgatccgtggttgagtcaagacagctgaggcgtggtgatgacgaagctcttacatccccggcaaccaccttctcaagcagaagctaaagctgaagttggagcactacaattatttggctgtgtactcaattccattgaggttgattgtcaaggtgaggcttcaaaaacactgatttcagagaggacgtgttctattgagttgaggccttggccaccaccttattttctgttaaatgaggtgatcaaggaagtattggagatatgtcatcaagtaaatatgaattggatttccagctatgtatgggagaatattcaaggactattagtgctggatgatcaagtctttcaaagctcgacacagtggcaatctgctatatacaaggaaatgaactgcttggaattgttgattggattggagctattgcgtggaaaaatacattcttgttggagggagatggctcagctgaaaataccatggacacctcctcttaatgcatgtgctgttacattacttgcgcatgctagagagagtttttcatgcaaatgcaagattaaaggaagtcatactatcgtggggttatggaagcatgagtactggcaggtaatcaggtgtcaacagaagagtgcaattcctctcttagctggcaaagtgcataattggcacaacctcaagtgttcttggtcgggtggaacttttatagaggttcaggtttcagttttcactctctggtctgcagagtataatgagctccaactaacaatgcatgcactcaatccatccttttgccccagttcagtagttgtgccaatggtgtgtttgtgtagcagatcccttgaaaaatggatggcttcccatgacaaccgacatttcttattggtgaagactatggcattgtttggagatgctacaaattggacattacagtgtgagtttctctctagtgcagtactgcaatgtctacagcctactatgaagactagtgactggtatacaaagagttgcacatattcatgggtatcactgaactccaagttaattaatctgaatgaagtgattccagttgacatgttacagctaccaacttcagatgaggagtttgtaatatggcccagacccattggatggtttgcaacaagtgatcagtttgtcgatctcgggttgggctattcttcttatcatctagtcagggtaataactacggttgtttcactgaagaaatcctggttgcgggaaattattgaggagctttccgaaccaggacctcaaggacaaacattgcaaaggcaggataacaagctttgggagtcactattgcttaatgatcatgatacactatgctccttgcaactaatatggaatcctggaggcatcaaaggcatcggcttggggacaagccgaaactaaaggaagggagaatgccacgtcctatgggccgggcttcaggcacggggctttgatccagacaaacagggtgcatgcctttaaaagagaaggaacagcaacatatgaggcatcgatgaagaaatcaacagaactgaagccaaggcttcttcctcctccaatttcctctcatctctatgttcttccaatcctaggctctccaatttcctctcatctctctgttcttccaatcctaggctctgttctcttattcccagtcccccgcttctcttcccaatctacattgctaattcctctcaattgtatccaaattacttgagtgattactgctgtgaattatcggttgcttccggtgctgggcattgatcagtgggtgggttgaggattgtgacacgatacctcaagatatttttttataggaccggagtaaaatctctaggagtaaagttgaatcgatgagaagaattactcgtaccacgtcgatggatgaggtagcgaacccggtgtcccacgtgattacactcacgagcgacagggagtatccctctactgtcgtttcgtcggcgtgcttctgaccatataagacatataacttgggggtaaaacaaaagaatagctgtaacatatgccacgatatggatccgcgagcattccaagctatcatagcagaattgccattgctactcctacagttcgatgcacaaagtctaaactgaaaatatctttagttacaaaagtatatatactctggtagctatcaccagttttacgaccttttttttttgacatgtaactatgaatcagagaaaataaatttctttacaaggagaatcgtcccagaccagccgccgtcacaaatggtgaaaaaaaaaaacaaatactactgcacaggaggtttacaggcttgaactacaaaaaatcaagatcgccaagcggccacacagcccaagagaagccaatacaaagtatgtataccattgcgacatctgcaaatctcacttctgaatatgcaatatgcaactcaatagacttgaatttgcactgcccaagtgcccatctcgtgtgttaactgtgaccctacaaaagttgggcggttccaaacgggttggcttgcgggtgcatcccatttgatgctgggaaagggccgaacccagcatcgaggaaggggttgggtgcctgagcaatgcctgcatgctgcggctgtagtggtggcccgaagggatttggctgcatcatcataggcatctgctggggctgctgagtcatgctacccatttgaactgatggtgggggagctacttgattcgacatagcgaaaggatcactcgccatgaaagggttgggggcagctgaaccatacagctgctgctgctgcatctgc

SEQ ID NO: 1567 - DNA, 1919 bp, Oryza sativa
atcactcaacagttcaaaattttaaatattaccattatgagatcataagtataaaagtagaacaaattgtaaagatgccaactatcagctcagtcattaaaatttagaagcaaatccaaagactgtgtctatgcaaaagtcgtgattttcacctgaaagttgagtttggggacacttttgcccaaataaattgaaaacgcaaaaggaaaagtccaagctcaaagttaatcactattaggatgagatattgcagaatttgctagcataatgaactttttctttgagaagcagagcatgtcagcaggtctttcatggacttaaccttaaccaagtttgttacaaccactttctagattagcccaagactccatgaggtccattaattctaggaaataaatcatttacttgcaattcacaccaattacaaagttatcattttttctcacttaaatgctttctgataaacagatatatatgagtagttgtgctccctgttttcaccaacaatgaaccagcaaagcttttccagccagattgatttgggagctatggctaaaaccccgtccgatccaaaaccaagacaagctggcaggagccactaacagcagaataacagtttccaaatccaaagcgggacattatactaaccataaatatcctcagagaaagagtaagaaaacccaccaaattactgtccatggccattgagtttgtgttggtgctcggggtagtaacaagagcaagttcccatcctgtagggtcaaatcctttatcttgcagtgtagctgtgccacttgttgacgtctcaccacctgttatattgcacacaattttcagaattatctaacacaaggttcatgataggcatcactggattgaaggatgacaaaatacctgtaggaataatagccaaggccaaagcattgctttcctctattgctgatacactaggggttggatcgcttaatccctaggagcatacatatcattaaattgtgataaatgaaccagtgcagcatgcagtaaatggtttcttctacttaccaataaatcaccggtgtctacgacctcaggtttaggaggtggtggtggaactacttcagtagatggcactgcaacagcaggttcttcaatttgtggtttttcctcctcagcagaaacaggctcaggaatctcttctgattcttctggtttgtatgtcaggaggagtctctcaggaaactcctggtgaaataacaattattaagagtttaagaatccgttttatagatcgaatgattattttagtacaaatcaacatgtgattattttactgtggtgacacaacacatgtgattcttcttttgctatggtttcaaatttcaattgaagataaatattgcacaaacatcatcatcagggctgctgcttgattattataatataaaggaggcatatcgaaacgtagaaggcatttttaaaagaaatagcaggtcattttaactaagaactgaccaaaggttccttaattggaaccatgcgtggagcctctctcacatactcctccatggtcgaaaggaatgattgtggtggctggaacaaatatagaaaaagaaagtgatgacaatgatttatctgattctgatttacaatacaagaagttgcacagttagcacaaaaatacttgcctccctcagagtaggaaactggaaatttcttgcaagttctaatccccgacagttttcatagaagtccgataggcttccagcctagagcataacagtgttatttctaccattatcatcatctttgaaataccacaaatttcagataaccatccttcagaatcttagaatcacctgctgtccagctctcctgtaaatttcaagggctttgagtgcttcgtgccttggcatctcaaaaaactgcatcattttcga

SEQ ID NO: 1568 - DNA, 560 bp, Oryza sativa
ccaaatgagattgataataaccaaaccttttcaggcccttgaccctgcttcgacaaacgctcagcttcaatatcgtactttaagaccctgaagcattccagtctttcctccaaaaacaaaccgtatgtacgaacccatgaagaatagtcccaagctggataaaaagttgtattagaaacaatgggaatttaggaggtgatactaaagaaaattgatgtgctctactaaccaacaggggtggagtcatccttgaagtttgataattgcaaaatccgcactctttgtgtgaaagtaagaaactcttcacggaatgtaggatcaccatcccggagaagcctgtggatcaccacaagtgtcttcagtgcaacctacatagtgcatgaaatgaatgttacattaattggctccagatgtggaccagcgaatacttgcaaatagaacagaacactgaagagtgtctgaagtattgctgatctgctgttgaagtggtggcacgaaaaccataaatcagaaaaacttgtttgggaccaagccgatttactccctccgtttcacaatgt

SEQ ID NO: 1569 - DNA, 5222 bp, Oryza sativa
caattccgggtcttggcgaggcgacgagcaagagcatggatgcagtaggcgacatccgcccgaggcctaccgatggacgtcgccgctgcaatctctgcaacacaaccaccaacccatcaaacaccaaacccaacagagaatggggaaaaccccaacagcaagtaccctccatcccaccgaacaatctcaattctcaaatctgattccacacacactgaactaaattaagcagaaaatcgcaagcgaggatataggagattggcagattggtagtgaggacgaatcaacgtacttcgcaggtggcgctccttgggcgggcactcgacgtggttcgtggccttcacaatcgccacatccagatcctacagaggggaaaagaaaaacatcgcaaactaaaataaatcccaatggatgcgtacaacacagatccaaacgcctccccctcctggactcctcgtcccccagtcggttgcggcaaatcggatgaactgaaccagtttgcgccactggattgggggagggtgcaaaagctcgacgcggaccttgaagtcggagttgagattggcgaggctgacggtggtggtgtccttgagcgcgccgtacgccttgcgccagctctgcagcgccgacattctctgctcctcctcctcctccgctcgctcgctcgccgccgcctgctgccgcctcctcgacttttttttttctctctctctcccccctttgcttctgattatttttttctctcagccctgcggcctgattcgatttccggctacgcgtccgcgagattgctcggtgcacggaacggcaaataaataggaaggcttcgtttttccgatattgccaaatgtgaaggcgcgttggcacttttcatcacaccttctaaagcctgacgagcagaagctataaaaaggatttcttttaaatcgaggagagatgaaactttttaaatactcggatttaaattagaaaatgaatcacttctcgaatttaaaattccaatggccgcctgagacagcgtgtccagatgattggtttgttggattgttgattaattggtggaatctcatattttagactgtaacagagtactaagtagtagtatttttcaagcctaattcgaaggcaataagctagagtcaattcaggccggctgctgctcctatcaaaagcggtagtgtagcagctggtttggttaccaggcagttccatgaaagtgtttaggttggctggtccaacattgtcaaaaaggcccaattaagctacggtttaaaaaatttgggaaaattggaaccatgccattataattttataaaatttgagatatgtcattctaactcacatgtcattgactcatgtaggtcctacatgtcattgagataccaatgacatatcttaaactttgcaaagttataatgacatgtttccaaattacccttaaaactttggttaaacctttcttctgcgcatggcttgactcgtgagcatgcgctaggcatgatagaagaaagaatctcagcacagacaagtcattcatattttatgctgtacagaacgaaaaatgcgtggtggtttggctgtaaagacgattgacaactccagtgtgtcctaacaccggtggtcctaccgcagcagcatgcagcttggtttcttccttggaaaggtttggtaccagagaaaggtagggagaggtgagttgccaccgtgccagttcacaggcacgtctcacctgtgacaaaactgcggattcgtgtggcttggaagatttaactgcatgcacggcgtcggattgacagggactacgagagaggagagtgattcgctgctgattctgaagaggaggggaatgcgggggacggttgcgttctccctttccaagtcggtcggggtagctgggttgtctcgccgggtcccaggctcgccaccgctcaccggacttggatgtgaggacgaagcagacggctggcgttggagtcgaccggcagttggtccgcttgcatatggcacagaaacacactgacacgcattcggcccgttccctcgatgcgtcgttcggaatgggccaaaatcccggccctgtatttggtgatggcctgggatttcagtggacttagcaagtcagaagcctgtgagagcccaataagccctacgctgtggacaaacttctgccgtgcgttttgttatacactcttttctttgccatcgacggtttcaccagtggcgcgacgcgatccgcgtcaggcgcatctgacggatctgcttccttctggaccgaaaattgtgcgcatgtatgctatcccgatgcagcgtcttgctattataactccaatcaaactacgaattctggtagaggccctgacgatctacgtgcgcctcagcgagggccccaaagatcaattctccgccctcgccatccatgtgatggaaaaagtgcaccaaggtccctcaacttgccatcgaattataaaattatcccccaaccacaaaaccggatatccggtgtccctcaactaaccaaaaccggtcataataggtccctcggtggttttaacccggttttatcctatgtggctgctaactcagcgtgggacccacgtgggccccacatgttaggctgccacatcagcgcatactctatttccccctcttctctctgttctctccttccttcctccccctcgctctctgctctcgcacgagcggcaacgcgtgcggccggcgacggtggctcccgagtggcggcgcgcgggctcgccggcctccccgtccccctagtgtggtcggcgatggcggcgtgcggttgcggccatcatgcggaaatcgactcgacgacgccgccatcaagtcgctgccgtcgggcgtcggcgatggcggcgcgcggctgcggccggcgggggaggcggaggaggtatgcgcggacgacctcgccctcgtcgttgatgtcgccaccgatgaagaggtccgcaccgctcaccagttcgcatgcctcgtcgtcgtcgacactcgccactccggtccggccgcggcccagcgaacaagcgacgagaagccggcggcgcggcgcccccgccgcggacgagcgacaagaagccggtggtgtggcgcccccacccgaagccgccgacgacgatgaggccgagcggcgcagagtcgtcgacgccgccgctccccatccaggtcgcgctcagggtcgccgcgctgaaagcggcacatccagcgcctgatgagctgccgcgcctcatgacgttgcagttcctcgccggtcagctctcccctgtcatggtcaaattgcaagggatcgattctcctcaactcgggtacatccaacctgtcgtttgattgcgaatccatgtagacgaagctatccagctgcttggtgggtgtggcgccgccatacgacggcgacgaggctaccgactcaccagtgaactacgacctctcctcatgcgaacacatcctgtctctgaagatgtgcgtcctcgacgccatccatggtttctacatctgggcactcgccgtgctcccatcggcgacgattggacgacacggcggtcattgctgcggccctctcgaatccgcttccaacatcatcctcgtcaccgtatggtacgccgccaccgctcctcctctgcctgacgacgaggctgacttaccgggagacatttttgacaccgggctgaccagcacgtcgcggccgacgacgacgtacacctgcgcgagctccggcagcgtgcgcgcgcgaagagggaggaggtggggacgtcgacagcgagcacacggagagagggaggatgcggcgcgggagcaagccggggctccgagtccgccagagtccacctccacggcgcccggccctgcctccacctccgcggccaccgccgcggcgcccaaccccgccccgcctccacctccgtgcccaccaccgcggcgcccggccccggctccgcctccgcgcccaacgccgcggcgcccacccgcgcggggccgtttcgccggcggcggcgacgcagcgccgtcggtgccattcttgaccggccgctgccctcgtcttctcgcgcgtcacagccgctgccgcctactcctctgtcgcctcgtccccagccgccggccggcttgccccagagaagagaagagaagagaagagtgagagagagagaggaggaagggagaggaaggggaagagagaggctgacgtggcatcctgacatgtggggcctacgtgggtcccacgctgactcagccgccacgtaggataaaatcggatacaaaaccactgaaggacctatagtgaacggtttttataagttgagggatgtcatatatctggttttgcggttgagggacgattttgtaactcgatgacaagttgagggaccttcggtgtactttttcctccatgtgatcgacgaggcgttgcgggggttcgcggcatccaaacacctcagccgcagcccctttcccaatcacctaaggccgacggcctgcatccccttctcctgccttttggagggcgcggtggataacctcgtcatccctaccgcggtcttcaacaaccatagggacgtgtgctatctcaggacagtagcagtgcaaggcacgctaccgtgccttcatcccaatccagcaaggattttggccctaaattcatctctaagtcacacaccctacagtgctagtgaccttaatctcgtgaccttccttcttttacgtgggaccacaatgcaggggaccaagagtgcccagcccaagaaattaattctcgcaactacccttctctcgaactctccacattgctcccgttctccttatcccggttgcgagctcgccgagaagcactctgcctcagccgccgctccggctcccctcttccctccaccagcggctagcgccggctctcctccctccgccgccggcgccggctttacttctccggcagccgcggttgccggctcgcgcgagttcttgaaccccatcgcccacgaggtggtgctcaagatcaccagcttcggtggctgcagcggcctcgtggcggcggcgacgacgggggggcggcgtactcgcgtcggcggcagagggaggaggcggcgccggccgccggtggtgtcggtgacatgggaccgggagtatcgtgactagaggcttgggcagccgcgctcacccacgtggcctgaccccctcgggggggtcaggccctgagggtgacgtggccacccctccctctg

SEQ ID NO: 1570 - DNA, 24731 bp, Oryza sativa
tgacccatcccatcggagggtcattcggatagcggccattgcaaatctccgcccattaatggaggaatgacagggtgatcccctgtgtcaggcgagtgacggcgctgggcctcactcaaggacaagctgtgatttagcttccaagcaaaggcgcgagccaagttctgatcaagatagggtggatccccacccaaaagaagggtaggtagaagtggtgcatgtggtatccccttgagatataaaaggaggaccttgcccaccgaagaaagagaggggagatctagaacaagaataggggggacgactctgagaatacctgagctcagggagatccagaacaagaataggggggacgactctgagaatacctgagctcgtagaggacagaaagaggaagaggggttctagagcctgaactcttttgctctccagctctctgtaactccttcacacacagatccaccataacacaggagtagggtattacgcttcttagcggcccgaacctgtctacatcgcccgtgtcttttgcattggctctctcgcgaacattccacagatcgagggtgaagaacctcacttagcgcccccggccgaaccggcaaagggggacctgcgcggtctcccggtgaggagccccacgctccgtcatctggcacgccaggtagggggtgcgtgtgactttttaagccctcgtcctctttcgtgtgccccaagcttctcccgctcagcccaatggccgaacgggcagtggcgcacaacctctctccgagcgctagcggtgacgtcggggagcagaacccgcgccgtcgagctcgtactccaccgcccccctctcgccgaagtcttgggtgggaggaggcgctcgagggggtcgaaagatccgcgacttcgccacccacgggcgatggagaaggacggcgagacggggagcgtcgcctcctcgtctacggcgatggcagcacgccccagggcgcgctccaggctgcgggcgcgctcctgcgtcacccgcccgtcgtccccgatccagagactctagcccgacgttggctggatgacgtggccgacttggtcatgacggcgcagcatcgcctaggcgccggcgggcggtcctccgccaccaaggcctctggcgctgctaccgccggctccgtgtcgtcgaggcggagggcgcggcgagcggcggccgtcaaccgccgttcgtccgccattccctcgtcaacgcctccgacccaagaagatgtgcgtggggggccggatgcccgcctcaatatcgagcgccggcgcaatggtcgtcgtgttgcccacgcaacggagggcgcttcctcgtccggagcgccacttcggcccgggcacgggggccaccccccgtgtccccggttggcggtgtcggctatcgagcctttgtggcgagccttcggaacgtccgttggcccccaaggttccggcccaccatcaccgaaaaatacgacggaagcgtcaaccccgccgagtttctccaggtctacacgaccgggatcgaggccgctgggggtgacgacagggtcatggcgaatttcctccccatggccctgaagggtcaggcgcggggttggctaatgaacttgccacccgcatcggtccactcttgggaggatttgtgccagcagttcactatgaacttccagggcatatatccgcgcccaggtgaagaagcggacttgcatgcggtacagcgaagggacgatgagtctcttcgctcgtacattcagcggttctgtcaagtccgcaacaccataccatgcatccccgcacacgcggtgatctacgcgttcagggggggcgtgcggcacaaccgcatgctcgagaagatcgcctccaaggagccccagaccaccgcggagctttttcagctcacggaccgtgtggctcgcaaggaggaggcctagacctggaactcctccggttccggtgtggcagcttcggccgcccccgagttcgccgctcggtcagggcggcgggacaggaggaggaagaagaggtcggcccatttcgacgacgagggtcacgtcctcgccgtcgagggcgcttcgcgggccacccgaaaggggaggcttgcgagcgacaaaaagaaggaggctcgcgctcccagcagggaacgcccgaccggcaaatggtgttccgtgcacaacacctccctccacgacctcgcggactgccgcgcggtcaaaagtttggctgagcggacgaggaagtgggaggaggagaggaggcaggagcgccgtgagggcaaggccccggcgcctcccaccggcaaccggcgagatgaggccaggcagaaggccaccgccgaggatgtcgacgataacctggggttccaggagcctgaggccaccatcgccaccgtcgatgggggagcgtgcgctcacgcttctcgccggagcctcaaggccatgaagcgagagcttctggccgcggcccctacccatgaggcgacgcgacgagcgcggtggtcggaggttgccctcaccttcgaccagaccgaccacccgccgtgcgttgcccggggaggacagatcgcgatggtggtttcccccaccgtttgcaatgtgaagttggggcgtgtcctcattgacagaggtgcagccctcaacatcctttcccccgctgcctttgacgccatcaaggccccagggatggtgctccggccgtcccagccgatcatcggtgtgacgccggggcacacttggccgctaggtcatatcgacctcccggtcaccttcggtggttccgctaacttccgcacggagcgggtgaacttcgatgtggcggacctcagtctgccctacaacgcgatcctggggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggtgtccaagcccgcgggtggcgacgagagactcagcacctccgtcccagccgccccgaggcagcggatgatcacatgcgacgaggtctcggtcaaggaggttgccctgggcgacggcccgtccaagaccacacgaatcagtggtcttctggacgacaaataggaagacgtgctcgtctccttcctgcgggcaaacgccgacgtcttcgcctggagaccggcggacatgcccggggtccctagggaggtgattgagcaccgtctcgccgtgcggccaggcgcaaggccgatccggcagaaagtgcagcggcaggccccggaacgtcaagccttcatccgcgaggaggtggcgcgacttctggaggccggattcatccatgaggtcatccatccggaatggctggcgaacccggtcgtcgtccccaaggcgaacggcaagcttcggatgtgcatcgactacaccgacctcaacaaggcatgtcctaaggacccttaccccctgccacgcatagatcagattgtcgactccaccgcggggtgcgaccttttgtgttttctagatgcatactctggttatcatcagattcgcatggctagggagaatgaggaaaaaactgcattcattaccctcataggaacttattgttatacgacaatacctttcgggttaaagaatgcaggtcctacttttcaacgtactactcgaatttctttgggtaaccacgcgcaaccaagagaccttactctcggatctagcggaaactttcgaaagtctccgctccgcccgcataaagctgaaccccgacaagtgcgtgttcggtgtgcctgtgggcaagcttctcgggttcttggtctctgcccgaggcatcgaggccaaccccgagaagatacgagctatagagcggatgcgcccccccagcaagcttagggatgtgcagtgcatcacaggctgcatggccgccctaggtcggttcatatcgaggttgggagagaaggcgctacccctatttaagctcctcaaacgctccgggccgtttacctggacggaggaggccgagcgggccttcactcagttgaaagcgtacctcagttctcccccagtcctggtcgccccggggccagatgagccgttgctactctacctggcggcaaccccgcaggtggtcagcgcggcgttggtcgtggagcgcgacgagaacaaccctcactccgcgcatccccaccctgtgtcgactcgacccgggagagagcagggaggagaggctcccgagccgaacggcggcccgaggcccccgacagccggagctggccctctgcccgcttgtccgacggtgcctgtcgccctccgaccccgaggtcgttggcacagaagccgagtgcgccccgcgtggcctctcggacgaagagcgccctgggaatgcggcccctggcgaagaggatcggccccgccgaaaggtgcagcggcccgtctacttcgtcagcgaggccctccgggacgccaagacccgataccctcaggcccagaagatgctttacgctattctgatggcttcgaggaagttgcgccattatttccaggcgcatcgggtcacagtggttacatcttaccccctcggccaaatcttgcataaccgagagggtactggacgagtggtgaaatgggcaatcgaactctctgagttcgatttgcactttgaaccacgccacgcgatcaagagccaggccctcgccgactttgtggcagagtggaccccagctcccgagcccgtctctgtccccgaggccagctcgggccccgcgcagctgcctcacaccgcctactgggtgatgcagttcgacggctccctgtctcttcagggcgccgggcgggggtcacgttgacctcgccgagcggagacgtcctcagatacctggttcgcctcgactttcgggcaaccaataatatggcggagtacgagggactccttgcggccctcagggtggcagctggactggggatccgccgcctcctggtgttaggcgactcccagctggtcgttaaccaggtctgtaaggagtaccggtgctccgacccgcagatggatgcttacgtgcgccaggtgcggcgtatggagcgccatttcgacgggatagagcttcggcacgtgcccagacgggataacgcggtcgccgacgaactctcaaggctcgcttcttcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcactcccagctcccttagattgatcgcttggatcgctgagatccaggcgtacctcacagataagactctacccgaggaccgcaaagggagtgaacgcgtccagcgcatctccaagcgctacgtgctggtagaagggaccctgtatcggcgcgcggctaacggagtcctcctgaagtgcattcctcgggaacaaggcgtcgagcttctcgccgatattcatgaaggtgagtgcggagcccactccgcctcacgcaccttggttggcaaggcctttcgccagggtttctattggccgacgggccaccatatattgcgagactgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacaacctcgtcctacgccgcgtccaaacgcgtgttggactgagcaagctctcaccaatgtgggagggtccgtatcaagtgatcggcgtcccccggccgggctccgttcggctggccacgggcgatggcacagagttgcctaacccgtggaacatcgaacaccttcgtcgcttctacccctagtgggggtcgggtgtcaggtctcgggctcgggccaaccccgcacccccccgggcgtgcagggttggccgggggctaccacatgcatatacttaccttttttctcttccatatttcaataaaaacattttcgatttcctaaggactgtgtctgtgccattgtttcctttttgaagaatcttggcttgaattagcacgcttgtgctcgatcctgccctcggtggctcgggccgtctaaaatcgccaaaaggggcccagaaccgagccgtgccccggggtgtggtgaactccgggggggaatcggcaaaggcccacaatcgggtcatccataaccctcggtcaccacgctcccggcctggccagtctcgacacatggatctccccaggcactagccccgacccccgccgtttgaggctgggacctgggcacgagcccttgttcaagccaagacacagaaggaccgcggcacagaccatcctcgtctcatacacacaacaaatagaattgacacagaaatttcctctttatttgattgcagattaaattggtctatacaagaagggggcccgaaggcctcggaagaagaaagaaagagctatttaagattggcaggggcctgggggctcacttcgacgcgcccgggtcgccagcctcgtcgtcgctgtcatccacaccaccgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaactcgtccagcgctgcccacggggagaagtcggggtccctggcctggtagcttgccagtacgagctccactgccccccaggcgaggtctctcgaggatgacttgatcgtctcctcgagctcctcggggagccgctggagggtcccagccatctctgagaggcgctgggcgaggcccccctggttggcggcgtacttcgcggtccgctcgccccagaggcccgcctgccgctcggcgcggtctagacgggagacggcgtcccgaagcatgccgggccctacctcgcctgccaagcggagggcctcgacctccccggcggacgagtccagcgcgccctgcagatcggcgatggtatgttcggcggctgcaaggcgggcggctaggtcgccgtcgcccgcggccgccccgccgctgcgcgctctcgcgtccagctcctttgcccgcacctcgggctcagcggcccgccgagccagtgcggccctctcggcgcgggcgccttccagattgcggcgcgcctgctcctcctgcgctgcctcgcggaggaacaggctgtccgccagccgctgcgccgcggcctcggcctcctcgagagctcgctcccgctcggtgagcgtatcctcgcggaggcggagtgcggactcctcttcggcgcaggcggcctcgtgcgccgccagtgttgcctcccggatggcgacagcggcctcgcggtccgccaggtccctctcctttgcgctggcgcgctcttccagcgccgtggcgcgagcctcaagggcctcttcgcgccgccgggacgccgcctcgttctccgccgcccgccgttcccaggcagcggcggcgtcaaggactccccgagcggtgttgagcttcttctctagctccgccgcccggctcccgtattggaggcggaggtcgtcccgtacctcgtcgagcacggcggtggcgatgagagcagtctcccgctcctcctccacctccttggcgatctccgccagctccctccgacgggcctcgagctctgaggcgtgccggcggtgtgccttgcggcccgcctccaccatggcctccaccgagcgtcgcccctcttcgacgcgcgcccacgccgcgtcgagctccgcccgctccgcctgcaggacctccatctgggcgcttaacccgtccaacaccgtggtgttcgcggcggccaaggcctgcgggaggggctccgcgctcggtggggcggcagaaggcagaggggagagccgcctcggtgtgggcgccgcgcggctcggcccgccgatcgacgtgccggactcgggggcgtcccccgaagctggctcgtcccgaacatcgtccgaggggtcggacccgagcggtgtgcccgcggcctcgtcgtgggtggcttcggaagtcgtcgtcgcctcgggcggagtcgggtcgggggcttggtaggccgcctggcgtgcgcgcgccgcctccgcctcccggacggactcctcggcccggcggagtctggcctcctcccgggcggcttcctcagcctggcgaacccggacggcctcccgggcagcttcctcggcttcccggaggcggtccgcggcttctcgccggtcagcttcccgcctccgggcctccgcggccgccgtctcctcggcctcggaccggccggacttggaatggcgggaggggcacgacgggatctcgctgaggcagaagaaaaaccagaggacaaaaagaaacgagtgagtgaaaactcgccttgggagatgggagaatgaatacggccgtggtaggcgcgggaacaaacctgcggggaggtcggttaaacgaccacctcgggggcgagatgaggttcccccggcatgactcggtcccccccatcttgcggagccgtttcttctttcgctccccctcgggctgcgacgtcggcacgacaccctctgggcgcctgctgctggcacgcactgccccgccccctcggggaggagatggggaaggggtaccctcctgcttcctcttcccccgggcgtcggcagggcggctgccccccgggcccccgtcgcggggcccagaagcatgaccccctcccggggtagattgtttccccctgcggctcccgcccgcgccatcgtggcctcggggggctcgctcccccgacgccccgaccgcctacatgatggtcaggatgttggcgcgatctggatcgctgcagagggggaggactccttgggggatgagggatgcctccacggagctgagattcagcacccgttggaccaccatcttgaagtcctcaggggcccagtcccatctgcccccctggtgggtcctcatgtagtcctcggacccggtgtactcccaggcgccccgggcgcgccgctggagcggcgcgatccggcgacgaaggtagtcgccgtacaccatggcccccgtgagcccctgggatcgcagacccgccaggcggtcaagaacggcgtcgtagccgtctcccagatctaccggcgcccgccagctggaggcctgcgccgggggctggctcggaagtcggaggcgcgcttcgtcggcgaggggggtgtagaaccagtcgctcttccagtcgtcccacttcttgcggaggacgcagggaatgtagcggctcagcaccggcccccgcggctggaagtagcagccaccgactaccgacggcggcgacaccggctatacggtgaagaaccaccggaacagccgaagagatgggcacaccccgataaacatctcgcacaggtgcgcgaagatggccaacgtcattaccgcgttgggggtgaggtgcgccatctggagatcataaaactccagaacatccatgaagaaagaagagaatggcgggaccagccctgccattgcgaaagagaggaagaagacggaccgccccgggtagtgtggcgccgggcgtccctcgcccagctcgaccacctcccggccggtggcagattccggcataaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcgagggtagggcacaggaaacgaagagttggagcgcaagtggcgaaggcaaggggaatagtggcgagaggaaggaaacgaatctcttcctcggcgtctttataccctttccaacgctatgcccggctcctcgcttcccgcgcccactatctcgccccctcgtttctcgcgcccacacctccactaattccgctcgcccgtttgcggcgcacgaggcagatgtgcggccgtggcagccgagatgggacatatcgtgcgcgcgttaactacgctcgccgaccaaagcgccatcatcatgtctccaggcgaaacgaatcagctcgtcccgattcgcgcgctgctcgagtaatgtagcggtcgcgaagaggccgctcattattttcagttggttttcccttaccgatgcgcacgatttgcgatggctggctttctgcccgcctgtagagaccggccccacctgtcaccaggcctaaggagtggcgtcacgcccgagcgcttccctcgaggggggcgatcgccctggcataacgccgggggctactgtcggtgacatgggaccgggagtatcgtgactagaggcttgggcagccgcgctcacccacgtggcctgaccccctcgggggggtcgggcccgagggtgacgtggccacccctccctctgtctccccgaggggtcgggccgctcccgtttcggccccgagggctggggcgccccgaccccctgtggtgttggcgccacttgtgcgggttaggtgagcacagcggcgctcacctaaccgcatttattgcgggttggacgagcgcgccacgccgcatttaatacagcgcagcgcgctcgcttatccggtccgtgaccggtcgcaatatgtgaccggtcacagatcggtcggatcgcgggttaggtggcagcaggcggcctgtcacacgcatcgccccgtcccgtcggaacgatgagagcctccaggcactcgtccctagccggagccggtgtgctaactcctggagttagcacgccagtcccggccagatacattccaggcttcatcgcaaccattgcaaagaagtcattgtatgaagaaggacagacgtgcggcatgctaaactgacacgtggtggacaagaatgaccggtctgtgactggtctgacgccggtcacgtcatcagcagacaaaccgtgctcccacgttgcatctgcttccagcgaagtggaggtaggtatgacccatcccatcggagggtcattcggacagcggccattgcaaatctccgcccattaatggaggaatgacagggtgatcccctgtgtcaggcgagtgacggcgctgggcctcactcaaggacaagctgtgatttagcttccaagcaaaggcgcgagccaagttctgatcaagatagggtggatccccacccaaaagaagggtaggtagaagtggtgcatgtggtatccccttgagatataaaaggaggaccttgcccaccgaagaaagagaggggagatccagaacaagaataggggggacgactctgagaatacctgagctcagggagatccagaacaagaataggggggacgactctgagaatacctgagctcgtagaggacagaaagaggaagaggggttctagagcctgaactcttttgctctccagctctctgtaactccttcacacacagatccaccataacacaggagtagggtattacgcttctcagcggcccgaacctgtctacatcgcccgtgtcttgtgcattggctctctcgcgaacattcccagatcgagggtgaagaacctcacttagcgcccccggccgaaccggcaaagggggacctgcgcggtctcccggtgaggagccccacgctccgtcaggtggggttcagtttctgctcaggggtggcagcagcttcagtccgccgccatgcggaggcagggaggggtcggcgcggccaggggcgtggcggtggcagcggcggatctcggtgcgcgtggcggcagagctcggcgttgacctggccaaggcggcgaccgggaggagggcgcgctcctcctcaacgttcttggcggcggctcaagaacgggcagcgtggtcgacgccgccgcctcgcctcggcgttctgtgttcttgatttttcttgtgtgattttgtgtgacttgattttcttttgtgattttgttggtagctcggcgtcggatctcggcacgggagtggaggaatcttttcttggttttgtgtaatgtaatgagatttgatttcttgtgggaatgggggatcctttgtgagtgagatttgggttcttgagatgggtggtagctgctccgacgccattccaatcgatgccgaggccgccatggattttgtcctcatggcggcaaggccgatgccggcgcgggcaaaaggactcggtggcggtaggatgaatcgcaggcgcgggaagggattttttcgtgggcgaatctggaatttctccgagtgctgcgtgcgcgaggtcacgggcggccaagcatcgacgcccacagcgctcgctcctcgtgtttttctggcggcgcgtggattcgaccgagcaaggttgcgcgttgctctgcttggggacgagcaaccaagtttggtcctggttccacgcgacatgtcggacaaaatcctccgtgtcgccccatagcaccggtccagggtagagcactgtgaaaggcctcatctatgataacatcaacgagttgctcatcatgattccactcgctgatcaacgagttacttagtaacgattgtcgatgtagattgcacggatggcattctcaacaactactagttccatagaggtcgtgtcagtcgtggcctacgtgaccaccacaaacaataggggaattgggcttgacgtcggagctagagcattttgtcaaacacatggtgggcgtcaccttggactgcttgtcccaaccgaattttgcaagtcttcggcattcttctggactttggtcatccacgcttctaccaccgtcttgagagatagcaaatcagcgctcgtctgatctgcctccacccgccttcacttgaactcctcaatccgcctcaaaagcgtgtcaaatttatcctcacttgccatggtagcttgtttggtaggcttggtgagctctgacaccagattgctagcaacccaaatcaaccaatctcagcaccaactcaactaacaatctagccgtacaagtagcagcaaagtctagtacataggagatatttggatggggaacaaataggaagatacaagtggtggaaggtgccagaagcttctagaacaagtagtggtaaaagggaggtagggagaaatcgacaagggagcccccgaccacccaagtcgtcaccaccgccaagagcttccgctcgccaattgatttgttcgatgatttcctggaagtgctgctgcttcttatgtatagttgtctcttgggttcgcttggacttcttgaaaagtagatgatccactccaagttgcagcccagctggttcctattccctccgtcccaaaatataaatatttttgaactctgacacggtcttcaaaatgttactttgaccaataatatctataaaattaaggtgttttaaataaaaagagttgcatattatgatagtttgttcaatgataaatctagtaacatcaattttacatgattgattttttatatatttttgctattaatagtcaaagtttaaaatgttttgacgtgtcactatgctaaaatgcttatattttaggacacggagggagtaacacaaagttatattaacttatgttggtgttcaagccccttcctagggatgaagttctccgggatcaagttagttatcatgcaaacaatcacgagaccgttgaaaatttaaggaatacatgaacacatgatcaaataggtaaactacgcaaatatgcactctgttatcaagtgcttaattattccccatttttgtgaaatgatcaaatctgaccatgtatatcacatccatgttgcctgaagatgcggtatatgtaccctctaattcgcctgcgccaaagaaggcccaaaaaagagacgaaggacgtcatcggtaggaaaagccaccggcgaggaaaaaaaacgagagagacgacgacacacgcaccatcagacgaacacggacacagcaacactgtgaacacacacgcacaccgaaacaaacagaataagcggcagcccgaccgcgtccgtcggtgccagaggtatcgatcggccaatcagtcgcggtagcacacgagcagcgcgacgcagcggaagatgatgcggagcctcgcctcgttcccccgcgcgaccctgcagccgccaccgagctggctggcgcccctgcgcttcttcgccccgtggctcctggcgacgacgagctccatggtctccgcgcggcgcgcgctccttcgtcgctggctctctctgccgcgagagcgagtgagctagctagcaactactagcaaatgcgtccgcgcgcgagagccagctaattaaccgggcgctggcatgccaaaaaaacactttgacgacggtgtgggtgcgcgatggagtcggggctgcttgttgatgtgtttatataccgcgcggcgcgcgctagctctgatcgtacgtacacttggacggacgctggaaggttcaatgtaggtcgcgctaggcgctagctaggtgcagttccagtgcagctatcgagctgtacgtacgtgcaatgcgtacgtacgacgccttgaccgtgggtagctcatggtgagttccgtgcaaacgcatgcaccaacctgcaaactttcctggcccgatccagcaaccagatggatcatcgatacgtcggctcgtccatccggcatttaaagtcaaaccgcctggtgcttgattattaacgtccgttcgttttgttcagggaggttagaaacagtccaggatacacgatcggatcctgcagctaatgttgccatccgccatcggccatccgatgccgggtatgccgatacagccgtcaacccgcttgttgttcgtcatcgctgaccaatgcgtcgtatcgcgagccattaattaccttttctttgtaggtttgcgaatacgtcctgtctgcttccatgccttgaccgagcggcaagaatctttttctttcatctgcagtgcagtgcaatcaaccatcgatctgaacgttagtatcagttcgtcagggttgctatgatacacgtctactccctccgtcccaaaaaaaaacaaactctggttttcgtgcccaacgtttgaccgtccgtcttatttttaaaaaatataaaaaaattaaaaagacaagtcacgcataaaatattaatcgcataaaatattaatcatattttatcatctaacaacaacgaaaatacgaattataaaaaaatttcatatgagacggacagtcaaagttggacacggaaacccagagtttgtcttttcttggacggagagagtacacttccatatggttctgaaaatttaaggagcgcaactaatccagtatatatataacaagccaccggccctatccaagttactctttgactggccacacaataatacaatggtcttgtttggatgctccgagctattaaatagccctccagaatcttgctatttagaagtattaaacatagattaccgataaatccgattccataacccctaggctattttgcgagacgaatctaatgatgtatattaatccacgattagcggctgattactgtagcatcactgtagcaaatcatggattaatataccttgttagattcgtctcgtaaaatagcgtaggggttatggaatgggttttatcaataatctacgtttaatactcttaaatagcaagattctgaaaggctattaaatagccctccagatccaaacagggccaatatatcgatgctactcccatgagctaagcacgatccatccattttggacatgcatatgcaggatacatcgcatcaggacgaagttaaaacggctacgggatttggccggcacctcaagtttaacgtacgtcctataccatcgcatcgatcactcgtctacgggacagaatcgctacattggcgcacaagccagttgactgaaaacctcggtgggcacaaacgctaacgttggcataacaaattgtgtgaccacggctctgtgtgtcttttaaaagccggtcaaagaagagcgcttgccgttgttgcaatccagagaaaagtgagaaaactgttactactactaaactggcttatgaactcctagtagtcaactgacagcacactcaagcctctctgcagtctgattattcaaccagcgattcgtgttcaggtgacgtgccatttagtcctgcaaatagagagagacgctactgccagagtgtgctgactggcgagaatttggtagggtttcacatgcatatctacggctgtgtggttagttcgtattccctttcagaaaacaaaggcgaaatgcttgcaagttgcaacctctatagatagattttaaagaaatgcaatccatatcatgtacgtgtctgtaatctgtacaaacaagagcttgttgttaattgttgcaatttgcaaacatgtatgccgggccggccaaagagtaggtcggccaaatttcattaagaaagagagtgtttttatacaggttttgcactttgagtctttgacaagaggctgtcaaagctgaagggagagtgttaaaaaccctcccaaaagataaatttgcaaacatgtaatccagataaattgttaatggctgatgagctcctcattgccaacccgtaacacatttacaatcttctcttgctattcaaccagtggtcattgttcgtattacgtccgatgatttagcccaacaaatagaagaacccaaaatccgctattactctctacagtattggtgctgctactaattaaccggtaagaattaggtagggatacacatgcatcatctacagtatgtggtcgcaaaactgccgacgcctgcgttagtttgtgttattcctttaggtgaggtgcttgcaagttacaaacctctatagactgatttgaaacaaaatgcaatctacgatcatgtacttgtctgcaatctttgcagacatatcaataacacagcagatcattgatgaccagaagttagcctccagatcattaatttgggggaatctgacgatctcagcacatcaggatcttgcaaaaccgaggacagaaactcagatatgtatggccagggccagacagaaccaagttagtgtcaaacaagttggaatgttagccatacgtatagctaaacaaatcccagagcaagattcatgaggcattataggccacaaaatttttagaggcgttgtcccccagatcgatcttgcatcacacttcgtgcaagttgagaaaccgtggcatgtgctctgtggagtacttgcagctacccactctaaaaatattaccagtacatcaaaatgtatgatatattattggtagtttacagctagacaatagaaggcttcttttaaagaaaaggagctagagatttgggcgcttctcctctatataagcacgccaaatgcaacaggcatcaccatgctaagcagaagcacttaagcactaaacacttgtgaaggagggctgtcttttttcttcagaggtgtgatctgatttctccaacagtatgggcaatccaaggagccaagggagaagaggaggcctcggcagaatgttgaaggagcacaaggcgaggctgtacatcatccggcgatgcgttgtcatgcttctctgcaaccgcgactgatcagtgatcatactgatcatcacgcatttttgttgtagtccgggtcctccgggatatggacggacaacttctttttgttctggatttcacttccagaatctagggttaacaattctttgatcgatgtatataatcatgtatggagggctagcatgttattttccaatattttcaccttttaacaccggtgatttcgcactctactttgttagattgacataacagttctctttttgatcgttcagaaactcgatctgttattctggatccttcagaaaaacaaaagtagttcccggatagtgttttatctgaagttctgctacttgtttttctttcactttctgctccaaagaggaaacaagtctccataataattcacacactagtcaccagcaaattagaatactgtcatcaagttgacaatgaatattttgtgcataagttgggaaacaagtttacacactagatactctttgttgtcttgccaacaaagcagtgcaatttgcagcagtggacaacagcaactgaacctgaagcttcaaggcagtagtagtctctagcttgaagaggcttgtagcaccatgttctgtactttcatagttgttccccttcgcatctatccttgtggtcttccttggtactttctgcgtttggatgttacgtttggtgctgttcttttctctaacaagaattgaatgaagattaaaatttttatggtacatttttcaaaccgctaaatggtgtgtttcgtgcaaaagctttttatatgaaagttgctctaaaatatcatattaatctattttttaagtttgtactaattaaaactcaatcaatcatacgttaataccacctcgttttgcgtaaaaaacttaatcttcatcttcattttcatcttatcttgattgcctgatccgatggctatcaagaccattttagaccttaaccaaaaatctagccatgttgaaggatttttttgtgcgaaagcatgaatgatgtattgttgaatactatatacatgaatacatccaactatcctacaaatgatttcgattttaggcactgaacctttaaaaggtacgggcggttttggggtatgctctaaacccaaaccttcttccgctctcgcacaaaactgacaaaagaaccctcaaaccttctgtcaacgccctgaagtagccttgatttgtttccagtattatgaggggacctgcagtcctgcaggaatgatgcattttggtgttatagttctatgctcacgctttatagctacattaggaggatttctgacgaatggtttttatatgattcaattttatctttcagtttttttatttttaattttctatgtggtgggagaagtatgatgactccacttttacagtagtagaggtagtttttttttataacacaaagttaagattttttttttgacattcaacagagataagaaatgctattgaagcattgagagtttgagactaaggcttaagtatgtctgcaaaaatgccacgccgcctcaccgcccttttgcaggcggtcccaaggggactgcttgcaaaaaaaaatcggtgtcccctgtggccggccgttatgggagggcaacggccgtctgccatatcggcaaaatcgtcttctaggagggcgagggcgatggcgtgactagttttgtaaattttttaaatagaaaattatttttgtaattattttaataataaataaaattaaaaataaaaaaattccacttaactgatcgcttaacgggcaagatgggcctccgctccactggcccaaccacgtagcaagctccccttgaacagagtggaattttttttatttttaatttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggcatggaattttgcaggcggcccccttgccgccctccgcgagggcgattttgtactgtgcggggggccgcctgcaaatgggcggcgagggggcatggaattttgcaggcgacccccttgccgccctccgcgagggcgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatatttaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatgtttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcattttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaattctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggatctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagtcagtaagcctggtcgcgtgtgcacaaggacgaaagtcctagcggtgctctcgcagcgacggcctcttctgtgtacggctcccagatgacgtcgctcggctggagacggtcaaactcgaacacgaagtctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaatatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctatcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatcttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgaacatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatagatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacaccttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctatgatgaattgagcgaaccagcagggcttcgccgctccccttctgctgccctcccctctctctcttttgttttttttggatttttagtgaatataataaaatttcacagaggagggactgggctttatagggggagaggcaaaaatcgccctcccccagggcggcaagggggccgcctgcaaaattccatgccc

SEQ ID NO: 1571 - DNA, 2447 bp, Oryza sativa
tcacaccccccggggccatggagttcgaggcggacggcgcccggtggccggagccgcgaggcgacgctgccggggcgccgccgctggagcgtggcgatgcgccttcccctcgcttcgattcgtctcgtgccctaaggtaagcggcgaaccccctctctctcttgtctcgagaaataaaatcctcagacgagtgataaagctctcgcaccgtgattcgtctcgtgctccggtagaacttaatttatagggtttgctgtgggatttattattgtaggttgatgtgcttagctctgcttttgtacgattacgaatttggccaagttagagattttcaataaaatgcctgttgagtgtgtggggaatagtttctagtgtttaggcgagcactggtaatagcatgaatatggataaattttgtatacgctgccaataactgatgattggttttatacgaactactagatgctatctagcttttcagaacaaggaattcatattatatgaagtactaaatgccatctaacttttgagaacggggaatttattttatgcgaggacagggcagtgaagaaaagtctgtttgacctcattgtattgaaaaactcacgggatataatccatactcaggcactaatttaaattattatttgaactttgttgagaagatttagggtcaaaacacggttggatgcagaaatatttttgtttaaggtaatataatctatctgattgcatggtttggaagcgtgtactttgatcgaatatatcttttttcagggttttgcatgaaacgccttgatctcctttgacttgttaaagtggaaataagtttgttaacttctcaagcaataaaaaggacctaatttttaacatatagttcactaatatatctaatgcttatttctgtgttctctagttacccacggcagaaactattttagtgttcttattgatttctttgttgatggcagattgctgagagagcttggctcaaatgtaacagaagatttggttgtgctgatgccaaatttgctatcatttctgaaacatgatgatcctgtggttgttaatcaatccatagctagtgggacaaatttatttgctgctgtattggaagagatgacacttcaggtcttttttgtaaaacagatatttattaatgaataaatccattgttgttgtaattactaccgttgcgatgctggtattatcgtttgacgaggtttattttacttgcttctcctaattgttttgggagtatgtctcagaaataaacaaattgtgccaaaggaaatacaaaatattaaattgttttcttggaaaagacgtgtttataacctcagagaccagcacttcttgattgcaatgcatgttttgctctttcagtattattggaggcactgcataaacccagtactttgctgtttgctgttttcatttattctgtttcacatgttcccatgggtcagttttatgcaggacagatacagcctctggctatcataaagtgcttatgaagagtagtactgtctgttctctactgtcagtatgctaaaagtgctcggcaatcgcaaatcttattgtgataccactagagggtcaaaccatttcagatggtgcatccagtgaacaagcctttaaatccttgtgactccattaatactgtgtctagcttgcttctattattcacttttactcccagaaatcattttttctgatgatttaccaatggtctatgttctagacgattggtgaaggagcgtgctttgtctcgtatatatttgtgctagagtagttggaccagaagtagttgcatgtcagtttggtgctagaatagttggaacagaagctgttgcatgccaatttggtgttcttttcttaaatcaatcagttaaagtgactttactacagtaagtcgacaatcttacacaactatatcacttacaaagtgacaaaagattctgcataaatacaacataaactgtaccagctgtatacatttgaagcagtgtgaaaaatgtgtcatgtttgttcaattcatatttaataactagtgctgattgatactagcaaagaataatatttccttttgtaaactgtgactttataaccttgaagaagcttccaggaaaatgttatccactggatcacatgttaaaacattaaacttacatttgtactgtaattataaaaaaaatattactatcctaataggactctatgtgatcaagaacaacttgaagcttctttcagtagttaaaaactaattgagccatacaatgctcatagatttgtttgttagctatttgttttgactattttacaagcaatggttttgtgattatacccgtgaagatttaaggtagtattttacacagtagggtcagagaaaacccatatgttttcatttagttctgaaaatgcaaaacgttatgtagaatcactat

SEQ ID NO: 1572 - DNA, 1120 bp, Oryza sativa
tggatgggctttagatttcatcggccggataaatccttgttcttccaaaggtcatcgatttgttttagtagctacagattattttacaaagtggacagaggctgttcctctaaaaaatatgacccataaagaagtgattgattttattttagagcatattattcatagattcggcataccacaaaccttgacaactgatcaaggatcatcatttatgtcacatcaagttcgtgaatttacggaatcttttaaaattaagttgctttgttcatcaccatactatgctcaggccaatggacagaccgagtcaagcaataaaactttaattaggctgataaaaaagaaaatagaggaacatcctaaaagatggcacgaggttttgtctgaggcactgtgggctcatcgtatatctaagcatggtgcaacaaaggtaacaccatttgaattagtatatgggcaagaggccattttgcatgttgaggtgaatctggacgcccttagattggccagacaaaataatttgtcggcagtagattatcacaacttaatgatggacggaatagatgaggttagtgatgaaagattgaaagctttgagagagattgagaaagataaattgagagtagctaaagcttacaataaaaaggtgaaggaaaaatcgtttcaaattggagatttagtgtggaaaacaattctgcctgttggttcaaaagataataaatttgggaaatggtctccaaattgggaagggccatatagaattgtagaaatagtccccgggaattcttattttgtgcaaagtctacgaggatataagttgcctagagcttttaatgggagatatttaaaaaggtactatccaagtgtttggcaagatgcttaaaaaatgataatactaccgatgcatggttttcatcgtgctgagaagtgtgtagtttgtttatcatcgtcccgaggaatatgtcgattatggctaattatagtatggccggtgtttaattatttaccatcgtcctgaggagtatgttaattatagctactgcaataattatgttggggcagcttagttttatttttcggacaataaattttacccaaaaattgacagccgatgatttta

SEQ ID NO: 1573 - DNA, 1569 bp, Oryza sativa
aatcatttactttcatgttaaatactcgcacaattacatcagctctatctgatggttgttggccaggttcaaatcgaatagtttctgcaatttcttgccacttaaagttacaagtgaatgtgacaaataaatcaggcgagccatacacacgacagattgccatcgcatcctgataattcatcaccatatatcttctaccgccggtaaagctagcaggaagtatctgacgtttgccaacagaatctccattagtaacacctctatcaatcgcatctacgattccttctacagtttcagcacgcaaatcagcttgatgatctattatgtattgtatcctattagcctcgatagtagaaaagatatcaacaacactttggtcactcagtcagccataacatgtgaaaggattaggctcatttagtctataatggataaggtatctgtagacctcaagcattgtagcatattttctaccagttccatcataatttctatatttaatgcctagatggaagccacgttcaccatatggaaatagcaaaggatactgcaaagccatatatgatggatgcaatgaaaacacttgatgcattccatgatctttatcgtgaacaagcacaccaaatttatattcttttgctgaaaaatcgcctactattatgctagctatttcaccacttgttggtaggttatactgcacatcatctttagcattgcagcctaatagcgaagagttattttttcattaccatgttcagagaggcggtctctagcatatctgaaatttttaacaagttcattattggtatcaaacatgcgtgttaaggcgctaacaatttcagggtctggtctatcagcattgtcgcaatcattttcgaaaatatttaatcgattttggatttcattgtcagaatcatagatatatagctgcgcaaatttaggtggtgcacctcgtgatggcagaagagtacaaattctgtgatgcacaacaccattgattttgaaaacataaggcgcattcccattattaattgacttgtcaatagctgcacccattgaggtgaaagcaaacatcgaattatatgatcgaatttgtctcaaaaatcttttggaacgtgcatcaccattgaaattcaataaagttgcaagcggttcaggtagaggacataaaggaggcaattcaattttgccacttttgcaacataggttgtaaactatttttcttttcgagacagcagagagggttttaactctctcttgataccaaaagatggcaccacaaaatgggcattcatatgtcggaggtcagtagtacgatcgttctgggtatgatgctgtaacatacatatttgattatgtcagtttttttccttaataaatgtaaaatgatttgcttttattagaaaaatacaaaccctttaaagattgaatgtaatccttatctgtctgggatgaactaccactggctttcctatttgcaactgcagtcaataaatattttaaccatatctaagttatgcagttctagcagcagtatactacaataaaaaaaacaccttttcagcatac

SEQ ID NO: 1574 - DNA, 31325 bp, Oryza sativa
  unsure (1)..(31325): unsure at all n locations
gcacaagccacaatatgcatgcatgcttggctacttttgctatgagacgtttgagaaacacaaaaaaccaaaattttgggacagacaaaacctcttttaatcacattgtctcatgttaaaatactactgctgtcattgaacagagaacaactgtaatatattagtagtttggctcaaataaatttgtaaaaaaaaaatctactttacacaatggaaagcaaagtctttgaaaactaaggttccaacaatttgctaggcctttacttttgaggcaaaactgaaacagagaaaacactctaagcggggacatacattaagcctgatgcatgagaaaatgtttctttacagggcattgaacctccctctggtctgatgattaaattgctatacagctgattctactctttatacactataagatgaaactaaacaaaaccctatgtatatacagcaaatgaatgtctccagaattcataatggattcaaaagataatcgtatgtatatacagacaagcagtagtatcatgaatgaatagccatatatgatgaaattgtgggagcatgttgtagtaatagcctcacattatacagcaaccataaataaaatatcaaaagccaaactccaatatcaatacgcaatgttttagaagcactgaatactaattgcacaatacaaaaattaatcatgcacgaggcatgtttaatgtgaagtaatcagtatggcactaaagcaaaaaactgcagtgacggatactcctaaatatagatataagaggtgccttaaaattattttgtgcaatagtaagcatggatctgacctaacatcttgcacaatttcataaaaaaattgaactaagcttgcagaaaaggcaaaaaaaaaaacataatagtctaaaggcacactacccatgatgcagaactatcaagtcgctttaatagtttgacaactgcagcgctgaaagctcaatgagaaatgtcactccgaagcagcagcagaaaaagaatgctaaagagtttatatataaaagcaaaggcctaatcaaagtgcaaagctagtccatttttatctgctcgctgaccaaatatcctgcactatataatatatatatttttttgtttcaaaagggaaaagatgtcttgcaagcaactgtgccactctcctactctcctagccatcatatgaactccatacatgtgtatgttttccatcctgcaaatcactgggtgtttatttagatttcagtttaatctgtataaaagcgaggacaggtgagaagcaaaacttttgctttgaggtcgctgtgcacagattgattagttgtattttttttaccagagagaaccaatacttaataatagaggttatacctttaaaacttcatatggctagcttaccttaaaaataattactaacttttctgaaaaaaaaaatcagagataatgtgcagagctgaatgagaaatgtcactccgaagcagcagtacaaaaagaatgctaaaaagagtttatatataaaagcaaaggcctaatcaaagtgcagagctagtccatttttatttgctcgctgaccaaatatcttgcactatataaaatatttttttttttgtttcaaaagggaaaagatgtcttgcaagcaactgtgccactctcccactctcctagccgtcacataaactccatacatgtgtatgttttccatcctgcaaatcactgggtgtttatttagatttcaatttaatctgtataaaagcgaggacaggtgagaagcaaaacttttcctttgaggtcgcagtgcgcagattgattagttgtatttttttttaccagagagaaccaatgcttaataatagaggttatacctttaaaacttcatatggctagcttaccttaaaaataattactaacttctccgaaaaaaaatcagagataatgtgcagaagttgtgcagccatgtaggattaaaacgtcaaatgcacattttacaaactatcgaatgacagttttaatcttactttggataaagggaggtagagctagaagcatgaaacgttgtgaacaacatttagaaagcaggacaagcgagatgtgaatagcaaatatattagatggaaagaggaagtttcacaataatagctctaaagcaagaaaagatgagttcagggacaacaaagcaaaaacctagccgactttgataagaactaaagatgaggtggagggaagcaacatcgttatgggcagcaagggacaaaatatcaggaaagagaaagagagtactatgcgagaagtgtgtgcacaagaacctatgcaacggctacaaaaggcactgcagtgaccgttatatggctgcaataacataggaaaccgacaacacgcatgtaccaagtgataagtgtcagaaataagctattaatatagcgacaaacaaagcaccataaatgcacaatattgaaaagaagcagaaaatagtgcaaaatagtaatcaataaacagaaaaggaaatactgaaatagggtatgagagagatggaaataccttatacgaaacagcacccaatgtgttgacaacgcagcagaagcaatgtaaccaagaagatgccacgcaagaaagatacccacagaagacaaaggccttgaccgagaaatagaagaaagggtagaaagggacggtcaccaataaaggtgaccagagctgcgcaacagaaaaagattgttagcaaacataaacctgaaacagaaggcaccacaaatacaggggatatttccatatcgtttaaagcatatatatacagtagaaagaacctaacctgcttgattgaaccagcagcccgaacattccttggcaaaatcaatcaagaacccttgaagcaccgcttcagcccgtgcaaatccggccctctacaaatcaagccagaaatcaaagaatgattagaaggcctaaaaacaggaaaagcgacatcgaatagcgctgacaaccaaactacaatgtcgcctacatcttaccgtgccatattcaatgatcaaaagcaacaacaaatagatgtatcaagtagtacacgtgaggacgcaagcagcaaaagagcgatgaaaacgatagagcgatgaaaacgatggtgcaactttgaaagggaagcggagaaaagaagatggctcccggcatctgcaaaggaatatataatagagaagaaggcatagacttgtgcatcacatctaataggaccaaccatacccaccaatagggaagcagcatacatggaccccatggcattcaaccccacctgaaagtggaatagcctaatacatctcgcgtaacgaaggaaacaccctggactatacaccatgagaggcctcgctaatactacatcggataaggccccacaatacagccaggaggagtatatagaccaggttcaccaataggcaccgatgcaaccgagaaaaattgagccaatcacagcaagcagcttgccccatcccaagctgacaaccgcactccccaagctgacaaccctgagcaagcatgcacagttgtgcctcattacataggcatattccatggtaggtatgaaaccaaccctaaccatatggcctacacgccagcggcaccaaagccatagaccaattgcatcgataatgcattgcccaccgtcaaacacaacgaaaattcacaaacgcaactggacgacaccgcacaaactatgacgaacaaaggccacacgatctagatcaaacggatagggtggcaagcaaccacaaagccccaaactgaccaggattgcagccgtgggtcgtggccaatgtgcgaggactcagcagcatccacgccggcggcaaacatcaacgctttgacctcctccatcgccgccgagctgctactgccgccaccaccgagctcagcatacccgatagccctggatgtgccacatcgaacttccccatcagtttggatctggattaaacagagagagggaaagtgtgaagaaagaaagggtgggtgagctggccctttccctgtggaactcaccactgcggaagaacggccggcgtcgacaccattgatgagcctctgcgctagcgctcgccctccactctgagtgaccggatccgccggaaaggaaatcgtggctgccgcatccagcacccacggcctccctttcgagtgggcgtcggcggcggcgtagcaacgagaccgccagcagcgagggcgcagcgatgacaccgtgcatccacaacatccccttggagcagcgaatggcagggcgcgtagggaggagtgcgagcggcggccacggcgctccgaggacagcgggcggcggccaccgcgctggcagatccaggcggcgggcaggagagagcgagagagatgagagcggcgtggcggcggtggttttttctttttttttctttcacgcggctggagactgggggtttcgggaaggggaggcagaacgcaagaaagaaggaaatttttcacaaaggcccctgagattccacgattcaggggcggtcctttttctcatttttttctccttcgtatcggatttcgtaggattcgaagggcctaaacgaaatattttaaagccaaaaaatgtacagcaagaacgtataacataataactataaaagagagggcctttttgcaaaatctacagagacgacgcggccgcacgagaggacgcaaaatccagcagcccaccagcgcgcgctgacgtgtcgcgacgcggcagcatccacgccagcgcaaaacgctgagggaagagcagatcaaggccggtttgaagactttagatttttgtctccttcgtatcggatttcgtaggattcgaagggcctaaacgaaatattttaaagccgaaaaatgtacagcaagaacgtataacagaataggtataaaagagagggcttttttgcaaaatctacagcatccacgccacggaagagcagatcaaggccggtttgaagactttagatttataggcataatgccccctcttattcctacactgtagacggaggcctgttttgtccactgcacacttcaccattccattccatggcgccgccgctcctcgatctcccctcgcactgcctcctccctcgccttcgccgccccacctccggccgtctcctccttcacctccgcctcaaacctctctcctcctcctcctacaccaccaccaccaccaccaccaccagtagctccacctcctcctcgcgagcgcctcaagttccacctagtctccatggcccctcgctccgccgcggccgccgcctgcccggcgaaactgacggcctgctctccttcgcccgcatcttcgatctcgccgccctccgcgtcccggccgccgcctgtgcgcccctcgagcgtcgcctccgtggccacctcctcaactggcctcgcgtgcgcaacgtcgtccgccaacccggcgacgacggcggcctcctcttccccgttccccatccaagcctcgccactccctcctccctgccaactgcggtggctcgccgagagaagctggcccgcgagttcaacgcccgaggcttcgtgcaattccccaaccttgccaagatgtcgcggccccccgcgaggaaacggaaggggaagaaggatgaaggaggcggcgaggctgcggctacggcaagggatactaaagacaaagtatatgtggtggaggtgatcggagagagaaaagaggagcacggcgacgagtggatggggttggtcggggaggaggggttcgggaggatcacgtggagaggaggtcccacccggttgctgctcctggacgagaactatgccaacaagagggttgatgacctcccggaggctgtcaaggtgatgaattcttgtcaccaaatagcctttcatagttgcagttgtagaaataaaaatcacataggttaggaaaagtttctatttgaatgattctgtggattcaactgtgatcaaatgaggtttgggtgtgcgctggccaaattggttcagcattctaccttgatgatactcacaagaactcaccagactagacagtattttctttctaactattcttttcgagaccagatgaggaaaatcacactttcagcctgtttaaaattttaatttacgtatttcactggttttgacacaatattaccttatttggacccagaaatggtagcttattttttattcttttttgcaaaattatcttcaaggtttatgaagttattacaaaatagataccaagaggatacatgaagaaatgatgtatatcttacttttgtagattttctctttcagtggaatctgtttactagttttagttaagccaacttttcaggttgtgttggaccatgaaactaacaaggatggatcttcatcctacgagcttgtgcaatgccaattgaccttgttctacaattactggccaatgaatgaggtattttgccacctgtttacagttgatggtctaagcatcattttctttcagttctcttcatctcttgttattatttttgtccaagtatttgctgttttttgtgccagtgcatttttttgattaggtcattataccaacggcttcctttgttatctaatgccagtgttgtccttgagatgttctagtctccagttgtatccctaatccctaatattataggatacacatggatttaaacacaaagaatcagttagcagaagtgtgagccaactactatcatgagttggcgattgattgaaaggatcaatcatcaaagttggtttgactatgtgcagtaaatagccattcattttgtgttttcaaccttctgggcttctgtctgttgatctggaagccataaattatatatatgctaagaacaacatcttgctgctgttcaatttgctgaaaccggccaaagtaagaaacattgttacagctgataaatgtaaaccatcttagtgcaagtgttgcatgtcacatgtaaaaaaaaatagaggtgaaagactttatccaggagaaaacaaaatatgagttggttcttacaggcagtgttacttagacttggccagactacttgtcttgtttgacatgtgtcacaagtggctgatacttaggtgcctaggtcaatctgaccaaggtgggtaagatgaaccattttacctccttaccaactgggctatgctcagttcctttgagacacctttttttagttctaatggtatttacccttgtggcttaccttttgttctagaataaaattatccaatttctgtagatttaaaataatgcttgtttaatttactgtattgttttcaagttcttcaaagtctgtagaattctttcttttcaagcttctcatttgtgtcagtatctgatgcttctgtactgtccaggtaacactgcctttgcaaataccggatacagaccaaaagttcagtctgtacaggttagattgaattgtctcaagatcagagtctggtcccagttttctcatagatgattggtctactctgttcttgcttcaaagatgtgacaacatagaaatgcaattgaaaactcagtcgtacaaatgcattatcgaggcacaaatatgaattgtgggattactaattaacttttaggcagcacaaatttcaactccacagattttgttttcaatccaaatgctgtataatggtttgatctaccgaaatgtttagatattaaactgtatgttccaggagcatgaggactgtattagcatgtcatcacattgttacttgtggggtctattagatatgttgatcaacattgcttcacatggaaaaaaataaatattcttatgcaccatgctcgttgtctgttcactttctgctgcttaactgttttgattgaatcttactttttgtagattttagaggaaatactcccagaaggaataatcgttcctacagggtttgagacagtagggcatattgcacacttgaacttgagggatgaccatttaccttacaagaagcttattgctcaggtaatatctaattgcatgatagcttccattcttgagtatgttttcttgtgctctaacatttgacatgcaggtggtactggacaaaaacaagccaaagatccaaactgttgtcaataagattgatgctattcaaaatgactacagaacaatgcagcttgaagtcttagctggtattgattcccttgtaactacggttattgaaagtggtcttcggttccaagttgatctttcaacagtgtatgttctatcctctcttggctcatatttgtcacacaacatttctgatttattgtgattgcaaaataacaaaacaaaatgatttcattatttgcaggataaaatccttacctacatatttgtagtttgtggttgtgctatgtctataaagaattctattgtttgcacttgaaccatagtttaattgctatcattaacctcttttccagtaacaaatcttcaccaaaagatttccctagtgtttcttattctatacatgtaataaagatatagtcaaatctcaattcaacattcacattcttaagatggctttgtaatagaaaattttgaaaatttttagttgaatgttttgaaaagttcataataggactattgctttttatgaataggtgtatgggaataaatggtccctcgtgtaatccataagattagctactgtgctatatgatctctttttctcaatctagggttgcttttttttgacgaaaaaaaaatctatggttgcttattaattggtgcaatgatttggaagctaagaattttgttactgtttgatttttcattgtttctgaatgatgtgtattgtttgattataataatcttctatgtttcttaacttaatcatgagactaatgatcctcccatcctttaggataatcaatcttatatgaatcgtgtctatgatcttgattgagttcaaattctcgttaccttggatggcaatatattgctctccaatcttgtaggaaaaaaatattgcaaacaaatatatccactactacagctagtagtgtctagtcctgttcaattcttcaaagagcaaaactggggccaaacaatgaacttgaagcccaaaagatacacttgggcattgcccatataggccaaccttgtgtagcaaataattttttttctcgaatacgcaagaagctatcattgcattaatagaagaaaaaaggcgtcgaacacgccaaagaacagcaagtagtagacgaactcgcgccaccacacaacaacccaccgcaagggtggaaccagaaccatgcctagccgggatccattaataaggagagcctcttagtccctgccaaattccataggcgggcttcctcacttgctaatataaaggtgattgataatcttggagctattccgttgaaaacacaatcattccgatgttaccaaaaatagaccaagcttcaaagatgatctagctgttcagacccttgccatctgatgatccgtcgttgtgtcccccacctggatgggagtagatgccttttgccttgcgatctgtggttgccttgttgctctcaaggcgggtgatggtggccgtatgctctcccagggtgatctccatctttttcagctggtcgaggatggctgccagcgcagcgttgctctgcccattgttccttgtgttcccgacatgttcacaggcggcaggaagatgctctgataccaagttgtcacggcccgggctgtcaggagctgggaattgaaatggatgaatggtctctgagttaactgaatatctgaagtctgaagattctgaagaaaatgcattggaaggatgattatgagaaaagaacggtcaggattaatcgcgaatcggaatgaagatctgagagtccgttcttgtcgggggaccactgttgaattctagttgtcattttactctgcttttgagctggcagtagtgcatcctatgatgtggtcctgtctcacttttgtttcaattgtaatcgcttcttaatcgagctagttagcctggaaattataagagaaacctcatatttatcttgttttaggagtagcatagcatagaaccttaaattagtcttgcagcgaccacttgagaaatttcccgattcggggttctattcttcatttcggtgaaagagagagaggctcggtcctggcaccggcaattgccgtagattgtacggatgaaacaatggaggccaaagcctctggcgccgcggatgtcgaggtacgatggcgatactctcctaatcatatctctaatctaacaagactgatcctaacagataagtaactcaatagacacgcacaaactcgtaacacactcaaactagcttttgccctacaagccaccatcaatctgccgaactggatgtagcttcgaacttgttctgccatcgctcatacgaaatcccccacctaacaaatcagctgtacaacaacgattatgagccactaaccacatgaagaaacggcattttccagggcccatgacttccaaatgcactccaaaggaccaaaataaatggccccttcaaagagagcatcataagtagatttggccaagtaaacacctgaagttgagaacctccaagaatgtatgcccggtgaccctggttgtaatatcaccgagcaaagggcattccataagccaagaaaatcctctaaccacaatggaaaaagctccctgaatatcggagatccacgaacgattggttaaggcctgaagaacagtacgcttgttaaccttccgctttggcaccaaagcaaaatggcgcggcgccacttcctcaatgtgctgcccaaacagccaacgatctctctaaaacagcgtattagcaccattcccaaccccagagatcactggctcactgccatgtagaacaaggatgtaatccgctcactcggataggaaacgtcgaccatggcttcaatggttccttttttgcatccaaagccatctcaccctttagagcataactgagaagcttaagatcgaagattccaaaacacccaaactcttgaggctgacaaactatgggccaagcaattaaacggtgaccaccacttgcttcctttcttcctctccaaagaaatccacgtctaattttatcaatggccttaatggcccaagccggcaaatgaattgtcattgcaagatcgatgagaatggaggtgagcacaaactggacctgaagtgcatgaccagctttactgttctaaatggcggccaccactagtgttgaaacatgatttcggcaatactaaaagggggtggctatcaagctggaaaagtggtgggtttagagacaaggaattttatacaggttcaggccttcttattcaagaagtaataccctactcctgtccggggattgatccgccgagtatattattgatcgtatgatctgggtgaaattcgtgcccctagaggcacccggacccctccttatataggggaaggggtccgtattacaaaatacagtccatatccctaacggaatatgtagttacagataaaatacaatcgtaaccgactaggatctcggatattttcttgacatacaagtttagattttaacctgagtccttctaaagatattctatctacacatggcaccccatacccagtcggactatacatgccgtgtaggtatggggtatccataatctccacaactaggttgtttacctaggaatagatgtcacctcctttcagccatatttctatctaggtggcagcctagtccgattacttggcctctacatagtggctactgcttacttgcttagcattttctagaatactgaatagaatttagaaataatatcatgtcttagccaacaatatgatagtgtcaaagtaagggtatggaaactggtggcattcgatattggaccgaatgagcctgaatagtttaattttgaattagaatgttattgatttcttatagatgtatttattctgcctggttactgactagtaataggtccggctaccggtcactggccggtaaacattatttggattcaaatatttccagtaagttctggtaaccagcaataaccaaccaactaccagcgttgcaaaggagacctgcatttttgtattgggttttaaaacctcggttcaagcgaaaactcaattacttggagatggaaccatagcttgttagtgtttgagttttgtcaatttattctaaattttacttggaaactatgtgtagcaggaatagtaaatggtctcatttatcaattctgcatgataagtgcatgcttaagtttgcttgttctcttgggtagtgtttggttgatgggatgggatgggacgggacgaacccacttttagaggtgtttggtttaggggtgagtggaatgggttggttcctagagaggaatattcctctcagatccgggaccaagccatccggaaaaatctggcggacgaactcatcccacctgggatgagcgcacggcgtgaggtgccgcttcgccccgctcgctcgctcacgtcgtgctctgctcctctgcccatcgtgctcgctcgctcgacgaacaacggcgcgctcaagcgatggccacggcggatccggtggtggggagggcggcggcggcggcgtatccggaggtgggctcaggcgacggcggcgaatccggcggtggcggtggtgaaggcggggagggcggggatggctcggtggcagcggtgaatccggaggcgggctcgggtgacggcgacagatccagtggtggggagggcggcggcagtgaatccggaggcgggctcgggcgacagcggtgaatctggcggtggcggcggcgaatccggaggcgggctcgggcgacggcgacagatccagtgatggggagggcggcggcggcgaatccggaggcggcctcgggcaacggcggcgaatccagcggtggcggcggcgaatccgaaggcggggatggcggggaaggcggcggcgacggcgatggcgggcgagggtgagttctgcggccaccacgtccatatcgtcgttgtctctgatgtcagcgccgctccttcttccgcctgcgccactggtcgccgctcctccttccgctcacaccgccggtcgccgctcatccttctgcagcttcgctccttttctcgctgggagtaacatggtgctaacgtcactccaaatgtcattcatcccatccctacccatcccttctaccaaacaaaaaactgggatcattccatccaataaaccaaacaagtaaatgggatcgctccatctctaaaatcagggatggtatcatcccatcccacgtagtccccaaaccaaacactacttggtgttgttagacgtcctggaggtcaaatttgcttccctggtgtatgtattccatttggggcaattgtattcttgtccctattttcaagtgcaattgtctttttaccctttgttttcagacatcgtgatttttccctcactttttgaactgaagcttcggtctaccccaggtctgttaagtcatcctaatggtgttaagtatatggtaaaaagacaagtatgcccttgcatattttcccttcttttgtacactagttctgtttttgcccttattttgataccaagcattttgacaagaactttgccccagtgctgacttgaatttcacatatttcaaatctgatcgagttttatttgacaaacataacagaatttcaatataatttcagccatcatttgacaacttcataaatattcaagcaaaagtcattgagcaacatgacttcaattgttccacttgcaacaacaaattcatcagttctattttctcttgcatgtatagactccaaatcacatgagtagcaacatcattcttcatatcagatgacaagtgattagccaactgggacatgttcaaccaaaaactctgtttctcttcttcctctgaaacaacggccatgaaccttactgttttttaagctgctatttcgacaaccagatctgccaactgccaaacaagctcattcatctagttttctgtgcaaatttctgttgctacaatctctgctctattgttttctgaaacatgtatcccacagggcgactaattagccatagaattaaaaaattcaatacattatttcaattggaaattttctagacagctcataaattttagaaacaatgaatacccataattttaggtagtatttccagaaacatgcagcttcagtttaggagaccacatggtggtcgcatcctggcggcgatatctgcagagggtcaccgccttatggcctaaacagcgaggggctccagcagatgaggcagggagaagaggtctctacctgcacgctgagccgcccctcctcctgcgcgtttagttgccccctcgcgctgccgcacggcgctctcatgcctgcttgctgctccgtgcccgctcaccgatgaaattagcccgccgctgctgctgttgccatgacgagagagccagggtttggtatggagaatggggtaacacacatgtaagggctgtgtggctaattgatgttgtatttgggggtataacaatccttttattctgtaaatcatttttcattccctttttcttttctttaactccctaattcttggcacacctaacaaacatccaaaccaggggcaaacgggagcttcggttacaaaagtgatggcaaaatcataaagtaaaaaaagaggggtaaaatcacaattgtgtttgaaaataggggaagaacacaatttccccattctaatttacattgagtggttctcagggatgtcagggactcgtggctgatgtttcagaaagtatttttggccaccactattccttgcaaagcattttgttccatgttgttttagcagtgaaaccgagactctgaaaatgcaatgctctatgctgctccctccatcccaacatataatgcacccacaattttaggaaaatcaacatttgcaaactttgactaacagttaaagtgtactaataatataatgtttagtgtcatgcatgtgacatcattagattcataaaaatatttttcatatgatgttaatttgtgtagtttttgatgatatatgtatgaaattaatggtcaaagttttacattgaagacactgcaaaaaaattatacgcctcaattttttgggacggagggagtattgaacttgatcactaaatctgaatacatgatactctagttacattccttttgttagctagttctgtctgatttcaagaatatatttagatatcttaacattttcttgagaccaccaaatgtaactgtttggcgtgtttttttacacaatttatgattttgtttccgattctcaataatgaatggctaacaactttcttatgcagttattggaattctagattatcaacagaaagacagaggcttgttgaccatgttttcaaaaattctgatgttgtttgtaagttctagccctgctttttattataacagaggtttttgtggcctgtggaatcaggatgacagtctacattgttttgtaactttgttccctttcaagatatcgatcttttctatttagagcaatttacactgtgtttgcagaaaagataaacacatagtcatgtgccactacttgtgcaaacatgtgtactatttacttttggtattgaccctgatacctcctcaggggcagcggcaatttttagaaagtatacatagcaatgcaccataggttgggcaagtatttgttcgctgtttagtgttgaaatattgtgtcttgcagtgtttctgcattggtattgtattgttctggtagcttgtataaacatgacagcaaaagattgactgccattttattcctgcagttctcttcctattcacatgaaaagcatttgctgtcttcattatgaacatatattaaatatgataatcagtgtccatgcatgttcttcatcatgctcagcttttgtggacaaccaaatggtccatgtagaagaaaataatgtaatcatcatttacggggtgtgttctgatgatcacataaatcagtatttgtgtatatgtactgaataatcgtattttacaactcctgtaatgtaatatggtcgagcatctgggtcgagtatgttttatgatgtatgcacccctggttctggagtagttcacagtaactattacatttttaatttcatcttctcttaagcttcacaatatttacttgattataaccttttccgtagtgagtgaaagatcaattgctaccacatcctttatgcaggtgatgtgttctctggtgttggtccaatagcaatatcagctgcaagaaaggtcaaatatgtctatgcgaatgacctaaaccccactgcagtggagtaccttgagagaaacattgttcttaacaagctcgagagaaaaatcgaggtagttccaactatgagataagcgagatagcactcatgtctttctatttattaataaatttcctgtgatggctttcagattttattgtagcttacataaagttcattgttagcaacctagcatcaaagcttaccgctgtctcagaaaagcatttggttggaaatcctttttgcaccactagaaattagaaaatacaccattttagtgcttatgttcgtttgttaatgacttgtttcaagtgtatctaatggtttagtgtggatttttttctccgtctttatggctcttgttgatatttgttcattgttttgtcgaaccaggtttttaacatggacgctagaaggtttatcagttcaatatactcaagccaacatgtgcatccagtcacacaagtagtaatgaatttgcccaatgatgctgcagaatttttaggtgggttttcattatttgtgttacttaattgaactgttatcttgagttcttatgattatattagagaacaaatttcattctagtatggtattggcttaattcactcattcgcccgttgtgaaacatccactaaaattctgttgaattttggggatgtatattacaaaggatatgcacggtttcatgtcgggttctctcctctcacttttttactatagaagagtaagaacacacaatgccttttggattgtgatcagctgaaatgtagtaatttgtaacctgcatcttataacattgattatatggcattacacattgcagatttacagaatacacatcaaatgtgaatacgcatcgaatgtttgggagaaaaattgtttgggagaaaatctttcttctacaaaatggcattaccaatatagaaactaaataggggaagaaagtctatgagtggtagggactagggactagggagtatattgatgagagtggaggagagggtgggaactaaatgagacgggcgtttgggacatttaccagtcttattattttcttcttctcttacaccatgtgctgtcgccccgcggcaaggcagcacgtgttatacttggccggtcttgcctcccggcttggcgacaacatccacgaactagttaatcgattcgcaatgatgactaacgagctagctaactaaatcaaatctagctaattgactagctagctgctgctatgcatgcaaccaagcattggctgctgctcggttagggacatcaggcggtcggtcttacctggccatatggtgacaccgtctgctgccgagcggcaacagcagtgtcgtcatgccacctggcaaatcaggtatattctattatttttaaaaaaaatagtatatttatgcaaaaaaagggtgaacattgaaatttagttctaaccttacctgtccattctaatggccaatatgcagccgatgttttttggatgggaattttgacagttaggctaatcacaggaccaattaattattttatgatttcactgtttccccagatgtgttcagaggaatctcatggaaccaccatttggctgtgccttcttgtgtaatgccaaatatacacgtgtatggattctccaaagcagaagatcctgaatatgacttccatgaggtaagcagcgagtattaccaaaattttttttctttaagttagaactgttgtatacatagttctgtttatcgattgacacacaccccttgaattgcagaggatnnnnnnnnnnnnnnnnnnnnncgtgtccgatgttgaaatgcatagagtgcggctcgttgctcctggaaaatggatgctttgtgcatcatttacccttccagtatctgtggcgtttgcaaagccaaattacattgcatgttaagaggacggcctataacaaattaaccatcttgtatattctttagtgggtgaatgaaaatgacagtagtgtttatgcatcagctgaagttagaattgatcgtcttggcctactacatgcatgatgatacatcattcgtgatcatcatatatctaaattgaaggtcgttcgtttgtagaaattgcttcaataatccaaaaggattttacgatgagaaagtataaaaaaaaagctatgggtgaagcgccagggacatttaactatttgtcatctatgtgttaatgacatatagatccgagtggtaaattaattgaagagtgtcaaatagttaattttttccatttgccccatacacagtagtggatgagttggctcctctgttccgatggaatagctaaaattatcaagaacctactggtgcctctctctctctctagatagttcttttttctccttgggcagtggcctatctagcatttagcatttagatggtctaacttacataattttttatttttgttaaagtgagataatatacagttagttcatcatgacataaggatatgatttgctaattgttacccttgcaaacaaatgtattttttctcttcctaagaatagtttttctttctttttaacacatgtatctttggctacgtatttctaggtgatcctggaaccacccacaagcttggaataatatggttgcaaattttatgtatatattaaatgtggtctgtcgttggggcatgtgtaaattttatatagccattgtttcttaagagtaaaataagacaccagttattaaaattctgtgtggaatatcattgtggttattaagctttgaaaatacatagtatattaagaccaaattaatttgctaaatatatcgttgcaggtctaaaatctaatacatcagatctttaatgctaacagccggatataaagaaagtagataaaactaattgaggaaacggatgttgtgattaattgaaaagtagatgtaggtggaaaaaattgaatggtgaaagtttgtgattgaccgagaagagaataatggtggagttattatgttttatgacaaattttaaatattagaagttgctatattttaagaagtaccactcaacgatacatttaggagcgtcaagatagacattgtattataagctcctcaaccaaccaatgtaaaagttcgaattaaaggcttcttcacattgctaccacttttaagttttaaccctaataatttttgttctgtaagtatgaattaagagctcttcaccttgcttccacttttaagttttaatgctaataatttttggtgttatcgataacaaactaaacataatattgtatcatcactctaccaaaatttgacatttcaaaagtttcttctcacataaatactagtaattttttttggcacgaatactgtaatttttgataatgctgcaaactaaacatataatgctacaaactaaacatatctaacattgccaaaatttagtaatactaaaatatgccaaaatttatgaatactaacttttggtttggtttattttcgtgacaaactcaaccctgaattccttaacttcacgttgcgcctaggactgacggttttcgttaaccgagggactgcactgcagtccccattaccgttcaccgttaacgggcccgcaattcaatcgatttgttggtcagcccatactgtgccatctcaacgcagcagctcagtagtcaaccaaatgtaactagtctcttcttaccggaatccccacaccttctcgccacggtccgacgcgcaagcgcggcggcgctcgctctcgcggttctcggtgacggcggcctcgtcccactcccgcccggggatgaacggcaccccgttgcgttgccatctctagtcgcgcatgaccacccgcgccggcgcacctctcgccgtcttcctcgtctcgtccctcaagtcggccgccgcacgcctcagccacggcgagcagctccacgcgctcgctgccaagtcgggcctgctcacctccaatcttttcgtccgcaactccctcctcgccttctactcccgcgtcgcccccagcctcgcctaccacctgttcgatgaaatacccccgctcctccgcgacgccaccgcccacaacattctcctctccgcgctcgcccgcgcgggccgcctcgaacgcgcgcagtgcctgctcgcggagatgcctcagagggacgcggtctcgttcaccactgtcatttccgccctctcgcgctccggtcatcctgagcgcgccctggccgtcttccgcgatatgctcaccgaggccgtgcagcccaacgaggttacacttgcggaagtgctcacggcgatggcctgtgaccacggggcaccagcaccagttggtgctgcccatggcgttgccgtgcggcgtgggcttgatggatttgtcatcgtggccaccaacctggtccatgcatatggagcagtgtcacaggttccttctgcccgttccatattcgagctaatgccagatagaaacactgtcacttggaatacaatgcttaattgctatgtcaaggcaggaatgattaacatggctgctgaggtgttcggtgtgatcccagagagggatgaggtctcttggttgacaatgatagatggatatatgtgtgcggatttcctactgcaggctctcaggacatatgttgcgatggtgggtacggtgggcataagggccaatgaggtgatacttgttggtttggtcaaggcatgttctcgacattccgctgtctcagaagggcaacaactccacacagtcattctaaagaatggttttgacgctcatgcatttgtacaggctaccctgatccattattacgggtcttgtgattttattgaccatgcccagatgcaattcaaattgtcagacaagtcacacgtagcttcctggaatgcccttatggctagcctactaagaaggaatctagtgcatgaagcaaggcagctgttcgatgacatgcctgagagggacaccatttcttggagtacattgatatctgggtatgtccagagtgggaattcaaacatggctttgcagatattctgttcgatgctagatgctggtgttgaacctaatgagatcactttagcaagtgctctgtctgcagtagccaattctggcaccttggggcaagcaagatggatccatgactacataatcagcagatcaatccagcttactgataaactgagcgctggactgattaacgtgtatgcaaagtgtggtagcattgctgaagcagttcagctatttaaccatgttaaggataagtcaatttcagtgtctccttggaattctatcatctgtaatttagctatccatggctatgtgaacatgtcgctggaattgttttcacagttgcaaagcaccacccatattaaacccaactcaatcacataccttggtgtgttaaatgcatgttgtcatgctgggatggtagctgaggggaagcgccaatttgagtccatgaggcaacaatatggaatccaaccagaaattaagcactatggttgcatggtcgatcttctttgtcgagctgggtatttggaagaagcagaactgcttattaagacgatgccaatgaaagctgatgtggtagcctggggttgtatccttgcagctgcaaggactcaaggaaatgtagccttaggagaaaaggctgcagaagaattgtcaaagcttgacccaagccatggagcatccaaaatagccttgtcaaacctctatgctgatgctggtcattggagcaatgtgtcagtggtgaggaaggaactccagaatgagaatttggaaagacttacaggaagcagtggaattctacaattataggtttcactcttttggtgacaactgcaaaactgctcttatgtcggtgaactaattgcgacaagcagtttattttcgtgcttgatctgttctgttagccaacacatacaatcattattttgctcttttagactaaacaatatgtgaactaaagaatctctaacatgacatggcaactattcatattggaaagttgattggctgttagactgccaagaagattagctggaaaagtagattagcatcacttatggaggtccccttggcctttgccatgttgtcatttggataattgcatctccgaacttcgatattcagtgttataagtgcttaattgacatgtctgataattaataatcctaggtcagtgatgccagcattcagtcttcggtacatgtttagactcttttactttttaaggtaaatgaatgacatccatgttcaatcgtacaaacattgtagtaatatggccagttctaagtgaatctttctagcattgatagtagttatttggtgcagtttgtatgtgaatacaggactacaaatattaagtaccacacatattttgtgtgcgcacggttttgtttcagttgcaagatgcattttgaatttgtaaaaaattggctcaaacaatctcacttgaaaagtttggagatgtaatgagatgttctgggtacacaaaaagaaaagttaaatttagtgttaagagtgtgattacttgtgttgtacaatagacatgtcaatcatcctatgctcttaaatcttaatccatgcttttttagtccatacacctttatattatttaaatattttgacgatcatgttatcttttgtaggttttagaaatatagctccctcaaggaacaataattcttatagactttgacacagtagggcatatttcggtcttcagcttcacatatgaacattaggttacaagaaactcaattgtcaggtaatatctcattatataatgcatttgttatccaatcttgtatatgctttcttttattctaatacaaagttttgaacttgctgctggtgctactcaaaagcaaataaaatatccaaactattgtcaacaagacagagatgatattttcaattattatggaattttttgcaatttgaaatcttggccggtaagtgttcccttacaacagtcactgtgtaacctttattgtcaaattgatattgcaactgtatatgttcttatcctctccttgttcatatttgtcggacatcgtttaaaatgtttgtcatggtataataacaaaaaataaaagtgattcagtcataaatattatgactgaaagcaatgcacttatttgcagcctagtaaaagagtggagctataacaagtaaggggaaatagaaaaatggaagttcatatgggacacgtgatagagatgattggaatccagaataaacagaatttagaggatgctatattttggatgtaatcttaatattatcatatattaacatggattcactctggaggagaaattaagacatctcattggcacattcatgtgtataggcaggaaattgaactaaaatcatgcccatacatgtggataggcagggtttttgcccatccaaatcgtggccttatggaactgaacagtcctgtaaaatgtcatatgcaaatcttgaccttgtggaactggatgtcctgtaaatttttagatgttacatttccaagaagaatatgttctgtagacaaaaattgtttttctaataactagcattatgcctgtgtgttgcaacaggaggaccattatgaaattttctgagatatttagaaattattttgatgtatttcttatagacatttaatgtgtatggatttttagaaacaaaaactattttgaatgaaagtctataagatcttttaggctgaatctggatgttcccatccatccctcaaacccacctgacgccctcttccccagggacctagcccaccttattttccaccagaataagttcactcaggtccctcaatttgtcattgagtctgaaattcatccctgaaccgaaatacagatactatgtgtccctcaactcccaaaaccatttcaaatagggttaaaatgaggggctctggtgtgtgtgcggccagcaggggtgaggggccggttgggaattgagcagcaaaaagtagctgccccaatgttaatgctgcagtgcaaggtgtaccttccccacctcttttctctgtagcaaccttcatttgctgagagccaggcacattaagcagcacacatcctgaagcgcatccaacggtgcagattatgggtgcagatgctccagagttccaaacggcattttcatatattctggtcatccccttgcaaacaattgtgatatgtaatagtcaatttttttcaagaattcctttccgatctgaaataataaaatcataaacatggctcacgcgcagaggatctacccaaccagcagggcgccatcaaaacctggtcttccactactatggaaaggaatcaaccgagaccgagcaaggtgccgagcttatcctccacgccatcatggtaatccctagctcttgtagcctcttcctagtgccatagaagctggcgcctccaacaattttggcgaatagcgcccatagccatgcagacccgagcgtacattgctccgtcgtcgagctcaccgtggacatgccatcccaaagctcctctcacccaccttattagcaaaatcgaaccccaagacgctctgtacactcctccattcaataaattggccggagtccccgactatcgccaaagccccgaacctccttgagctcggccatggcgttgccatgccgcaacgctcgcccctgctccgccttgcgccgccaccacaggtggagggccgtcggaacccgttcgcacctcccttggtcgtagccgagccatccccggccgagtccgcctcgcaccagccaacgctcatgcgtctacttcccagtccagaggttgaagacgacctcaggccgattttgactagagtcaagcacctgtcatttggtctacaaaattattcttaagagaaataatttggtaaatcagataaataaaccttagaccccacatgtcagccatggtaggttgtggataatgtttcggaataaaaataaatcaattaggaacagtactgtttcacaattattggaattacttcaaatttgaatattgttttgactatatctcactcattttagctctgatttgagtgaaacttgaacctgaattcatctaaatttaggagctttccaatggtatataattaattatttaataaaatttattttataattataaaataactaatgtcaaatggttagataatggcaaacctaaaaatgtgctaataaatgaaaattgtcattgtacagtaaactaggtaggagaataattgtctttaacatgttgtgccactgtagaaaccatgtaaatcaattagaagtattgtttcgaattaattgaagcttaggaaatactagtgccatttattaatatatgtccatatataattatacacatgacttccaaattatataaatgaattttagccttatatttttgtcactaaaaatatgaatacatatagatcagtccttagattgtttgtgaggaataataacagagctattatgaatgaaccaccaaataaagttgatttgtgcaatagcatatagttggattggttagcacccattaattaacaaaacagtaaatagctcatgctcagtaaatgatccaatactagtatatttttacactcacagctactctacattccatttaaattatatagaagaacaatagcctaccttttgcattcctctgtcccaaaaagagtctaatcatagggatgtatctggacatacaggttgtctagatacatctctagaattagatttttttttttttgggacagaggagtacatgataagcatgtatagtagaaaaatattaattctaaatcttgacctcatataattgtagttcaactgtgacttaggattgtttattgtaaaattatgcaatgagataatccttaactacaatattatggaccacacgaatctaacatactgagcatggatatttgttgaatgttaattacaattagaaaaaatctacccatcatatgtcatgaagaattctagtaataatgctagcggaagttaactaaactgtgccaacaaataaatcaaccatatacgttagtcttgctaatgttatgtgatttccaatctccattaataagccaatccccagcctgtccatttgaatcattacatttagattactctatgagccatttcacgtctctagtgccaatcattttatgtagagtggagccactgtagtgatagtccatccatagcccagtaagtagactaaaccgcatgttaacaaaatgtatgtatcatgtgtgttggttagctcctaaataagccatcatgacaatagaaggattaagaagtcttagcccctaagctctcttgcccataaggtgcttgcatgttgagtaatttagagcctaagctacctcaattttcccccttgcctatataagccgctaccgccattttgagatctcttagcaccatacaatccataagcaaacgagagtagtatgagcagccctaggtatgactccaacatttatattttgtttgagcatatttgattgttgtttgaatattggtttttatcgcctatcatagaatgtgtatcggttagtcgtgaggcaactcatgcaacttccaggaggtgaaggtggatcaagtattatcaagaataaggactatcctgagcagataagtcatcacccctcccttaagcatgttgatcccaattgcgaacttactttgtttacaaataaaaatgtatgcaatgatgaatatcctacttgctattgtgacatgcatttgactattgtttaccttattcctttgtacccataattacgtatgagtccctagtcacttatgacaaatgcttagtaatgctaatttagattcatgcattctcatatttattaaatgctatatgcttgggcaattaccttagggaaggtccaattgttcgtccgggtgtttccattctacatccgtctatcgacccaaacaagccaagcccaacatcccagccacgactatttcgtccaaccactccaaaactaaataataatgtgatgtaagacctaccatataaccaagtcagtccagaactcaccataattttcatgggcatttcttttcttctcttcaacgtcgtacatatgtgtgtgtgttgatatcaaaaattgacagccgatgatttttattcggttattttatttggacgaggtcttgccgaatgtttttattcttctacttaattgaattcggttgttcaatggttaatcaggttattatcagagaatatatgggcaagtgcttctcctgaatgtgatgcatgcatgtatggtttaattccagttttactttgcctcctggctcctggcgtagcagcagtacattttctatggaagataaagcttgagaacaaaattaatatgctgtgatgctggatggaagatcacatgatcaagttggcagcatagaggtgacgtacagaggcaaggaagtcggaggcgctgtgcatatgcaacgttttcatttctatgttaattttcattgttttggttaataccatgtgatctctaatctaattagtgtgggaccaagccaaagaccaggcaccctatatatgggtctaggccgattggaaacagacaatacacaatcaatcgatacaaaattcctgtcatatttccttttactcgttttgctttcctttgtgttgttttgttcgatccccaatacggccgccggtgtctaccgtcgtcgcagtccctccggcctgctggtggcgacgccgccgcggcagagcagccgctgctgcgtgcacgtcggctggtagcagcagcaggagacgtgttgctcctggcttgctgtgcgataggcttgttgtgcatctgtgccacagcaaggaagccatctcctacattccgttacacgcacacacaatcgtaccaggtgaaacttcagtgttgctttttcaggacagatcaagtgttgcattcctagggcaaatcttggtggcaacacattttggcgactccgcgactccgctggggaatcgatcgaaagaaagaaacaagaactggagcggctgacattattgtgctttcagaagacgaggcaaggtatcgtccagaaggaggctacactgccatccgtctatgtcgaacctaaggtaaaacccactgtaagtgatccaccggtgacccaagaacaaattgctcttatgattgatcaatcagttagtgctgtggtttttaatactcatgaagtatttattaaaaatatggatcacgcattagatgctcgtttcaatgcttgtgttaaatctgttattagtgcatcaaatgggaaggacacacaacgacaagtatcacataatactaatgcttcaacttctagcactactggtaaatcaaagcaaggattagatgcatcggcgatgtttacaacacaacaaaatacgccgatgacacaaatatatagccgaactaatggtgggggttcggctggtagtgcaggagcattgccatttcccatgcagcatgatgttggacaggggggcacaccattcacattgccacagccaaatagttcagctagctcggctccgattatcactaattcaaattatgatagccgagtaaatgggaatttagaaagtacatttgtgcctccatatcctactgtggcgtataatatacctcgtattccaccacagggttcagtcattacatatggtgcattacctaatagtaataatagttttttacaacacgcaccatatacaccgccgacccaaatgacacaatttttgcatggtacaccacagcctaacattttttagcagcaaccacaatttgatgtgacccctaatcggcctatggccgagccacatgtggtgccggaaacacttagagagcaattggtcagtgtttttagagaaacatttgatgtggaacctaagagtagagcacgcacttatcgaaaaccatatcctgatttttacgacacagtgccatacccccgtggttttagagtgcctgatttcattaaatttaccagggatgctggtaggacaactttagaacacattagtcagtttactgcacagtgtggtgaagctggtcctagtgatgctttaaaattgaggctatttcctttatcattgtctagtactgcattcgcatggtttaccgctattgcacccaattctattcatacatggtcttagttggagcagaaatttcatgagttcttttatactggagatgtagaattgaggttagcacacctgacatcggtcaagcaaaaatataatgagcctgttgttgattatattagaagatttagagacacaagaaaccgatgttttagcctagcattatctgacaaggaccttgctgaactagcacattctggattacttccacactttaaagaaaagttagagggtaaaatcattttagatgttagtcaggtattacaacaagctctggctcaagaaagccgtgctaaagagtccaagagtttttagaggtctaatgataaatctagtcgccctgtcaattttgtagacgatgatctcatgtcatcggatgatgagaatgtggatatgtgtgtagccgaatggtcatgggcatcgaaatctaaaccatttgtttgctccgctttgaagccggtgtcccaaaagaattggcaagaagaaatgaaatttacttttgatgttgctaagtgtgatagaatttttgattacctattacaagaaaaacaaatcaaattgcctaatggtcatgtcattccatcacccgaggagcttaaacgaagtgcatactgtaaatggcataattcacactcgcatgctactaatgattgtaatgtttttcgtcgacaggttcaatcggccatcaatgaaggacgattgaggtttgctgagagcccaaaaatgcaactagacagtaatccctttcctgtcaatgtgattgattttgagaatagcaaggtacttgttcggccatctcaggccgaatccactaaaaataaagctgtgatagttagtgatggtggtatgcatacagtgaagactcctagttctgggtctggtcagagtagtttgccaaggatgattaaacctagaagcccagaaattggtcggtggaaggttaatgagagtaggaacaaagctacaaaaagggttgaaaagccgaagcccacattcaaagacctttcggcaaaatatgagggaagagccggcaaaggagttgctagccggccaaataattttaaaagaccaagatcacctccaatgcaagggtttgagggtccggatcgtcgatgggaggatttccatgcatcaccgccatatcctccttttgggccaccgatgccgttaccatggggtcctcctcctgttggttttcctccttgtccaccatggggttggtgtggtccatgggtgcctcctgctccaatgacttatgagccattccatccgatgccctatcaaccgttccacccagtgccatatggaccattccatccagtgccatttgaaccattccatccaggttgggaagcaccaaggaggccggtgtttgataggctgtcatggcctagggatgaccgatctaatcaaaggaatcggtcttatgatgagaaaaatggtggattggtgaataaggtgcatcgtgtgaaagaaggtggcgattcaggaggaaattcgagtgcagttttggcagcaaaaaatgatcagtcgacgagcggcaattcacatgtgagtaacaaagtgattagtactgcggttgctacagaacaggcccaggtgaacagtgctccgactgctacagtaccagcccagatgaacagaaccgcaatcacagccgtgcctgccgaaatgaacagttcttccgctgcagtgccagcagctgattgtggtggtggttcatgtggagaaaatgtgtctatgcagcccggcaaaggtaaacagctccaatggtgccctccagatattggacacactcggaagcggaggctgcaaagattacgcgcacaagagttgagacagtctaaggctgaga

SEQ ID NO: 1575 - DNA, 1538 bp, Oryza sativa
gctaatttgacacttaatggattcacgggagagccaacagaagctaaggacattatttccatggagctaactattgggagcaaaactctccctactgccttcttcgtcgccgaggtgcaaggtaattataatgttatgttgggtcgtgattggatacatgcaaaccattgtgttccttctaccttgcatcaaactttaatacagtgggtaggtgatgatgtagaggttgttcatgcagatacttcggcttgcgttgctttagccgatgcctcagttgattggcagtatggtaatattcagtgtttaacaggcttagatctttctgattatgattatgttattgtcactaaggatggttttgtacccgtgtctataaagccggcttctgcagctcggctcagtagtgtgatgttataaatgaataaagaaagcaatttagattggttacaaaaacgtgcagagcaatatcggtcaaataagaacgatatttgggaggctattgatgattttgatgaagtagaaaaattaggacaaggtttttcgtcggctgaccctttagagaaagttgatataggtgatggcaccattcctagaccgacatttataaatcaaaacatgacagccgattataaagttaaagtaattggtttacttagagagtatgtcgattgttttgcatgggaatatcatgaaatgcctggacttagccgagagctagtagagcatcggctacccattaaatctgggtttaggctttataagcaaccacctagaagatttaattctaatatgtacgactggatcaaagaagaaatagaccaattattaaaggcgggttttattaggccgtgtaggtatgcacaatggatttccaatattgtccctgttgaaaagaaaaatactgggaaattgagagtgtgtattgattttagagatttaaataaagccacccctaaagatgagtatcctatgcccatagctgacatgctaattaatgatgcatcgggacatagagtgattagctttttagatggtaatgctggttataatcaaatatttatggccgaagaagatatgtctaaaacggcctttcgttgtcctagttttgtcggtttatttgagtgggtcgttatgacatttggtttaaaaaatgccggtgccacttaccagagagctatgaatttaatctttcatgatttacttggtgttatattagagatatacattgatgacatagttgttaaatcggaatgtatggatcaccatttagccgatttatgtttagcgtttgagaggatgcgtcagtatggtttaaaaatgaatccacttaaatgcgcctttggtgtgtcgtctagcaaatttctaggatttatagtacatgagaggggcatagagatagaccctgccaagatagaggctattagaaaagtaacagcgccgcagtgtaagttagacatgcaaaaatttttagggaaggtaaattatttgaggaggtttatatctaatttgtccggcaaagttaatgcatttacacccat
